United States Patent 10,233,495 (METHODS AND COMPOSITIONS FOR SCREENING AND TREATING DEVELOPMENTAL DISORDERS) - sequence listing, part 37

SEQ ID NO: 415 - DNA, 2883973 bp, Homo sapiens (residues 1,441,988-2,883,973 of 2,883,973)
  misc_feature (1300925)..(1400924): n is a, c, g, or t
  misc_feature (1735004)..(1835003): n is a, c, g, or t
  misc_feature (2703741)..(2753740): n is a, c, g, or t
tgccttattaaactttaatgggtaactagtagacagtaacactctgggagggctcaaaccacataaccaaatgtgccaagataatcctgagctcactattgtcaggtaaggcaaagtattttagtgcaatagcaaacaattaattaaacaaacaaaaacaagaaacctttcttgggacaggaagccattaattagctaagctcagagccactcattgaaactaggtcctgattgggtttctggatttgaccactgggcagaaactaggacccaaaaccaattggaatgaaatggtccgcagatattgttttcatgtaaggataggtttggaagtatccagacttagtggtgggccaggcctcccctgcgagcagtacagttcaggacacctggactgccctttccctctgccttccctggggtaatgtgaatggcttagtctttcgtgttctcaactgtaacatggaggaggaagagaagagcctcactgcacatattgggtcattaagaatgatcttagagccataatttacaatattttgaagttaggtttgatttttaccactccactactcctctcccaatatgttgtgccaaattgtaagtaatttgcaattagaacacattgaagacatatatttgagctccttagagagtctcacccacctttgtggtaactttttgtacttcaggttttctcaagtcagagtgttgagtccttaaatcagtgttgggtagtgataaaattttgatacattgggtagtgataaaattttaattgcctaagtttagtaaatgggggacaggcttgcttatcaacagtctttgtggcattttatgctgaaaaagccttgaggctcagactcagcccacagttctctgcactccctccacttcccttctgtgcctttcatgtgtatcctttacagcaatttttttttgtgagttcttttcctttttgagatctctcttaaggttaatggtgtacagtagatatccagaacttattcatcccttttagctgaaacattgtaccctttgacaaatgtctccccatatcccctgggcacaattttcaataggtagttagggaaagcctcaatgaaaaggttgggattttgggatgctgataacattcagtttctggaactaggtacctttacacaggagtatcagttgataacaattcattgagcaatatacttaggatttgtgcactgtactttttgtatgttatagatgaataaaaaattcagaaatctcataaaggtgatatttggataaagacttgaaggaagtgtggaggcaacaaatataaacatctggggaaagagggttccaggcagaggagatggcatgtgtaggtgccacgaagcaggagcacgcctggcatgattgagacggcagggagtcctcatctcttcttcacctacgctacatctctgaaatggccatttcagaaagcatgaaatttatttacatgagtttattttaacaaatgctcacttttgatattttacaagagtaactacaagtttattatagaaaaatttgagaaaacatacatatgcatgagaatacaacataaccatttaacatttaaaatttttcctttcatcacacttatattcataatgtttgtaattaagtgtaaaatttactatgcatgtttatattatttatatttatattttaatattaaaaactgattagttaattcaataataataattgattgtgaatgttccagggactactctaaatgctcatgcacatagcagtgaacaaaatgtacaaaaattcctatgtggaacttatattccaaagggagacaacaggtgttaaataaataagtaaactatagtatattagggagtgatgaggaaacgtggagaaaaattagaaacgtcaggtcaatagggagtgtgtgtgggagctggcagaggtgcattttacccccagccttactaagatgtaattgacaaaaacagtatatagattcacatgagaagaaaaaacaattcacagaactagcatttgactgtttggtgagacattctggagtttaagctgtcatttaaaccagttacgattttccatagggagctactctgtcacttgggtcttttcccagttaagcaaggctactttccatggaatcattatccagtatatgaggctcacttggcacttgttcaatatgcgcttgccttataataggtgattggatattttttattaaaaaactatgcatttgtggcatacaagatgattttttgatatgtatacatggtgaaatgattaattcaaactaattaacatttatcacttctacatactttcattttattgtgtgagaacatttaaaatctcttctaaaaatttcaagtatacttttggccctatgtttccatgagttccacattcaggcattcaaccaactggatagaaactattagtacaaaaaacccacaaaaaatacagtaaaagcaataaaaataaaaaaatgcagtataacaactacttataaaacatttatattttattagtattataagtaatctatagatgatttaaagtgtatggaaaaatatgcgtaggttacatgcaaatataaaatgatatcattttatataagggacttgaacatcccaggattttggtgtccttggggagtcctggaacgaatcgcccccctgatattgcagatatttagggacaatggtataacacatgactgttaactacagtcactatgctgtacagtagatctccaaaacttattcattctgtttagctgaaacattgtaccttttgaccaatatctctcaattcccctgagtggaattttcaatagctagtcaggaaaggcctcaccgaaaaggtgatatttggtcaaagatttgaagggagtgttagggaaagaaatataaatatctgggaaaagagcattccaggcaaaggagatgacatgtatagggaccacaaggcaggagcatgcctgccatacttgagagacagtaaggaatcttcatcttttcctcatgtctttctcacctccaatatatttaaatatggcttccccccaccacacccttaaaatggccattgcataaatcaccaataacatttgtgttagtccattttacgttgctataaaggaatacctgagactgagtaatttataaagaaaagaggtttatttggctcatggtcctgcagtcagtacaagcatggcatcagcatctgcttagcttctgaagcctaaggaaacttctactcattgaagaaagcaaagagggagcagttgtgtcacatggcaagaaagggagctaggtggggagggggttgtcccatactctttttaaccatcagatctgatggtaactctactatgggtaaaatgcaaacccattcctgagggttgggttggataccatcaccatcccatgagggattcacctccataacacagacacctcccaccaggcaccccctctgacactggggatcacaattcagcctgagatttggagggtgcgttgaatataatgtgagctgtaggcttgtaatacatggtctttattatgttgaagtatatttcttctaaaccaactctgttgagaatcttttcatgaaacaatgttgaatttttcaaatgctatttctgcatctaattagatgattatataattttgggcttcattttgttaatgtatatcacatttatagatgtatgtatgttgatccaccttgtatccttggggtaaatccacttgagcatggtaagttacctttttaacgtgctgttgaattcagtgtgctagtatttgattgaggattctttcatctatgttcatcagggatattggcctataatttttcttttcttttcttttctttttcttgttcttgtctggccttggtgtcagagtaatgttggccacgtaaaaaaagtttggaagtgaagtattccttcctcttagattttttttggaagagtttaaggattgctaattatttcagtgtttggtagaatacaacagtaaagctattctgggcttctctttgatgggagactttattacaattcaatcttcttactcatttttggtctgttcatactttttcttcatgattcagtcttggtatcttgcatgtatcttggaatttatttatttcttatactttattcaatttgttactgtacaatttttcatagtactctcttatgagcttttttttcttatgagcttttatatttctatggtatcagttgtaatgtctcccttttcacttttgattgtattaatatttgagtcctttcttttttttccttggtctggctaaaggtttgttgatttgtttatccttctgaaaaaacactctttattacattgagttcttttctattgtagttttagtctctattttgtttatttctattcagatccttgttatttctttccttctgctgactttgggtttagtttgttctttttttattagttactagagttgtaatatcaggttgtttattttatattttcctttttaaatttttatgggtacacagtgactgtatatgtttatggggtacatgagatatttttctacaggcatacggtgtataataattacatcgcggtaaatgggatattcatcacttcaaacatttaccctttctttgtgttacaaacaatgcaattatgctcttttagttatttttaaatgtactataaattgtttggctatagtcaccttgttgttctatcaaatactagatcttacttattctatctaactgtatttttatgccgattatccattcctccccttaaccctactattcttcctagtctctggtaaccattactgtattctctatctccataaatccagttattttaagttttagctcccacaaataagtgagaacatggaaaatttgtctttctgtccctggcttattttatttaacgtaataacctccagttctatccatgttgttgcaaataacaggatctcattctttttcatggctgtatattactcgattgtgtacattaaccacattttctttattcatctgttcatggacaaacaggttgcttccaatcatgactattgtgaatagtgctgcaatatgcatgggagtgcaggtatctctcagatatcctgatttcctttcttttgtgtatatacctaccaatggcattgctgggtcatatggtagctctatttttgttttttttgagaaacctccaaactgttctccatagtgattgtactaatttacattcccaccaatagtgggttcccttttctccatatcctagccactatttcttactgcctgtcttttggatataagccattttaactagggttagatgattcgtcttgcagttttggtttgcatttccctgatgagcaatgatgctgagcactttttcacatgcctgtttgccatttatgtgtcttcttctgagcaagatcttttgcccatttttaaattggatgatcagaattttcctatagagttgtttgagttccttatatattctggttattaatcccttgccagatggatagtttacaaatattttctcctattttatgattcttttcaacatcaattgaaatgatcctatggtttttgtttttaactttatgtgatgaatcacatttattgatttgcatatgttgaatcatcctagcatttctagaataaaactcaatcgatcatggtgaattaaatttttaatgtgctgttggatttagtttgttagtattttgttgaggatttttgcagcagtgttcatcagggatattggtctgtagttttcttttgttgatatgtctctttctggttttatatcagagtaatactggcctaatagaatgaatttggatgtattctgtgttcctatattttttggaatagtttgaatagtgttggtattaattcctctataatatttggtaaaattcagcagagaagccaccatgtcctgggattttcttcgctgggagactttttattagggctttgatctcattacttgttattggtttgttcaggttttggatttcttcatggctcaaacctcataggttgtatgtatctaagaacttatctattttatctggattttccggtttattggcatatggttgcaagtgatccttttaatttctgcagtattggttttatgtcttaattttatttatttgggtcttttcactttttctcttaggtaaagttttgttgattttgttcatcttttcaaaaaacaaacttttcactttgttgatcttctgtattgtatgctttgtttccatttcatttattactactctgatctttattatttattttcttctaataatttgggtttgtttgcttttgcttttttagtttttaaagatacatcactaggttatttgaaatttttctacttttttggtgtaggcacttgtagctataaactttcacttgccaggttttggtatcaaagagatgctggcttcatagaatgagttaggggggagtccattctcctcatttttgggaatagtttaagtagagttgatactagctcttctttgtatgcatggtagaatttggctgtgaaaccatctggtctaggacttttttggttggtagatttttattgctgcttctattttggaccttaatattggtcttttagggttttaatttctcccagattcaatcttgggaggttgtttccagaaattgatcaatttcctctagatttagtagtttgtgttcatagaggtgttcctaatagtcttggaggatattctgtatttatcggatcatctgtaatgtcacctttgtcatttcttaatgtgattatttgaatcttctctctctcttcctcttgctctcgctctctctctgttactgtagctggcagcccatcaatcttgtttatccttttaaggaatcaacttttggtttcattgattcttggtattaattttctggtgtatttcaatcaggtctgctctggttttagttatttttttttctgctagctttgttttagcttttctagctattctgttggatgctaggtcattaatttgaggtatatctaactttctgcggtaattgtttggtgctataaacttttctcttaacactgcttttgctgcatcccagagatcttggcatatagtgtctctgttttcagttatttcaaagacttttttgatttctgccttaatttcattgttcacccagaagtcattcaggagcaagtcacttaatttccatgtagttgtgtagtgttgggtgatgtttttagtctttatttttatatgatatactattctaagctgacaacaatcacaactgtatgctttatttgccaacaacagccgtacactttatttctcctctcccacattttacgattttgatgtcaaaatatacatcattttcttatgtgtatccattgactatttttgctctatgtgttttaatagatttgtcttttaaccattgtactataggaaaaaattgctttacacatcatcattacagtcttagaatattctggatatgactttgtatttcttatcccattgcatttgtgttctcatatgttttatatttttaattagcagccttttaattcagctcaaagaacttcctttagtaattctcttaagacatatttagtggtgatgaactctcatagcttttgtttgtctggaaaagtttttgcttttctctcatttgccaaggacaactttgctgggttaagtagacttgttggccttgttttttcccttcagcactttgaatacattatcctactctctcctggtctcctgagattttgttgagaaatccagtgacagctattttgatattcccttctatgtgatatgcttctaattacttgctgttttcaaaatgttttccttttctttaatttttggtatttgaattattgtacatcttggataactcctatttggcttaaacttgtttggataactctgcatttgctgtgtttagatgttagcaactttctccagatttggtagttttttagaatttcttcttcagatatgctttctggtctcttttctatttcttttctttctgaaaactcctattagatgaatattaggtcttaatagtttcccttcatatccagagtctgtctttattctttttcaatctttttaattttttctcttctgactgaattattttaaatgttttgtctctagcttattgattgtttcccttctgcttgattgagcctgttcttagagctttctattgcattttcatttcagtcattttattctttaagatttctatatttttattattcctatttgtcaaacatgttatattgtttattatttttcaattttttaaattatctacccttatattattgtagttcactaaattttttttattatactttaagttttagagtacatgtgcacaatgtgcaggttagttacatatgtgtacatgtgccatgctggtgcgctgcacccactaactcgtcatctagcattaggtatatctcccagtgctgtccctcccccctccccccaccccacgacagtacctagagtgtgatgttcccttcctgtgtccatatgttctcattgttcagttcccacctatgagtgagaatatgtgctgtttggtgttttgttcttgtgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacgtacttgtgcatgtgtctttatagtaacatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcgtttctccacatcctctccagcacctgttgtttcctgactttttaatgatcgccattctaactggtgtgagatgatatctcattgtggttttgatttgcatttctctgatggccagtgatggtgagcattttttcatgtgttttttggctgcataaatgtcttcttttgagaagtgtctgttcatgtcctttgcccaatttcgatggggttgtttgtttttttcttgtaaatttgtttgagttcattgtagattctggatattagccctttgtcagatgagtaggttgcgaaaattttctcccattttgtgggtagcctgttgactctgatggtagtttcttttgctgagcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatgtaagtctttaatccatcttgaattgatttttgtataaggtgtaaggaagggatccagtttcagctttttacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggatcgacttggcgatgcgggctcttcttggttacatatgaactttaaagtagttttttccaattctgtgaagaaagtcattggtagcttgatggggatagcattgaatctataaattaccttgggcagtatggccattttcacaatattgattcttcctacccatgagcatggaatgttattccatttgtttgtatcctctttatttcattgagcagtgatttgtagttctccttgaagaggtccttcatgtcccttgtaggtggattcctaggtattttattctctttgaagcaattgtgaatgggagttcactcatgatttggctctctgtctgttattggtgtataagaatgcttgtgatttttgtacattcattttgtttcctgagactttgctgaagttgcttgtcagcttaaggagattttgggctgagacaatggggttttctagatatacaatcatgtcgtctgcaagcagggacaatttgacttcctcttttcctaattgaataccctttatttccttctcctgcctaattgccctggccagaacttccaacactatgttgaataggagtggtgagacagggcatccctgtcttgtgccagttgtcaaagggaatgcttccagtttttgcccattcagtatgatattggctgtgggcttgtcatagatagctcttactattttgagatacgtcccatcaatacctaatttattgagagtttttagcatgaaggttgttgaattttgtcaaaggccttttctgcatctgttgagataatcatgtggtttttgtctttggttctgtttatatgctggattacatttattgatttgcgtatactgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctattgattggaatagtttcagtaggaatggtaccagttcctccttgtacctctggtagaattcggctgtgaatccatctggtcctggactctttttggttggtaagctattgcttattgccacaatttcagctcctgttattggtctattcaaagattcaacttcttcctgttttagtcttgggagagtgtatgtgtcgaggaatttatccatttcttctagattttctagtttatttgcatagaggtgtttgtagtaatctctgatggtagtttgtatttctgtgggatcggtggtgatatcccctttatcattttttattgcgtctatttgattcttctctctttttttctttattggtcttgctagcagtctatcaattttgttgatcctttcaaaaaaccagctcctggactttttagaattctttgtcagtcattttgcaaatctccgttcctttagggtccattgttaagagttttattagtttattttggaggtgtcatcattcctcgattcttcacaatccttttgttcttgcactgctgtctgttcatttgaggaggtagctacctctttttataggtattagttggcagggatagactttcattatttagtctagcctttcattctagattggccaactggtaccaaccctgggaaggtagagcttgctttctgctttcaggttctccggatggctcagcttttgtctttgctctgagttcagttgggactactggctgggctctgatttttggtatgaccactaaatgagctatgcaatcagacaaaattgcttgctcggatggtgattgtctctgactgggccgggccacaggatgtatttcctggctggatggtaccactatttgagttctggagttgtatggggttgcaggcttactcataaagttaagtggggacactgctcaggatggagagaacagctactacacttggtgggaatgcacatttgatgtttgccttcctgactgggtaggaccttggggtgggctttgagatttgagccaaaccactgtttggattccttgttggggtgcatatagccctttcactttgccaaaatgcactgcggcaagtatctccatctctgagtgggctttggggatgattttgaggctgagttgaaccactgttagagtccccaggtaaggcatttctagaccctacactgtgctaataatgggctgtggtatgcatctccctgcctggctgggtccctgttgtgggttttgagactaagccaaaccactgtttgggcttctgagtggggcaggtctagcccttgtactttaccaaaatatgctgtggtcatctccccctctggacaaggctttgtggtaggatctggggctggcatggaggctgattgtctagggattcaagccaggtagaacttcctatttcccggggcaaccagcttgactttgttggtttgttatactgttcgctaatgcccctaatcacataccactgctggtggttacatagacctaccaccaagatctgcatgtttgtcactatgagctttgccttcctgctttgtttctacctgaccacaggtagtctagccatgctattacccctatgctccttgcaaggtgagaccagagttggcttcctgggggaggtatcttggaacacagggaacgtgaatgtccacctctagttctcttttcctactgtagaaactgtgggcctagaaaaattctaagtggtgttgtgctgacttgggagaaagggagaggtgatgtggtcagagtgaggctattctttttacacttctcatgtggcattttgtttggttatttagttcacacaggtttctcaggcttaatcttgagttttgaagtgttcacataggagtttttgtctgtgtacagttgttaattgaacattctatgaagggtagggaaaactgggacctcctattcttcaatcttcctgatgtcacagagaatctgcattttgaaaagatccatacgtgatggtgattgatatggatattaaagttgagaactactaggttaaacatctgttttcatgtgaaacatgaaaaataagctagattttgagttgcaattatagggtaatacacatttttcaactttttcatctttaatcttgttcataagaggctgcaactgatccaaaaacaacttattcccaggctatagcaaaggttttcaaactcaaacaatgtagaattacaaaatgtagagttcacatcttctctggctaagataatgttgactaatgaaaataatggtagattggaaaatctatttgagttactatactttcttgtacctaagataaaatacccatatgatgattattgttaatcctctacagaaacatgatgaaaagaagttttagttgagcagaggagatagaaagcaagatcacagggggttggggagtgaatatgaaatgaagaagtagaggttgactatactctttcatgtcacttggcaccctccaaagtaaaaggaatttgatgtaatcaatttgccacccattgctggctggttttctcaaagattggtgccatattgagggcttaacattggtttctcatcgaggctgcatcttcagtggctcagtgatttgtcaccaaccttggtaagataatgcctgtattttttggcacgtgcatattttccatttatacagctttctttatattcccttttataagctctgaggtgaatgaaatcagagctgactgacatttttagatgactcattcttttcacttagctattgagtgcctccactctggaggatactctctaatgggcacagagttgagaaacaaagatctgcatactttgtgcttattctcataggcccatacataggcctccacctcaaatttcattaaatctgatttttctgtattttgagggggtttgcttagtgaaacttttttacaacaatcattatactacacatatccttatcttgcatagcaagctatttctcccaacattcaaagtggacaactaagtatattgctaccgaatcattggcttacgaggatttcctccaccactacattctatggctactctggagaggcgttaagctgcagcattagtcagtttttatcttgtctaagtgtagattcagacaatccatttgtgatccaagcctgaggctctttcttcatttattagctggttgtgtgaaataccatgaagccataggtatgaactgaggaagagatattgtcacaatgaaggcatgtttgtatcttatggaaatgctttttactgtatctaatagttttcaattcattctatcaagtgccagcaagctcaatatgagatagaatttaatattggtaagataagattggttaatgatcaatttgaagataattacaaatatgggcactgtgcacatttataacagttgagattatattttattaagaatttctatcattttttctcatataattaagaaatataaacaaaactggcatggacaggtgaaactcagtgttaaatttatcagcactttaaagagatcccaccgttgaagtcagtttgaatgaagttctaaattgtttgtattttcttcctatataaaagaggttttcaggcaagtatttagctatttaatttacatttcacatgtgaggtataataaaacaaccactcttttccccagaactcatataaatcctgcctttcaaacccagaaaatattctcaactcagcttccttgtgacacaaaaactaattgcagttgcacctcattttgtggagcaaatagctatgatggcttacaaattaaaattctgtaaactacatttcatattgtgattccttttcattaagtttttgagagttgtatttgaaaaaatggcatagaacgaaacaaaagtcaaaattaaagcaagatattagtcaaatattttataaaatggattttaagagttttattttagtactgtccagcagtactcaaataagtcacacagtattaatactaaattagttatggtatcaaatcctgtgtttaaactgggtttacaacaaagaaagctatatcctgagtaatgctcacctttttgtttaggtctttgctgcactatattccaggtaacgaatctgctttaaattcctaattcttggttgtgtactctctgaaaaaacactgaatatcaaactaaggctattagtctatttatataatgtaaagaccacttgctacattttgacaagctggactacttaaaacttggctctttttcagccagtatctcttagtggataatgattggattatagtgttaattgtgagagcagtctatgatatctgtcacatgtgttaccaattgctttagctcagtaatacaaaaaggacgtctgcattctttttaaaaagttgggttacatatacacgttctgattagcatagacatagaattttacatacgtattattcacttcaacagaaaatctaattcactgttgaaacattcttaaataagaccacagtaatgcagattgtggtgagtggtgtttaagatgttaatggctcattattatagcagttcttaaataaaacaataaatttgtagacaaatattcatgtataataaagttacatttgataaatgaaaattctcttatttatattttattaacatcttttccagtcctgaagattttcctcagataatctttcatctctttgttcctgagactatatattagaggattacagagtggtgttatcacagaaaagaacaaggtaatgattttttcatttttactgggtgtgctgatccaggactaacatacatcaccatgatagagccataaaataaggtgacaactgccaaatgagaggcacaagtggagaaagcttttcgtttgccagcctctgaaggcatccgtattatagccagaatcaccagagcataggaacaaaggataaagagaaaggtgccaattatgaagacagaattgaatgtggagtaaatgagctgggtgatgatgatgtcttcagaacaggacagcatcttcaatgggacgggatcacaaataaaatggttgataatatttgggccacagtaggatagctgtgaaatgagaatcaccagagttaggaagattacaaagacacatgaccatgcaaaaatgatgaggccagtgcatacttgtttagtcatgatgcatggataacgtagagggcggcagatggcaagatacctgtcaaaggccgtgatgcaaaggaagaagccctcatcataccccaaagagaagaagtagaactgtgcaaaacaactcatgaatgagatggacttgcttgtggagaggaagttggccagcagtttagttgcagtaacataacatatttccaggagagagaaatttcccaagagggtgtacatgggagtgtgaaggtgctggtcctaccacacagcacagacaatggctgcatttcccatcggggtgagagtataggctactgagaagagaccgaagtagaggagctgcatttctgggcttgagggaaagcccatgaggataaggcagctaacaaaattgatagtttccatgctgaacacattcattagtctggaagacatggagatggcagaggtaactgaaacatgaaagggagtgtgctgtttcttcttggaaacaaccaaaattcttcatcatgtatattataaagtagtaaacaattagacttttgtttaaacaacaaaactgtgactttcatgactcaattcctacacatgtttattttaataaatcacaacaatagaagggaaaatatgaattgtggagagttttttttcttgctaagaacactagacttgaaaccaggaatgcaaattttgtgattccaataaattacctatatacaatgggtctactctttcttctgtttacctgcattattgatactgtatttatctgggtatgtagttctttcaacagtactatgaatacctgattcattattattagtggtataaaaataaaatacaaaaccaagatatttaaaaatactctttctcaatatagtgccatgccagggcacaaattaatatttactttcaatttcagctactcccggttacttgtagtgttttaaagtggtaataagaaagaactctgtcattagagaatatatggtcttttatgctgtttcatgtatctgtaccaatgtttagcataaaaaatacattctttcatttttaggcagctggatacgctatatgctgtgaggaagcgtgccatactttggctcttaaattgctctgactaaatatttttatatgcttccaggtgaatgtaagaacttcatatgcctattatgacattgaccttagggagaacagctggtctgcgtgactgtggccaagttcaatgtgcttgttttttgttaaccatggtcaagtcagctgcaggaaaataagaaaggcagataaagtttatattacaaaagtttccatgttttttattcactgctttcttccacatgttccttttcttcctttgacctttggtgttattttgcatctcactgtggttgttttctgaggcctttcctatctaggcaaatccgaaacataaaacttttcgcctgattaccctccggttaacttctagcccaaataacaacaaaaacaagaaaaagtcatatgagctgaagatttttgtttcttaaataataactaatttgtataataccaagtcttattaatgtaatggaactgaaaaatcagtatttgggcttaagaaagaaaatattgctggaaagagaaatatgccatatttcttctgctcaccaagtaacaaaaattgccaaaatatacccttctccagcaattcatcagttaatatacatcttcacttgaaatactattctttttgtataaatggctattcatattttaaagggatatgaaccataattggaaaatattttccagatttcagggaaacaagaagaaaaacttatatttttcagcttcattctttgccagcttttcattctgagatatatttttagttttctcaaagacaagaagaaaacattttctatgatttttgcaaaaaaaactgggtgactcacatgttatatacttcccattcgctctttgagtgaatgctgagaaggtcagggacaggagacaaaatattattccccagagccaaagacatgtgaagaacttccaagaaattgcatgatcctgtttgttatctctcatgggttgcaaaaagtaaaccctaaaagattttccccaccttcaaagcatatattaatggtcaaaatgcaagctcaagtgagtgtattatatatatctatttacttgcactatagccttttgggacttggagctctgtctctcttgggatattttgatagtgtttgtttaaaagaggataacattttgaattttcacaatcaaaagccagttcttactgtcccctaaagaatagtgaaaatgtagaagcagatcttatcttttctttcttctttcgtgttcatgtattgtcaaaacttcctgaggaataattaagtagtaaaagggattgtcattttagctacagtggttagctttaccataatactctctagatctattttgaagaaaaatcattctctggtcatcaaatatttgtacctgcagagttattagagatatttgagttgaattttatgtagagcacaagaaatttgattgacatttagttattccacagatatttactgaatgcctactggatactcaaacatatactatatatatttttaattttttgaggaacctccatattgtttttcataatgactatacaaatttacattaccaccaacagtgtataaacgttcccttttctctgcattcttactgactattaccatcttttgtctgatcatgaacattctgactgggctgaggtgctatctcattgtggttttgatctgcatttacctgatgatcagtgatgctgaggattttttcatatgctttttggtcatttgcacgtcatattttaaaaaatatctagtcaggttttttgcccacttttaaattgaattatttggtggtagtgttgttttttgctattgagttgcttgagttccttatatattttgaatattaaccccttatcatgtataatttgcaaaaattttctcttattctgtaggtcattttttggttctgttatttcttttgagcagaagctttttattttgatgtaacctcatttgtctatttttgtttttcttgccttagcttttgcctacatcaatgttgtgtagttttacagctttaggtctcatgttttagtgtttaaactattttttgttgattttttgtatatggtatgaagtaagggtataagttcgttcttctgcatatagatacccagttttccgaataccatttattgaaaagactgtcctttccccattgtgtgtgcttggcagcttcgtcaaaatattaggtgactgtgtatcacctgtggatttatttctgggctctgtattctattccattggtttatgcatctgattttatgccagtatcatgctgttttggttactatagctttacagtatactttgaggtcaggtagtatgatgcctccaactttgttcttttgggtcaagactgctttggctattccaggtcttttgtagattccatacgtattttaggattgttttttctatttctctgaaggatgtcattgttattttgataaatccatagcttgttttgggtagtgtgaacattttaacaatattaattatttgaatccacgaatgcaggattatctttccatttatttctgtcttcaaatttttttcataagtgttttatggcttcattataggtatctttcacatccttggttaaattaattcctaagaattatatttttttattttggagctattgtaaataagattgttatcttgaattcttttcagacagttgattattaccacataaaagtgctgctgatttttgtatgctgattttgtattctgcaacgttactgaattcacttatcacttctaagagttgtcttgataacgtttttatgtttttctctatataagatcatgtcatctgccatgagaaacaatttgacttcttcttttccaatttcaatgcgttttatttctttctcttgctgatactctggccaaaacttccaatactatatgaaataggtgttgtgaaagtgagaatccttgtcgtttttcagttcttagaagaaggattttctgtttgtcctacgtcagtatgattttcactgtgagtttctgatatatggcctttattatgttgaggtatgctccttctatgcctaaatttgtttaatttttatcatgaagcaatgataaattttatcagatgctgtttttgtatctattgaaatgatcatacactttttgtcttttattctatcagtgtaatgtatcaaactttttgattcatttatactgaataacccttgaattcctggaataaaacccacttgggcgtggtgaactgtctttttaatgtgttattggattcggtttgctagtattttgttgagaatttttgcatctaagatcatgttattgccttgtaatttattttctttcttttcttttttctttctttctttttcttttctttctttctttcttttctttttctttttttctttccttccttccttcctttctttttacttacttactttctttctctctctcttttccttcccttcccttcccttcttttctttctttctttctctttctttctttctttctttcttcctttctttctttctttctttctctctctcttttccttcccttcccttcccttcccttcttttctttctttctctttctttctttctttctctgtctttctttctttctttctttctttctttctttctttctttctctctttctctctctctctctttctttcttctttctttctgacagagtttcgctcttgttgctcaagctggagtgcaatggtgccatctcagctcattgcaacctccgcctcctgggttcaagtgattcttctgcctcagc[132 bp omitted]tgccttggcctcccaaagtgctgggattacaggtgtgagccaccgtgcctggctttttctttttttttaatttactttaaactttggtatgtatgtggtaggtgcatatatttattgagtacatgagatacttagatacaggcatgtaatgcataataatcacataatggtaaatggggtatccattcccctcaagcatttttatccttttgggttacaaacaattcaattacactcttttagttactttaaaatgtacaattaaattataatacacaatagtcatcctcttgtactattaaatactagattttattcattctttctaactactttttgtgcccattaaccatccctacctgccctcccatccccctaaccactatctttctcagtttctgataactttccttctactctatatctccatgagttcaattgttttaatttttagctcccacagtaggatttatcccagggatgcaagaatggttcaatatgtgcaaatcaatcaatatgataaacaataaacagtatgaaggagaataaccatatgatcatttcaactgatgctgaaaaatttgataaagttcaacatccattcatcataaaaattctaaaaaactgggtatagaaggaacaaactgcaacataataaaagccatatatgacagacccacagatagaattttgctgaatggaaagaaactgaaagcctttaatatctggagcacaacaagaatgccaacttttaccacttcattgactatagtactagaagtcctagctaaagcagtcagacaagagaaagaaataaaaggcatccaaattggaaaggaagaagtcaaattatccttgtttgcagatgatgtgatcttgtattaggaaagacctaaaaactccaccaaaacactattagaactgataaacaaatttagtaaagttgcaggatacaaaatcaacatataaaagtcagtagcatctccatatgtcaacagtgaactgtctgaaaaacaaatcaagaaagtaatcccatttacaatagctacaaataaaattaaatacctaggaattaaccaaaaaagtgaaaatcactacaatgaaaactataaaacattgacgaaagaaactaaagaagacacaaagaaacggaaagatattccatgttcattagctgaaacagtcattgttaaaatgttatactaccaaaagcaatctacagattcaatctctatcaaaataccaatgccattcttcacagaaatagaaaaaacaatcctaaaattgatataaccaaatgacccagaatacccagagctatcctgaacaaataaaccaaaactggataaatcacattacctgactttaaactacactataaagctatggtaaccaaaacaacatggtactggcataaaaaacagacccataggtcaatggaacagaatagagaacccagaagcaaatccgtacatcaacagtgagctcattttctacaaaagtgccaagaacatacattggggaaagaacagtctcttcaataaatggtgctgggaaaactggatatccatatgcagaagaatgaaacaagacccctatctcttggcatatacaaaaatcaaattaaaatgtattaaaggcttaaatctaagacctcaaaaaattaaactactaaaaggaaacattgggggaaactctcttagatattggtctgggtaaagatttcttgagcaacactccacaaacacaggtcaccaaagcaaaaacggacaagtgggatcacatccagttaaaaagctgctgcacatccaaggaaaaacaatcaatgtgaagatcaaacccacagaatgggagaaaatatttgcaaactgcccatctgacaagggattaataaccaggaaacaactctataggaaaaaaccctaataatctaatttaaaaatgggcaaaggatctgaatagagatttctcaaaagacaatacaaatagcaaacagatacataaaaaggtgctcaaacaccattgatcatcagagaaatgttcctcaaagctacaatgaggtatcatctcaccccatttaaaatggcttttatctaaacacaggcaatagcaaatgctggtgaggaagaggagaaaagggaactctcatactctgtcagtgggaatgtgaattagtacaaccactatggaaaacagtttggagattcccccaaaaactaaatgtagagctactttacgatcttgcaacctcattgctagatgtagacccgaaagaaaaaatagcagtataacaaagagttatctgcattctcatgtttgttttagctttgttcacaatagccaagatttggaaacaacctaagtttccatcaatagatgaatgaataatgaaaatgtggcacatacatatacaatagagtactattcagccataaaaaaaatcagatcatttgcaacaacatggacggaaatggggattattgtgttaagtgaaataagctaggcacagatagacaaacttcccatattctcacttacttgtgggaactgaaaattaaaacgatcgaatcatgcagataaagagtagaatgatggttaccaaaaactgagaaggatggtggaggtgtgggatgtggaaaaatggggatagttatgggtacaaaaagatataaagaataaataatatttagtatttgatagcacaacagggtgaatatagtcaataatgattcaattgtcatttaaaaataaccaaaagaatataattggattgtttgtaacacaaaggataaatgcttgaggggacgaataccccatttaccatgatgcgattattatgtattgtatgcctgtacccaaatatctcatactctataaatgtatacacctactctgtacccacagaaataaaaaataacaaaacaaaaaacattgtttagcaagcccagctaagggtcatctgactctctagcaaatgtgattttgtttaacttactatatatgaattatggaatctcagacattgtataattacatatagctagatgttatagaaaactgctgcattgtatctttttagtgtggtagaaaagataatcccaaagattaaggtcgtattgcccctttttagagctgtatgaaaaaatatgaatatttttgttatgttgatatttttaacttttaagttcagaggtacacgtgcaggtttgttatataggtaaatctgtgtcatgagacattaactggattacatcaaatttaacaattttattttagtgttcatttttttgctgtgattatgtaaaatcacacttttcatattctttttggaacggactttgttatcctgctatccctcgttaattaaatacagtttttgatgtgttcattatgtatttgtttgagaattatgttttatgatatttaaaaattagactgacagtctataaaaaattaaattactaatgacaacagctgtgttttctggatacgatctatgaataaatgccagtaggtaagctgcttgaggtttcaagaaatcaggtgttgtatcaagacactctatattaccttaaaggataaataccaagctatccctggaattatctcagagataaataccttaggttggtatttatccttcagcttctgctacttcaaggagcatgattgagataaaaaccagtgagaatcttcttcagatacagactgaggcattgaaaatggatggcatatacaaacaaatcaatgacaaattacaaataaatcaatccaaagtaagtaaaataagtgggttctgttatgcaacaggtctaattgcttcagagcctgcaggtcccaaggtcaacttcctagcaagaactaaatttaacagaactcaaacagcagcagcctagggaatcccagggctcattaagctaagtagtgttgtaagaaccatagcaacctcagatacagctagagtcctagggataggagatatttccagttcatacagccagccgtcaactagggcttggcttataaggaagcaattaagacatgtgctgggcagctgtgatggtcacctgaggattgtccattttgctggcctgaggctgaagagagggttggtaggatgaatggcaggataacatcttccttccttgaaaccacatagcttctgacaagcaaagatgtaggtttctcagatatatttactcaaagctcccctccccttcctgctcctctgtctgactctgatgctatttttatgtttactgttgtcctcactctttttctctatatactctggcattgatcatttttaaatttaagagatcatttgagttttgttgttttaaatttacacttagaaacattcacagaacagtgaaattcctatagcatcaaggaattctagggctagtggcatcttagaagacagttgcaatatttggatacgataggaccaaatttacataactgaaggcacaggtttcatggcaatattgtcttaagactacctaattctgttatagtcccttctagattctgttttccatttctttaattattaaagtttctttttactaaaatcttctttacgttccacaggtacaatatagaatgcaatgtttcaaacaaggccaaagaagtttagaacagaaagattgtttctttctcaatagagaataccactataggtaccatcttcaactaatggtgtccacttcttggttttcaggagaaatttaaaaatgcatcaaatgcgtctaaaaggaattcatatggaattgaaactccagctagccaattattttctattgttgagatagtcaaatttcctcctctaataatgcatttagctccacacagaccaaaataaatacaagacaaacataatagcaaaatatggtatactgttatgcttaaaacacacacatgcacaagttaccaggagaaaaattttactccttttcttcatattttcctcataaacatctctggttccttgtttagaaagacaagagaccagctgctcagctgtacacaagtagcctttgattatttaaggtgctttagtttgtcctcttctctctaagcaggacccttccataaagactttcattttgcattaagcattctcaatttttttggctcattttgtgtacttaaaaatatttttattgactttttcacattcttaggttatttttaggatatgaaacatgaaatgcttggtagggtctgatcttactgctaatgggataatggagctggtatttttgaatgtggctttccaagctctgcagggctttggcaagggaaattatattgtgactggggttagttttgggatgtagacattcgttcatgttgttgggtgtattgttctttttattctttgcagaacagtgacaggcttaatttcctactgtgatcagacttcagaagctgggagatgactcaaccaaatgtggaaatgttattaaacctaaaagggagctttctatattgtttagtattatgttttatattgtctgaagattgcaaatttactgtcattaaaaaaaaaatccaagaataaccagaatccagcccttaccttgattaaaactcaaataactaacatacagggctgcctatttttaacttatgcaagtgtaaagatttttatatcattattaatcaaaatcttatcacagtaatcacctaggaactgtccagaatatttatagtgctgaaatttcctaatattaaatcttactttaaacaagtaggccataaaatcaggcttataaatggtttgtagtaatttgggttataacatattttacatattcttctcttatttaatctatccttctgatttatttaattttaatattgtctgttttaatgtaatcttttctttcccaacatatgttcagtggaaataacaagtgtaccgtacacccttggtatactatgcccttcacattaggaaataatcacattgtttctcagccatattctgagactaaattataacagtgtgtaggattatgtgttcccattgttttctggcttctagaaaccttttttaattaaaaaaataactttggtttctctttctcagacttttccagttttcccaagattattttaaaaattagatgcataattttaatgagacttgacccctgttaattatacattttagataactgaaaagaacatcaaaatgatgttttcttatggaactttacaatccttggtgcatccaaaaaagattagagaatttccaatatagcagagctcaagtagggctgtacacataacagcaaatcgttccctaacttgtatttcttgctttggtttattttccaattgactctagaaagtgaggtgattccttctatcagttatgagattatagatttagatgcacctgtgcacttggctatataggcagatgaagaggatggtcacaatcatggtgtgacagaggcgtccaaatgtgacttgagccccaaatctctctctcactggcttatcttggaataataccctagagaaagttttcttgtcattagaggttttcatttttagaatttaagtacttttctgcattgtctatgtaaatacctgatatctattatgaaggattttattggataacattctctgaatgacttgatagaaccaagtgcaacatggattacaaagcttggaacacaaaataaaatcttgtcttatttcatattttgtctatagctgattctagataaaaaaaaattctagacagggagacatctactaatttttaactactgcaatggaagaaatgtatcaacattctctgattttctgtttgtaatccaaggtattgtcaccaaacattggggatgaatatgagtgtagagcagggaaaatggatctaacaatatcttagcaaatcttttattttcttatgtatctatggttgttgaaaagtccagaagcaacacaactgtggtttctcttattactttgtcctgtaaaagggtcatggtgggcttttgtgcatgcctccacgatatgggtcatggctcttggtctcttgtcttggtgattggtgtcttttaatcattgtcctactcatccccagtctgatgcttccctaaatcttaaagattgagactgtttcttcttacctcatttttacaaacttcccaatctctgtaacctgggatagtaaagacaaaaaatatgagctttttcaatccttcctaaatgatttgtttcctaatatatttattcacagtaactactaaactttgtacaacatagcaatttgttgtttacaaaacattcttccttcgatttgataaattattgagcttctgctatgcagtaaatattgtgttgtggatacaaagatgagtaagatatttcctcatcttgagagatctagttttttttttatggtgcacataggcattacatttgattctcagaacaatcttgggagatattattaactctgcattaaattgaataatcaaagaacaaaattcagagaggtttatttccttgcctgagagtactccattggtaatggtggagctaggcattcgatctagatactccattccagaacttttgtccttagaggacattattctgtctattaaaagaaatggaaagattagcacttaccacctcatgtccaggtcattgtgtttctttctagtttattgtgaatgcaatttaaaagtagtacaggaataaagagttggaagaagtgaacaaaattcaatgttctatcaatataagactactgcctatactacctcatagaatttgctaaaataatttttatgtaatttatgtattacatactatatatatagtgtatatctatatctatctatatagatagatagatacatagatagattgataccttaaatctcccttgttctgatttaattcttctttctctaggtcacttgatattcttggcttgatgaaaaaaaacaagattctaacgtgacagaacttgttcttctgggcctatcatcttcttgggagctgcagctatttctcttattactatttttgtttttttacattgctattgtcctgggaaacctcttgatagtggtaacagtgcaagcccatgctcatctgctccaatctcctatgtattattttttaggtcatctctctttcattgacctatgcctaagctgtgttactctgccaaagatgttaggggatttcctacagcagggcaagagcatctctttttcaggatgcctggcccagatctacttcctccactttctaggagccagtgagatgtttttgctgacagttatggcctatgacaggtatgttgccatctgtaaccctttgcgctaccttataagtcatgaacccccagctatgcctttggttggttcttgcctgctggtgtgggggttttatccactctatcatgcaggtcatactagtcatccagctgcctttctgtggccccaatgaactggacaacttctactgtgatgtcccacaggtcatcaagctggcctgcatggacacctatgtggtagaggtgctgatgatagccaacagtggtctgctctctcttgtctgcttcttggtcttactattctcttatgctgtcatcctgatcaccctgagaacacacttcggccagggccagaacaagttcctctctacctgtgcttctcacctgacagtggtcagcctgatcttcatgccatgtatattcatctatttgaggcctttctgcagcttctctgtggataagatattctccatgttttacacagtgatgacacctatgttgagccccctcatctacacactcagaaatgctgatatgaagacagctatgaagaagctgaggataaaaccatgtgacattccatttccttgttaaagaatgagcagaaaaggtgatttgaaaaacatactctttcttggaagactcttaactcatcttgtacatgtctaaaaaccattttgatgactttggtataaaaaagaagatagcctaaagattataatagatcactcttgattacaatttaaaagcacaggtggcactctggaaagccacctatgccttttgaccataatcaagagaactcgggaactcagtagaatttactggccacaaatgataacaagcattaattgaaagatcaacttttctatcttcatgttctaagtactcttcatttattcaatttgttccactttttaatctattcaaatgaaacaagatatatctctttttgtgttcctttcctccagcatttaatgattcctagtgttaggaagttccttctgatgtctcatcagatcctcttctgaagtagtgtgaatttctttgttctgttataacaaagcctgagaacagtaacaaccacctatgtagtagtatttacctcagaactgtgttccacagtgtcccaagttttagaaatgtagtcaggcatcactctaatgaacatatgctcttaacaaagtttatgtgtgagagaaaggaagtccaggagtgcaggggtgatggaagctgttagtattctgttgtagaggcttctcaagaagaggtacccagtttcacattgagtttttctttgagtggaattacagtgagggtgaataggtaagctggctcttcaactgaccataatgtttaagagttttagcctcgaaaggaggaagaaatgaactgtggttgaaagcactcattcttgagatgctcacagttattacctctgagtctcaaacatgtttgaggaataaatttacctaacttcatttttgaaaatgaactctgagttaagtgacttgcccatgaccacttagaaaaaatgtaatcaatcaagaaagctgcttgtaatcccagcactttgggaggccaaggtgttcagatcatctgaagtcaggagtttgagaccagcttgaccaacatggagaaaccccatctctactaaaaatacaaaattagccgtgcatggtggcgcatgcctgtaatcctgtaatcccagctactcaggaaggctgagtcaggagaatcacttgaacccgggaggcagaggttgcagtgagctgagatcgcaccactgcactgcagcttgggcaacaagagcaaaactcggtctccaagaaaaaaaaaaaaagaaagctaataattatataattaagttaatattttatttctcctcagaaagtgtatttatcccaattatacagattgcttctttctttctctttctttctgtgtctctttctctctttcttccttcctttcttctttctctttctttcttttttttttttttgagacagagtcttactcttgtctcccaggctggagtgcagtggcacgattttggctcactgcaacctctgcctcccaggttcaagtggtcctcctgcctcagcctcctaagtagctgggattacaggcaccggccaccatgcctggctagtttttgtatttttagtagggtctctccatgttggccaggctggtcttgaactcctgacctcaggtgatgtgcctgcctcagcctcccaaagtgctgggattacaggcatgagccacgacacctggctagattacttaatttctataatacctgtataggagcttcagagctggaagatccctaaaaaggttaacttaaacatttatatttaagattatctatctctgacataggatccttgcaatattttatggctatgaaaagtctttattctatttactatataataagataatgacaaatttttataatgttttttatattttgtcactttgtctcctaatgaattgccatagagaggtatttatgattacttagctgaaaaatatacttgtgaaaaaaagtctgaaactccatctaatactaggatatactggaaaatgccaataaccctggtcatgtaagagctttcttgatatagggacaaaaaatgtatttttatttttgtgttgggagttaatgacttcatatttaagaagccatatgtacgtatgtgtatatgtatatattgctacagaaggactcctcacagactaggaactaggctgccatttgggagatttctaaatagtatgggtgagggtgagaatggcatacctggaacatcatgttcttcttttttgctttactctgctctacacttttagagttttttgcatacgttgaatatcctgaagagcagtatgatatcctgaaggtaatattttgaatatcctgaagtacaggaaactgcccgagagtagtgtgtgagttaccagaaagatttgagtggtgctagggattaccaggcatgtttcaagaacatagagctccaggctttctcttagtataagccggctgcaacatcccctttttctgatgctctctttcatagcaaaatgtatagtcttggcaaatcattttaaatgtcctgttgatagctggaattggtagcgttattttaagaaaagcaagagcgttttgtattcccttttgcattttcaagtctctctttgtttccaggaacaaagcctacttgatcgtggtgaattaacttactgatgtgccgctgaatttggtttgctagtattgtgttgaggatttttgcatctatgttcatcaggatattggcctgatgttttctttctttgttttgtttctgccagattttggtattaggctgatgctagcttcatagaatgagttaggggggagcccttcctttttgatttttttgggaatactttcagtaggattggtaccatttcttctttatatgtctggtagaattcaactgtgaattcctctggtcctgggctttttttggttagtagagttttttttttttattactgattcaatttcagagcttgatattgacttattaaggattacagtctcttcctaattcaattttaggagattgtgttgttccagggatttatccgtttcttccagattttctaatttgtgtgcatagagttgttcatagtattctctgaggaccttttgtatttctgtgggatcagttgtaatgtcatttttgtactttttgacggtactcatttggatcttcttttttttttactatttttttaatctaactagcagtctaacaatcttattttttcaaaagactaactcttggtttcattgacgttttgtatagatttttgcacctcactttcattaagttgttctctaatttttgttatttcttttcttctgctagctatggagttggtttgtcctttattttctaattccttgaggtgcaaagtgcaggaggatgaagctagacccttgcttttcagcatgtaagaaaattaacaggatagattaaagatttaaatgtaaggccacaaactatgaaaatcctagaccaaaatctaggagatatttttcttgacattggccttgggaaaaaaattagctaagtccccccaaagaaattgcaacaaaaccaaaaattgacaagtgggacctgggtaaacgaaagtgcttctgtacagaaaaagaaactatcaagaggggaaacagacaacttaccgaatgggagaaaatatttgcaaactatgcatctgacaaaggtctaatatcccaaatgtaaatagaacttaaacaatacaacagacaaaaaacaaatagccctattaataatgggaaaaggacacgaatagatccttctcaataaaaagatatgcaaggagccaacaaatatacaaaaaaatgcttatcactaatcatcagagaaattcataccaaaaccacaataagataccatctcatgccaatcagagtggctgttatgaaaaagtcaaaaaacaacagatgctggtgagcctgtagaaaaaagggagtgcttgtacagagttgttgggaatgtaaattagttcagcctctgtgggcaaaattttggagacttctcaaatcacttagaacaaagctactatttgatccagcaatccttttttttcctctctctctctctctctgtgtgtgtgtgtatatatatatataaaatattttatatatatataatattttatatatataatattttatatatatataatattttatatatataatatattatatatatatataatatattatatatatataatagattatgccaaaaagaccaaaaagacacacacagttgtatgttcttttcagaactattcagcaaagacggaatcaacctaggtgcccataaatggtagactagataaagaaaatatggtacatacattatcagatactacacaaccatacaaaagaatgaaatcatgtcttttgcagcaacatgaatggagcttcaggcaataatcttaagcaaattcatgcaagaacagaaatccaaatactacatgttctcacgtaccagtgggagctaaacattaagcacacatggacatgtacatgggaacggtagacactgtggactacaaaaggtgtgatgaagggtggggggatgggttgggaaactacctgttgggtactatacttactaccttggtgcaataaacccacgtaacaaacctgcacatgtaccctctgtatctaaaataaaagttgaaattaaaaaaagaatgaaagggaatgaataaagctgatgtttataggccctcccaaaatttctggctcataacatgctttcaaagattttataaaatcatttttaaatttaataatttttaaaatttggaatggttatagatttacagaaatgttgaatatcacataatataattatacctcatgctattttccttattgttatattactatggtacatttgtcaaactaatattgatacattattactaactacattgcacttttcattcagatttcattagttcttaatgaaacggcttactcaagttgtctattttttatttatcatggcagttatttaatttattgccgttatgtcctttatattcccaaaaaactttttgtaattattctgtaaataaatacttgaaaatacttggtgagcttccattacttacaggaaatggtgaaatctataacataaatacagtgcagttctagtttttatctttttaagtgaatatttgacttccccccaccactctgttcacatctgtgcatggtttcttatttatttatttgacatgtaaaacttgtatatatttgtcatgtacatgatgttttgaaataaatatgtctacatagtaaaatggctcagttgagttgattagcatatacatcctagccctaccagtctctccctcttatttcatcaaacctatactttcttgtttgcatgttctatcctgcctcagattctgatacacatatgagattctgtaggggtgtagggtctgcatggtgataagaaaatctaggataataactaagatttctcatactacaacaccactctacaccttaggccttgttctagtagaaaaacttgttccaagatcaattatcaatcctaattccaatttttgcccagtcctgctccacagtttgaacttctgaactatgtgcagcttcctcatatttctatgtttctgaacatgctgctacttctgctggaattcttgaccaacttttcaccttcaatactctaattaaaagtgttgttttcagccagctttcagcatggttttacaaggagttatttagtagagactacacttgcacctctgcctaatcatattctccagctgcttacccaatcacttgtgcagcatttctctcagggttttgatgatgcataaagattgcggagagtttcttccctttggcatccaggaatgtagaagtcttttgcataccaaggttagaagctatggcatggttgtaaactcataaaatactatctttgtgagggagagagagagaggagagagagaaagagaaaacaaactcaagaccactttttagactgtacaagaggaaatgtggcatgtatataagagaagcatcattatataaatctgtcttttagtgtgcgtatcttggtatcaatcacatttttatttcaaaggcttttctgatccaagatctcggattgttcaaatccatgaggtgggaccacactcaagaaaaagtccagggtaagctttccatctagaatgataccttaaccaccagtgaaagaagcaaggtcaattttcattgattcaaattatattcaaaggtaaattctttacttctgtaaattattcacctgctttacaacgtctgttctagtaattaatttaagaattagtatattacaatttaaagtgtgtatcaatataatttcagttggaatttagtcctaggtttactaggtttaccaccatcagtaaacttagataatttaattccctctcttgaccttatttgtttcccagtggttagatgagtgtgaaaaaatcaatctctaaaatctcttatacatagataagtataggacttaacaaattatgcttcagtctaagatgatttaaggagatcatttaaaactgctgctctaaaataaatggttttatgtcaggaattgggtcgtgctcctcgttttatattcacagtgcagtaccagacacagataatatgtttagtaaatattaagtgaaaggataaattaatattggtacttaagaaatataactcaaatagatgataccttaagcaatctatatattgtgctatgctaactcatttgcagatttttttcaatatttatccttatatttcagctccacaaagactagtaattgtttcctcaattggagccaattagaggaacaggataggattaataagtaataaaataatgtcaggtaacaagagacataaaaacatgcacatgtgttataatgtctctatgagggatattgaagtcaagaacactattgcacgaaaagttttccatgagatagaacttgctgttaggaaagagatctagaatagtatatggctgccctttgtaaatccctcatgagaggaactaagacagtctctttcccagaagattccaagagttgcattctttgaaattgttctattggaaataatttatgtaggctcatggagttaaacaaaggaggaaacatttttctttaactacgcaaatcttatttcaactaatatatattctttagcattgtcttagagagatcaagtttaacctaagaacctgggtagaccagtagaaacaatccaccccatagaggctctggttcatagagttcagacgtctgatactggtgttcctgaaattctaccacaaaaatgatcaagagttagtttggcagattgtttattgcttttttgtccattatctaatttgagtcttaccatgggtagcattatctcacaggggagattagtagatgctagaaaaattatgttaatgttacacagtctgaagaggcagagctgtgagttgttctatctttaaatcttgtgcagtttctcccagcaaagatagcaaaaagatcttgggtcctagactatgattaatttgatgaactcctcaggaggagtctagataaagttgagttgtcaccactcagggtgaatagatcagcttcccaaacatctttgggcatccatgcttgaactcttaaatacatctatgcaagaatatagaatgtactctgttgctgctccagtcaaaggagtatacttgggagggtaggtgtgagcagtagatacagtctaagatttggacaagcataagcatgcatataggtgagaatcaggagattaacatagtaaggaggttagtgttctaagatgactcctatccaggcttctgtctctccttccaatcaacattttctctgatagcaaagatggataatgataattatatatttgcttaaagtatgttatgcacataagtgctttatatgtaatatatttaatatgtataacactctatataaatgtactattcttatccacattttacacttgagaaaactgaggcaaagggaagtgaagtaacttgcctaaagtcataaagttagtaaatgctgaagctgaaatttgaaagtagaccagttagggttccaggcatctttttcacaacttctctcccccaccttccatcgcagctactctactcctgtggctggatctttctttatggcaccccaattaattcaattgctaacttttaagcttaacacacaagactctgtaatctagacttgccttcttgtcagcctcatctcctgacactttcctatgtggattgtgtgctgaatcatactcaacttgctggcactccccaaagaggatggtgtaatgatttttaccttcacatattctatttgctaggcctggaaagttcttcctgccctgtctattcttttgtgcccacaccctgcaatcctcatcatcatcaggttaactctaactcatctatcagaattccactcagtgacaacgtttgaaaaggcagtcctgtctctcctgggcttccttcctgagccccttcacagagaactgtcacagtttacatgtggacctcctccacttgattgagaatacttgccaaatcaaataatgactgaatgaatgatcagtatcacatcacttgttattacatccccactgtaaatttaatttgagaaaagttggcacagactctatgctgtgatgatcttgctagttgcagctatagtctttgtctctaaatagtgtatataattaaaaaaaacttttcatgattagaagaaaaggagtcttttgattattgtagaaggtttaaggctttcaaatgagaaacatatttggtggctttgatgccatcagacccaggatatgcatagtagttaggaaaatagatcctgaagactcattgcgtgggttcaaataccaactctgccaatcactagatctataaccttgggcaagttacttactctttctgtgcttcagtttcctcatttctgaagtgggaatagtagtgatggactactttataagatcattgtgggagttaaatgagctatatgtaaaacatctagaatcaaacttggcatatagtaagtacaatgtgttttctgtttacctaaacattttttcagcccttatgattttgccaactggtgatgactgagcgcaatttgactttgctggtataggacgccgattatttaaagattttaggaatgtgaaacatattctccaattgaaggactttgcacgataaggaagcaattgtttaaattcaattctttttgtggtggcaggtgacagtaatcccagctacttgggaggctgaggcaggagaatcacttgaacccaggaggcggagattgcagtgggccgagatcacgctgttgcactccagcctgggtgacacagtgacacttcctctccaaaaaataatagtaattaaaaaataaaataaagaataagttcagttctttttatgagaaatttatctatctaatctttctatctacctatgatttatttaaggatatgtcagttatgtgtgttctggagaaagaataccacaattataccagtccttttacggaaaattatattgggcaatttgcctctttaatctttagtgctgctctgtaaaaaggagataataaaaattattatattgttgtgaggatggaattaaataacatatgcagagtttagcacacgattctgcacatggtaaaatgctcagtaaatgttagctactattaatgatatttctttaatggagattggcagatattatagctattatctcagaaataaaattgtatatgtttttaatattttctagtagttacattatatagcttttatataataactaaatacaccaaattacaaattatgcttactagagagattccacttgatagattctaattaaaaggaaacacctcataaattcaaaacatgttctatagatctcatttgaattctgaaacagctttgtgaggtaaaaaattttatcattcgtcttctataggtgagaaaactgagatccagggaagataaatagatttacccaaagttataaagctgatgagggcactcaaacttacaccactcagcttctgggcagtgctctttctgctctccatgcagaaaagaggtattctgagtaaagacggaaaatagctagtaattttcatatttcagaaaagccatttttatttcaagaaacttcagatcttgtctaatattaatctcctttaagaattttttcctgattatttttatccattatttttctctgtatgatgcaaggattcctattacagtttataaaatggcttcagacacttatttttaaactatcatttataacattatctgtatgataaatttcattcctaatttttcctgtgatcacaaggacagagagttatctgggtctttttcaaggcaaagggattgaggatgacagggacctgcaaagggattgaggatgatagggaactcagtaactttaaaatgtttcaactcttcagagcaacatagaaaaaagtatttctctgtataagttgatcacttctcatgtattccttactggcaagcaaaatggaattttcaaactgcaggtccaggcttatgattcaaatttcctcaatgttgatttataagcactaaaaatgacttaatttttaattgaattgagacttttaatctaattgagaaattggaaactgagtcttcctctcttgattaaataaaatgttacttttctataggtgagtagcatacattatatttgaaggattctgaaattttatacatcagatcttatactctgacttcatgcttttatttacagcctcaaaaaattaatttatttatttaaacaaagttctcactccaaagtaaatttctgacaagagaagttggaggtggggggagagagagcactgattagggaaaaacattaaattcaataaaaaagactcagattctctaggttcttgtatggaaaagaggaactataagactaattatgaaagaaattcaaatgtgagtcaatagtgtggaaatcaagctaaagacaagaaaaatattcatgaactatgttcaagaaatatgaagaactttctctaccatatttaacatcatataggtgttttcacaagactcttattgataggctttactatgcttaccacggtttataacgtgtttatttttgcagagaaccagagtcactccacgagtcctgcctggggccccatgaaagtggccaacaatgtcactgagtttatattcctgggactttcccaagattctggaatgcaattgatgttctttgtcttatttctcctcttctacgtcgtgatcatggtgggaaatttgctcattttgcttatggtcttttctgactcccgactacacacacccatgtatttcttcctcagtaacctgtcttttgtggacattgcctattcctcacccacagcacccaagatgattgaagactttgtttctgagaaaaagactatttcctactggggctgtataacttagatgtttaccttccacttttttggttgtgctgagatttttgttttgactgtcatggcttttgatcgctatgctgctatctgccaatccctccgttacactgtcatcatgagtgctaatgcttatactgtgctggcatcactgtcctggttgggggccctgggtcattcctttgttcagaccctcctgaccttccagctgcccttctgtaatgctcaggttatagaccattacttttgtgatgtccacccagtcctaaaacttgcctgtgctgatacaactctggtaaatatgttggtggttgccaacagtggtctcatctccctggggtgtttcctcattcttttggcctcctacacagtcattctgtttagtcttcaaaaacagtctgcagagagctgacacaaagttctctctacctgtggatctcatctgactatagtaactttcttctttgttccgtgtatctttatttatctccatccactactttcccattggataaagctgtgtctgtgttctataccaccatcaccccaatgctgaacccactcatctatactctgaggaatgaggagtaaagaatgccatgaggcggctatggagtagcaagatctccttgaaggaaaagcagagaggatagtttgtcagaattgcaaaatcactgaattagtggataccttcaatgatccctaatttactaataattaaaaaaacagttcctaaaatgcagcttttatattttgtctaacaggaaataatttgaggctattttagacgggctaaacttaaacctttccatacttggcaaggtttattctctcttctagagtacaagagttaacactcctactcaatatctcatttaacctcgttaaatcccttctattcacatcaaactctcttaagctaccattcagtaatttagagtggggttataagagaaagatatccctgatcatatcttctcaccatatcatgtctcttcaaaaaagaggtctaatttaccagaagctgcaccttttccctccttcttttgttttctttttcgtccttctctagtcttttcttatacatattgcaaaatctagtcagggaaacagatttgcaaggagataattacaatacaatacaacaaatgcagacatagaaatacatacttcctataatgaagagggttagtataaatcaacaaattgcccaaaggatggtttctgtgcaggaaaaaaaaaaatagaactttacatattttgaggtggacagcaatttcttcaaagaccctcttggagaatttgaatactcttctacccattactataatactatctttactgaaagaaatcttacttttttgccaataaaaacagactagattaaagcaactaaaatgagttggtatttgtaccattgaaatgactaaggagatgtaattctattataaatttttagttgaacttgtcttcagttccttaaaacaacaaaatggaataagcacattttcttcttgtggtattcttagtaaagttgaaaaatagttaagtattctcagtattctggaaaaggcatttttcttctaagaaattttgttagatcttgtctcatgactgatgttgttcaagaattctgtcctgattatttttgttcaacatttattttctgtatgccttaagcaatcctgtatgcaatttataaaatatcacttacctttttctcttttttagtggatttttatctgagatctacaacttatgaagaatacaaatgatgtatattcttttctactcttcatgtatggactagaggggcttgcacagtaggtacttgtcaaaatctgttgattgtaactccaatttctatttttttccttagtaatggggacctgacattattcatggtggaccaactaaaatattgcattgacttgcctcaggctcttttaaacttcaattcaataatttagaatgaccttataagaaaaagatattccttttgaagcccagtggacaatctgatgttaatagtagttggttggtgggacttttgaaaagtctttaaaatggtttgtctactccagccctctcatacatgatcaccattaacattttgattattaaaatttctttatagttattgcatgtccttatagttattttcatattactttccctttgcaaaagggtcattctatcctttttttaaactcctgattttttaagatagacaacaaacccacaaattatattaaaaatgatagaatacattaggtttccttttccctcctaagagcaaagtattaataataaaaataacaacacttgcagtaagaaaaaaatggctgagacccacaggaacaaagaaacaggacaggagttagatgcagagaagagatttcaacaaaagtttggaaaaggtaagacaaaaaagtagtaactgatttggcagggtcgggaaggctaagtctaaattcccaacaagaggaatagtgaggaaaaggggagagattcatttcctggaatccctacgatgattgggatgcaggatgccaggtcagcgggaggtgaggttcagggctgctaatgaagattaagagaaaggaacagttcaatcttctatcctctctttctgctcccagatgctaacggtagcatatgagtcacagacagaacattggcacctttgtttaagaaactgaatgttaatgtcacatctgcctttggagattacaaatgaaatggctacctttctactggaaccctgaccagaagtctgccagttagtaagctggcttaagagatcaatctaaaatttacataaggcttttgaaaaaaagaaaaaagtaagtctttaaaaaagccaaaaggaaactggtggaattagaggtaattcggggcgggggggggggaactgtaaaaaactgtatcttctcatcaatgaaagaaaatatttgtaatcttgaaataagaatatgatgtactgaaaaaatatagaaaaattatttttggaaggtaaaatcaaaaagaacaataaacaaaattaatatggcattaaaagaaataaaacaagtagtcaaagaagtcataaaagtacagtctctatgaaagtagaatgaaaatgtcaaagaaatagaaaacatgaaagataaaaacaagaaacacaaggaatcaagttaggggcaaaccattcaactcacacatattccaggaggacaaattaaacagaaggatggatttaaaagaaacaatgaaaataaatttcttagaacagaaaagcttaattttctcgatatgaaagatttactgaatgcccaccacaagatttaaaaaaaatcccaaggcacgttattatgaaattttatcaccttaacgattgaaaatattgtaaaattattaagaaaaaaccgtatagctcacgaatgaacagaaattcaaatggcatgagtatgctctgtagcaagctcatccttagaatacagtggaaaagtttctcacactgattttcaggctagaattctatacagaacaaatctatcaggaagatagaataaagcatatttaatcatacaaaaatttataaagtttacttcataagtactctctttttttgaaagtgtgggataatatatcccagcaaaacaagaggaagaaatgagatcaataaactaatatatgcaatgcagggtggctaaagccactttaaaaaaaatcccaatctcttttttctttcttcatgtgagtcaggtaatgtatatatgtcataaggtttgagggaggtacatttcacacaggagtgcaaaaactcagtcatcacgcttatgaactacgaagggatcaaaaggcacttttaagatgacagatgtacagtaggcataggagacaacagaaatggatgaaagcagaagatggaagccctccaggttcataaaacagaaaggagagggtgaaaatttatattatctaatatattgaagcatcttagttgtaaaggtacagtcaataagatgaaacaagttgatacactcaaggaaggatacatttatagaaaattatatcatttagagttccaacaggaagttaatgacacacttaatataggataatttgataaacatttatttaacgagatgctgtctatgaatttataggtatagagtaccacacaggccaggggtaagatggggtggagctgtttacaccattgtgcctgaagggactgagagagggaggaaatacagaaaccccaaaaagagatatttatgatagccatttgaaaggaggaatgaacttcagtgggaggtcaaccagcatgtggccacatggtctagcttattctccttcattccccttttccagttttattgaagtatatttgacaaataagaatcatacatatttaaatgtgcaacttgatgttttgaactatgtgtacactgtgaaaagatcatcacacttaagataattaacatatccattacctcacagggttatgtttttctgtgtgtggtgtgaacccttaagatctactcccttagtacatttcagttgtccaatacagtattgcattgtaatacagacaccatgttgtgcattaactctccagaactcactcatttttgcataactgaaactttgtaacctttagtccattatctcctcatttctccctttcctttccactcttggcaaccgccatcctaccttcagtttgagtattttagattccacacataagtgagatcatgcagtatttgtccttctgtaagttgctttttaaaggctgaataatactccattgcatatatatactacaattttctcaggctttattgaggtatgatttacaaataaaatttgcatatatttagggtatatgcatacttacgaaatgattaccacaaccaagctaattaatatattcatcatgttacatcattaccatttgcgtataatgtgtgtatgtgtgtgtgttaacacttgagatctactttcttagcaaatttgaagctactgtacatttggtctccagtacttactcatcttgtagctgaaagtttgtaccctttgaccaacatctttttcctggcatttcccagcccctgctaaccaccactctactgtccattgctatgagtttgatttttttaaatattgcacctgtatgggatatcatgtagtatttgtcgttatgtatctggcttattgcacttagcataatgtcctccaggtttatccatgtggcaaatggcaggatttccttctttttaaggctgaataatccattgtgtgtgtttgtaccacattaaaaaaatctatgcatctgtagatgaacacttagtttgtttctatatcttggctagtgttacaatgctgcagtgaatttgagagtgcagatatctctttaagatagtggttttatttcttttgcatacgtacctagaagtgggattgctgttattatatgagaagtttatttttttttttttgaggagcctacatactgtcttcaataatggttgcactaatttatatctctaccaaaagtttacaagggttttgtattagtccgttctcacactgctaataaagacatatctgagactaggtaatttatataggaaagaggtttaactgacccacatttcagcatggctgggaaggcctcaggaaacttatagtcacagtcatggtggaagaggaagcaaacatgtctttcttcacatggtggcaagagagagaagactgagaactgagtaaaggataaagccccaggtaaagtcatcagatcttgtaagaacttactcactatcacaagaatagcatgagaaaactgcccccatgattcaattacctttcactgggtctctcccatgacatgtgaggactacgggaaatataattcaagatgggatttgggtggggacacagccaaaccatatcaggtttcctttacatccttgccaacacatgctatcactggactttttgataaaaggcaatctaacaggtggttggtgatatctcagtgaggttttgatttgccttgatgatttctgattttgagcattttttccatatacctgttggccatttgtgtatcttctttggaaaaatatctattcagatcctttgcccattttatgaaatcattttaaaaatatcttttgcccatttagaagcttgtttgtttgctatttggtagtataagttctgtatatattttggatattaactccttattggatgtgtggtatacaaatattttctccctttctgtagatttctctttcatcaagcaaataaagatgagaccaatgtccaggaacttttccccatgtttcctcctaggagtttatggggccaggtcttatgttaagtctataatccactttgaattaacttttgtgattggaataagagaagcacggattctttgcatgtggatatccaatttcccaacatcatttatagacgagtctgtcctttacattgtatattcttggtaccttagttgaaaaaattagctgactgtaggtatgtgagtttagttctgagctttctattctgttttattggtatacatgtttttatgccagcaacatctgttttgattattacagttttgtaatggagttgaaatcaggaagtttaatacctctagctttgtacttatactcaagattgcttaagcttttcatgctcttttatggttgcatatgaatttcagaattattttttccattgctgtgaaaaatgttcattgccattttgatcgggattgcgttgaatgtacagatcattttcagtagtatggactttttaacaatattaattcttccagttcatgaatatgggatatgtttcacttatttttgtcttccacaatttatttcattaatcttttatacttttcagtgtacagatattctatctctttagttaaatttatttgtaagtattttattctttttgatgtgctcataatgataactttttcttgactttttctttctatagatcattattggtgtaaagaaatgcaactgaatttttctgttgattttgtagtctgcaaaattactgaatttgcttattagttctaacagttttttagtggagtcttcaggattctttctacataggatcatgccatcttctaacagagacactaacttttttatttggatgcactttatttctttttcctaattactttggttatgacgtccagtactatgttgaatggaagtggggagagtggtcttgttcttgatcttagagggaaacatttcaatttctcatcgagtataatgtttatcataggcttgtgatatacaggctttattgtgttgaggtacattcctataatttgttgaaaattttgtattgtgaaagaatgttgaattttgtcaaatgatttttctgcatttgtttagatgatctcatggtttttatttcttattctgttaatgtggtgtagcacatttgttgattgtgtatgttggataattcttacatcccaggaataaatcctactttgtcgtgatgcaaaatctttttaatgtcctggtatatttggtttgccagtagtttgttgaggattgttggacctttgttcacaagggacattggcctataatctatatttcttgttggtgtccttatctgggtttggtatgaaggcagcgttggcattgtaaaatgagttttaaaatatcccctcctcttcaactttttggaaggattttagaaggataggtattagttcttttcaaaatatttggtagaattcaactatgaagccatcaggtcctaggattttctttgataggagattttattattgattcaatctccttactcattactgttaagattttctagctcttcatgattcagtcttgtaggctgtatgtgtctaggaatttatccatttcttctaggctatccaatcttttgacttgtaatggttcatagtattatcttatgattctttatattttttgtagcatcagttgtaatgtttcctttttcattttggcttttatttatttaagtctattttttctcagtgtagatcaagtattgttgattttatttatatttccaaaaatcaatcttagtttcatgatcttttctactgtttctctagtctcactttcattgatttcttttctaatctttgttatgtcctttttttctaactttgggcttagtttgttctttttttagttcattgagctgtaatgttaggttgttaatttgagacctttcgtcttttttttgtaaacatttattactatacatttctcccttaaaactacttttgctgcatcccatacctttttgtatgtcatgtccattttcatgtgtctcaagatatttttacatttaccttttgacttctttttttggcccattggtggttgtttaatttccatatgtacatgaattttccagttttcctgttattattgattttagtttcataccactacggtcagaaaatatatttgatatgatttcagtcttctgaaatttgttaagacttgtttgtggcttaacatacaatctgtccaggagaatattctgtgtaagcttgagaagaatgtgtgttctgctgttggatcaaatattccgtgtatgtctattagattcatttagtctgaagtagttcaagacaatgttttcttaataatattctttctggatgatttatccattgttgaaaatcagatattaaagttctctattattgcattgcagtctatctcttgctttagatttgttaatatttgctttatatatttaggtgctctgatgttgggtgtattcatatttataactgttctattatcttgatgaattgactttcttaccaatatctaatgaccttctttgtctcttgtgacagtatttaaagtctattttgtgtgatacacatgtaactgctactgctcttttttggttttcattttcatggaatatttttgttttttatccctttacttttagtctatgtgtgttattaaaggtgaagtgagtttcttgtaggcagcatttagttggatcttatttttataaatcaattcagccactttttgtcttttgattgacaaaatttgcttatttatagttggtaagtaaagatttattattgtcaatttattgttttctggttgctttgtaggtcctttattcctttattactcctttgttgttttcctttgtgatttgatcattttcctcggtggtatgctttgattcttttctgtttatcttttgtgtatttactataggtttttaatttgtggttgccatgaggcttacataaatattcttattgttttaccaattcacttaaagacgataacatcttcactttgattgctaaagaagctctgtacttttacttcccttctcttacattgtgcttttgatgttacagtttacattttttatatgtcttaagaatttattatagctatagtcatttttcatacattcatcttataactttataatgatgttgtgatttacaccaccaccattatggtgcttgaatattctaaatttaaccatatatatactttaccagttagttttatatttttatatgttttaatgttactaattagctgccttttatttaatcttaaaaatccccctttagcatttcttgtaaggcaagcaatagtgaagactcactcaacttttcttttttttttctaaaaaagtctttatcttcttcatttctgaaggacagctttgctggcaaaatattgctggttggcagttttatttttcttccattgctttgaatatattatttcattctctcctgatcctcaaggttcctgctgagaaatccactgatagctttatttgggtccttttttatatgacatgattcttttctcttgctgcttacaagcttctctctttgtttttgatttttgccaggttgacgataatgtatgtttgtggattctttttttggttgaattgactggagaactttaggcttcatgcatctggatgctcatttctttcctgacatttgctaagtttcctatgattatttccttaaataagctttctatctaatgctctctctatttttcttctgaacctactataattctaatgttagctctcttgatagtattccatggcttctgtaggttttattcttttttttcttttatctccacttactggatgatttaaaatgctcggtctttgagttcacttatttttttattctgcttcacttagtctgatgttcaagcctctattacatttttttagtttagctgttgtatttttcagctccaacatttctgtttggttctttttaaaatattttctgtctctttattgagcttctcattttgttcttggattgtcttcctgatttcattaaactatttatttgtgttctcttgtagttccccaagattccttaggcaattattttgattttttccaggcaatttatagatctccaattctttggggttggttactagaaattaattttgttcctttggtggtgtcatgttttcctgcttctttgtgatctttgggtgttgattttgtcagtgactaaacctgctggagtcctctgtggagttaagtactatagtttgtgcaatgataattgtgggttccttggtagtaaaagcagtgtggtatgtgcagctgataatgacaggagacagacagattcctaggcagacagggataagtccctggtgaatcccaaccttcaagccaaagacaacctgaggcctgaaaaccaagccgccagttccaggtggagtccacgacccaactgagaacttcctcagtgccttttagtcaattaaatggtgctttttccaggcctgcccatgaaccaatcagcacagattcctccattctgagcccataaaaaccccagactcagcctcacagatggctctctgctttcagccccactcttacacagagggctgcccactttggctactctcttgttgtcaagagcttttctgctgctcaataaaaatctcatcagccttgctcactctgcggtgtctgcatgcttcattcctgttggttgcaggacaagaatccaggatccactgaacagtgggtgcgaaaagagctgtaagatacacctcctgttcaccaagctacagaagtgaaaaaaaaatgctgggtgccacaagtccccaattgctgagctgtgggcagcaggactgaatgagctgtgacacatccccatttgctgaaactgccagcagtgagaacgaacaagagctgtaacacttcctgggggctcagaccttgactcccagagcaaaagctgtaacacctcttcgggctccacagttgctggcatctctgagtttttgggcactgctgcatcccccttatccagatgccagcgctcaaggcagaagtcagtcatagcatgcccaaaccaaccgtgggctgagcactgagctacggtgggtgtcatggcgtctgggtgagtgagcatgagtggagcacagcctgccaggccaaatgagcaggacgagctcagagggcctgagtgaagcctcagcagaggctctgctggccatcgagatttccacttggcaaagtggccctcaaagaatcctgtgtcacatccatgagggctgttgaggtccttggtatagaaggctaccagaattccgctcagatcaggctactggggactgcattgattcctaccacaggactgatactgatagacctcatcatttctctttcttaccagcagtttacagatttctctcctatgttggtctccctagcaatctgggatgggtgaaacttaagctggttgtttgggcagtgctccagtaggctgggtaagatggttcactccactctccttttctctgcaaggggaacttgcaagctgagcagtgacctctccatactgagcactgccagcctgaggaagatgacgcaggcaaaatgaaactgttttttctaccatttttttgtgttttttcttgaagtttttctgtctgctctgttgttttaacttctgaagtagattcctgatctctgctagatattttcatttgtggatatttgcccagttgttgttcctttaggaggaataaagactgagatcacctactctgccattctagctgatgtctaacacattttctttgttcatctgtctatggacttttaggctgtttccatatcttggcttttgtgaataatgctgtagtaaacatgggtgtgaaggtatctctttgaggttctgatttcaattcttttggacatattcctaaaagtgggattgctgaatcatataataattttgtttttaatgttttgaggaactgacacattatttttcatagtgactgcaccattttctatttccaccaaaagtgtataggagtttcaattccctaaattctagccaacacttcttttgttttttgataatagccatgctaataggcatgaggcaatatctcattggtgtttggatatgcatttccttaacaactagtgatgctgaacatatttgcttatacctgttggccatttgtgtatttcctctgagaaatgtcttcaagtttttcacccactttgaaattgcattattatcattattatttttgccatagtatgactgatttttaagtgcttcttatataatggagttatttaaatttatttttttctgttcattatttgcctgttaaatttgtctttattttctagtaattttaaattgttttaatttctaacattttcccctatatttgtgtttgccattgataaattttaaatttcattatcaaatatgctataactcttttcttattgtttttccttcataggggcaggatatacttaaaagtttttatttattccaaaataatttaaatagtctctctatgtttctagtaattaaaaaaattactcctttgcaatttatgttaagtataagttataaaatataattcttttaaaaaatctggttaaccagttgttccagcacaacttattgtgtcctctgggacaatagaattgaaaatgcacgtcatactctagagagcacatattgtacatcgtagcattttccacccctaatcctgggaaattcgccatttttcttacttcttctgtgaaactcaaaagttgtgtttctgtgctctttggatgaagtgcaaatcaacttttaaattattccctcagggcttatgttcctacctggcttctcctggcctccagaggattgatttttgtagttacagctcatgctgctagttagtttactgttacatcagggcagaaactgatgcataccaacatgtacccaggataaagtcctccactgcgggtggtggaagaggcttcttctacctcctccccatagttcctgaaggcaccaagactgtcacagtaattggtaggtggaatgttgttataacatttacataaaccatcctatttttgagacagtaggacagataataatgatgggaataactatgtaaaatgctcagagatcagtggtaagaaacagaaagcagcatgtaaggaaatgtcttagggaactgtgatgatagtatagagtaggttttagctgtggagtgggtggacaaattgtttcttttcagccttggtctcaataattaaagcattttaaagtcagggttgaacagggcattgaagagacagcttcatcattttatactcataggatgaatcatttctaagcaagctcagagaaggctgttttgatttatgggtcttcagagcgtgacagattattaaaataaacgtccaaaattttgaatccttttactcctggaagaaagacaggaaaaccccaagatctttagttacttctttttatttttatttttatttttattttattttatttttttatactttaagttttagggtacatgtgcacattgtgcaggttagttacatatgtatacatgtgccatgctggtgccctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaatatgcggtgtttgcttttttgttcttgcaatagtttactgagaatgatgatttccagtttcatccatgtccctacaaaggacatgaactcatcattttttgtggctgcatagtattccatggtgtatatgtaccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggatgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtaggtacgcggcattatttctgagggctctgttctgttccattgatctatatctctgttttggtaccaataccatgctgttttggttactgtagccttgtagcatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatgaaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatggtttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattggataccctttatttccttctcttgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttggttctgtttatatgctggattacatttattgatttgcgtatactgaaccagccttgcatcccagggatgaagcccccttgatcatggtggataagctttttgatgtgctgctggattcggtttgccagtattttattgaggatttttgcctcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcttccttgtacctctggtagaattcggctgtgaatccatctggtcctggactccttttggttggtaagctattgattattgccacaatttcagctcctgttgttggtctattcagagattcaacttcttcctggtttagtcttgggagagtgtatgtgtcgaggaatttatccatttcttctagattttctagtttatttgcgtagaggtgtttgtagtattctctgatggtagtttgtatgtctgtgggatcagtggtgatatcccctttatcattttttattgtgtctatttgattcttctctctttttttctttattagtcttgctagcagtctatcaattttgttgatcctttcaaaaaaccagctcctggattcgttgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccaatagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggcatggtagttacttcttatagttcttcaggatgatctctgtgaagaggaagggaaaggtgaggcttgaaatatttcatttcaaagggattagtgttagtagtagcaaaaactttgaaaataaatagaaaagcaaaaaagaaacttaaaagcaaagagactcttacttgaaataaatgtgggtgaaatatgtattttaacaaaaaggattccaaaaagcaaaattaggaattatgtagcagagtagggaaagaagaaatgaattaataaaaacaattagatgttgtggtgtttaatttttgtcaaagtctactgatctatttattcaataaaaaatctatgtaatcatcccatccatccatccatttaacaaacacatattgaagaccataacatgctaggaactactttaggcagtagatatataaatgagacatactccatgacctcaaggagctcagagttcctgttatattttgcaaaatacaaactgaaaaattataatgtaatgagttaaaatttgtactggaggtgtaaacagtactattatgggagccataaaaatatgacatttttatggaacttatatatacaaaattcatacaaaatttcaggcattttagaaaacaagcttctgagaatagctgaaggatttaaaaatagtgatacatcaacaatgtaacaggactgtgggtctgggaaaaatgtggggagcattatatgcattaatcactacaatacctgtgaagtaggtactgttattatttccattgcactaatgaggcacactgaggcagaggtaagtgagttgcccaggattacacagctagtaagtgcttagctgtggttagaatgaaggcactgagaaataaaataaaaatgaaacccttagctccccaagctactgaatggaccctctcttggccaagggcaccccagagtaaccttaaaagctgagttttcatccatgacaagatgggcggtcagaggtgccttcttacatccccgccctcacttaactaccattagactttcctacctaagtgctaaatagaaaccagctcttttgaaagactccactgctgatatcaacaaatcactgaagcagtccctctttttttgtggttttaacatggcaattaaccagcattccttcctgataagagaccaactatatgctactcatgaaggggcatgaagcacaattgtgcatgtgcatggttgtcctttcataaatattcaagattcctcctatagcttattgagcatatgtatttggccacctcactcagtacatattccttttgacactgtctcgaaatgtttgtttctggctcctggccagaggctatatttcccagcctgtcataatagccacccttcaggctacaactctatgagaaataaaggtcctcctttccaaatttatgaaccccatcattcttcagttgatagcactgacaccccatatctaagtatattaaaagagaaataagctgcaaatatatataatatataaatatgtaatatatgtaaatatatgatatatacatatttatatataatttatattatatataaaatattttaatatactttaatatattcaagtaaattaaaagaatatattaatagttgtatataaaataagtattttaatatactttaataatgttaatgtatatactatatattttaatatactttaataacattaaagtgtattattaaatataataatatattaaagtatattaaaagagaaataagcagcaaatgatcttcaaaatagtctcattgagatcagcccttctcttatcctaatggtttcttcttgcctagtttactgtgggcaacaatgcatacagaaaatcaatgtaataactacatcttgatattttctgctactggtttatttatgacactcgaggtcccttggctacctatacccatctatatggtgaagatgcttctgtatactccttcctcaccatcccacagaataagtgagctccatatcctaaaaataggaaaattaatttgcattctttctaagtgttgtatatatccacaatggtgatgatatcactgtttctccctattgctacccaaatcattcttaatttacctttctgagaattttactctcaacctacttttactttaacggaatcataggattttagaggtagaacatttcttaaaattctagttaaaatccctccttttgctatgaagaaactgtcatagaggaagatctcacgacctcaacatcacgcagattcttgttttctcccaaagcattgcttctcttgagaagatttcacagttcactcaccgacagggaatgcacctgtactcctaggtatttccatagtcatcctctaggtactacatccctgtagattaagaatgggaattttctagatgttgttaaaagaggagcagaagcttaggaggagtaggtgggtggatgtaagatgaagtaaatcttcttaaggaacttatccaaccactgctctaagagtaaggactgatttggaatagtcatcccctcctcaatggcaaccttagaaaaaaatgccctaagtcaatcttcatgagtggcttatctcccccaagaatttcccataaacataattgcttgctttgggtttttttggtacaattcccagcttttcttggggtgttacagtgcatacccaagtatgtatagtttatttagcccaattttattaaggacgtggtatgggctggatgaacctcattttagacacagaagataggaaaacaatatttttaaattgccattgtggagttcaaattccagctgcctttggtactatgacaatagcaacatatgatccattgataaaccctggagttgcatctcctaaatattttctaaacaaattattattctcttcaaatagttattgctgtattgttagtttaagccatatatatatatatatatatatatatatatatatatatatatatatatattcttgtaatgttgtcttactctgatttattcacatagcagccagggtgatatttctaaattgcaaattgtattaagctattctcccgagttttattgtaaaacatattgaaagaaaattggaaatccaattttattattgtgggctacattacttggtctttgactaactctttattttgttcttatgcttctaccagttgtgggtcttctacagttcttagaaagtctttcatgacacaaggccttttcatttactattctctattcctaaaatgcttttcttcaaactttcaaagttagaaaaacgtcaccaactcagaaccttttctaaaatactccatcacacacataccactcccatcattatttactctaccattgcctttttatttcctgcttgtcttttagcactagtagcaattattttattttacttatttatattttattttatttttatttgtttacttatttattgtctgtctatattttcagaatggaagtttgatgaggcagatattgagtgttccttgttcattgttgtgtctcagcaggtagcatatagtagatactctctaaatgtttgtgggataaacaaatgaatagtttacagaagtgacacagaagctatatatttaggaatagactttttaatatcacatgtagatagctttgttttgacatgtgttaaatgacaagtgctggacagaataagaattgttgcgtcatttatggtattttaggtaatggttatgttaatgtagggaaactaggtgcttgttcttccttgaagtgacatggtgtagtggtgtgtgtgtgtgtgtgtgtgtgtgtgtgtgtgtgtgtgtgtgatgagtagtggctgagcattactagctttgggagtagggggtttgattggctgcctgactattggattgagatgctccagcaaaatatttcttttccacttgacacttgtgaagggtggaggacagagacactcatcaaggagtgtggagggatgaatcctttgtatttttgtcctaaggaataaatgtggttgattttggttcttaatgcaaagtatatacatcattagtttctaattttatgtcatatgttgaacactgaggtacaaaagaaaatctctttgacacttttttctggtaaaatcaccctttctattccataatacctgatgtatgtctgtcttttcaagacatcaacactcattcacataaattctttctagattagtgccattttctacttctgttttggtggaatgggtatggagtagagcagaggaagaaggggtgatttgtgtgatgacactcagaatcattgcatcatgtccccataataataaaaaagcatatgatcttgtaatggtatttactgctttaaaatattcatctcctttcaataataaagggacaattatttacttaggaacaaataatcgcttccatctggtcaaaaactacatagcattatagcaaaatatgtaaatgagctgagtaatcataatatttcagatgcttttgttagaaatttatttgattgttggaacctcatagttgacttatcagtgaatgtaaatgagttagtatataactagctcatagccctcataactaataacacaatgttgtgttattagttatgagggctatgagctgcctcctccaggtaagtacaataagatcattgtttcttggaatgttaggaaatatttcattctggataaccttattatctttcttttgattaaaatcttcctaaaccaaattttaaatttttcaatcttattaaatatgcttcattaactcactgaggtccacactgggcaatttatggacaaggggaaattgatcccttttctaaatagtcccacactattcaatttctgagtatttttacctttcttccgcttgctaccagattcctggaaaacactggttttatgtgtgtgtgtctgcttgtagtaagccatccctttttcaaaatacaatgcttctataagatattgaaagtcatttatctatgtttgttaaaattatgtgtaaattgagtcagtaggttccaaaaatggcgcatttaatttcttttctcagtagtatacatagtgcccataagtgtttggacacagccacgtctatttggttttacagaaccttaactttttaaaaattccttttcatatttaatttttttaagtaataggagaggcaatatcataaaatatcacatcaacagaaaagaaacaactctcttgtatttgctgttggttacaacaaaacttactttggtgtggcagtttttaaccttacttaaagaaaagcatatttggtaatgtgaactgttatttcatttttatttgacaagttttgtgctattagtggtgtcagattcaatacagggcagtaagcaaaattttaaaaataatattattcccattgtcaccttgaaacagcagagcagatcagctcagaatcaaattgggtagcaagcatactcatttctcagatcagtacacctacttacgttcctgctgtggtgagcaaattttatactcaatgtagtatcaggtattgatgaatctggtcacagctagaagaattttttatatagggccttgcatagctgtatgttgtggctggttacctgttaccaaggattaagctgtacaggttttggttacagttacggaaaaatatgtcccttcactacttatgaagccttgggatctcttttctgtatcacaactaaagtactgctagatctgtgtgtgtgctattagaatgcaagcctaagtttccaagttggcaagatttcccaacaaaaaaaaagatatagaaaaaagaggccacatctctgattgccagtctaaaatttggctacactcagaagtagcttcacatattgcttactaatgtagatgtttgggggaagaagtagtgcattgccaaatttcagaaaaagtaagtttttaacattaacaagctgagatttgagtttcaaatatatgccacacttcatatagttttaatgtttccaatttgtaacttcatcacatactctctccctcttggtttatcagatataaaatgggcaaccaaatgtatcctcgtgtaatctgttagtgacagggaacgtatgacaattttgaaagcagtgatataactctaggtaaatgctatgtctactaattatagtttcttaattttcatagctatattatgaaaagagtaaattgaagaaatggaaactgcaaattacaccaaggtgacagaatttgttctcactggcctatcccagactccagaggtccaactagtcctatttgttatatttctatccttctatttgttcatcctaccaggaaatatccttatcatttgcaccatcagtctagaccctcatctgacctctcctatgtatttcctgttggctaatctggccttccttgatatttggtactcttccattacagcccctgaaatgctcatagacttctttgtggagaggaagataatttcttttgatggatgcattgcacagctcttcttcttacactttgctggggcttcggagatgttcttgctcacagtgatggcctttgacctctacactgctatctgccgacccctccactatgctaccatcatgaatcaacgtctctgctgtatcctggtggctctctcctggagggggggcttcattcattctatcatacaggtggctctcattgttcgacttcctttctgtgggcccaatgagttagacagttacttctgtgacatcacacaggttgtccggattgcctgtgccaacaccttcccagaggagttagtgatgatctgtagtagtggtctgatctctgtggtgtgtttgattgctctgttaatgtcctatgccttccttctggccttgttcaagaaactttcaggctcaggtgagaataccaacagggccatgtccacctgctattcccacattaccattgtggtgctaatgtttgggccatccatctacatttatgctcgcccatttgactcgttttccctagataaagtggtgtctgtgttcaatactttaatattccctttacgtaatcccattatttacacattgagaaacaaggaagtaaaggcagccatgaggaagttggtcaccaaatatattttgtgtaaagagaagtgaaagataaattatacattttatagttcccctgaggatcattgtcctaaagcaggaagtatttgcagtaataatgctgcattgacttcctcctttcatttgtgttattaaaattttactataatttttctctattcattcctctttatattgaaaaaatagaggcattaagatgaaaataaatttactcacacctaccctgaaattcccaacagatcattattagaatttgagatataataatctgctaaagtacattttaactaattgtttattgagtactctgcagaggctctggctttgacgggaacatgttgagaaaaataaataagacatgagacgtgtctattacaaatatgaagtaaatggcaagcatatggatgcagctagcttcaagttagcaaataaatattgttgtcatgtttcagtgttggctcagtggaatggtatctggtcaacatcttgctgggtctggaaaaacagattatttgtcctttatctcctcttatttccagagttgatggaaaatgaggattttccatcaacttataaactgaaataccttataaaggtatttcagtttatatttcaggtggtgtctattcaacagtttggagacagaactcaaaattttatcacattatgaaaacaatttttatgaattcaaagcagagtataatttggctgatacatgagattcatgtcattccagatgaagcctccaggcaactagcaatttttgtagccagtccctacttacatccttcagagtgaaagcagccttggggagaaagcttctaggttgactgggattggtagacatctagccgtgtaatttttttctaaactatcatctcctttgccacttttgtatgttttccataattgctaattctgcctctcatgttaaacttaaattggtagagtgctgtttttgttagtgcttaattcagagttctttcccattgacagacctagacgtattggttcccatgatcccttagagaattattagggactgatttcctattctcaagcactaaaaactcactctccaagcttcagaatgtaagaggtagattagaacatttgattttataggttatgtttttacttaaatttattagtttttaatttcaaaactagggaatcttttcattgaagggcaagaatgcattgggtatattaatctttagtcttcttttttaaatttgataatgtaatatggactaaattttaagtgaattagatccttgtcaacattgggaatgaatatatagaaacaaatggtataactattcctagagttactatttatttacagatatattatttattaattgaggaggtaatttgtgccagacccagtgtatctcagatgcacaggatggaatggtggtacacaaagcttgttttttgctttgggaatttttccttatggtgaccttcttcgatcttcaatgctatgttgcttctcttctaggaacccaaaggcacagattgacgttataagtcctgatttttgacttgacttctcatcacctggaagtgaataaagcagtagacttctctaacattttgtaacacagcatgaaaaaatatagagtacaaaagatatatatatataatatgataaaatgatgagttacgtttctaaatcttttatcatcttactgtcatttctctatatttggtctagccagacttctattcattttgtcacttatctttcatcaaactagggctgatgctcttgggaaagggaccactgatttgatatgctcttcaaacaccagcacactgtactatatagaaagatattcactgaaaatactgaagctagtaatacaaaggaaaaaggcataaaaatagtgtgataactaattgcttacttaagaatattatctgaaattagaaactaatatcaatgaagaaaaggggaacttttggcaaactctagtaagtaataactgagcctgattcatggaggccataattggaataaggactgagagcaatttcaccccttggaggacatttggaagtgcccagagacatttttggtggtcacaactgaggacatatattggcatcttgtactgtttagacatcttacaatgcacaggacagcccccagcccctgactcccacatggattatctggcccaaaatgtcaatagtgccaagaataaagaactccatcaggttgagaaactctgacttaaataatgggcagggataaggcaggttagtgtagaagaaataggtgttaacctcatatgcaatcttgtctcattgaatattgtttccaaatagctcaggatcctcagcagtcaaatacaaaatatgcttcaggactccttttccctatataactcctatattttctttcagttacttttaaatgtcttttaatctctttttttttctttcagtctctcctactcctctttctttcaaaactgctgctgagctactatgtttaaaatcagcaatatctcggttgagtatattatctttagctcagtattgtgattatactttcaattatacactgacttgtgtgaaactttagaacccaagtcccattcatcttctggctttttgctaatctcaatattaaccagaattgtattattatatctggttaaaagagagctttattgctcaaacaaaattaaagttcttctgtttttttaattactaaaataatatatattcattaaaagttaaaaacatatgaatatataaagaacaaaacaagtatcactggcaatctcttttctcagggattttcttcaacaaagtttataaagtctcacccctccaactccattggaagcagaccagttggcctatcatgcattgttccaaaatataattaccattaaatagaggtccaggtgaagacaagctacaacatgcttacataaataagtataaccctcagattttatatcccacaaaactggcatttaaataaacaggccacaaagttttaaatatgcaacaaaaatctgtgaatgttgtttttaagacctctttgatgaaattatcagagaacaaattacagtcaaacatgtgactaggacaaaaggctgggtttctgacacacacacacacatatatatatacatatatatatacacacacatatatatgtatatagatatacacacatatatatgtatatagatatacacacacatatatatgtatatatatatatatatatatatatatacacagtagtcctcttttatccataggagatatgttccaagacacctgtggatgcctgaaaccatggatagtaccaaaccctatatataccatgtttttcttatacatatatgcctatgataaagtttaattcataaattaggcacagtaacagatttataacaaccaataatagaatagaacaattacaacaatatgccaacattactactcttgcactttggggccattattaaatagaataaggattacttgaacacaagcactgtgatgctgtgtctaactgataaccaaggtggctactaagtgataacgtgcaggtggcatgtataacatggatacactggacaaagggatgactcatgtccctggaaggatggagaaggacagcttgagatttcatcctgctacttagaatggggcataatttaaagcttatgaattgtttgctgctggaatgttccatttaacattttttggactgaagttgaccatggacaacagaaactacagaaagcaacactgtgggtaagagggggctactgtatttaatctagtattaggcttattaaactataaagactactaagcagacgttgaaaacagagatcgtcttcaagggaaaggcagtcaggataatatctcactggtttccttccttccttctttcctttttttttccttttctttctttcttttttttttttaagcagagtctcactctgtatcccaggctccagggcagtggctcgatctcggttcattaaagtcttcgcctcccgggttcaagcagttctcctgcttcagcttcttgagtagctgggattacaggtccatgccaccatgctcgagtaatttttgtatatttagtacagaaggggttttgctatgttggccaggatggtcttgaactcctggcctcaaatgatacacctgcctcggcctcccaaagtgctgggacaggcatgagccacgggacccggctgatctcttttccttaacaacaaaaaagtaaaccagtgaagagttatattatgacaagagaaaagagtttttatctcagtgaaaatataatcaaataagagcatcttcagagctggattatactcctaaatgtagtaactagaaatataaagtatctagaagaaaacacagaataatatatttgcttacacaattggaataagcaatgatatcttaagcagcacaaaagcaggtgtaataataaaaagtgatcaaatgaacctcaaaaaattaaaaattactgctcgtcaagatacactatcatcaaattattaaggaaatcatacactgggaggaaaatttggtctctcttaatctccctgtttctctctgtcttcaagtaaagaaaaatcagcaaaaaatttgaacagacactccagaaaagaagatacagaagtgatcagcaagttcacgaaaagatgcacgtcattactcagcagggaatggtccacaacacacgatcaagtgttcaggcagagcgctctcccactactctgaggaacagaacaaaatagcagagaaggaaaagaggaaggggtttatcaagtgccccaggaacatataacatactggagactagacacgtccataaaaatgactcagtttccccattgcttgttagtgctgcctggtcagtgggccagattcatccatggcactaggaaggcagtcagttctcatccccttcggacgaatctttctagaaactgatatagccaattaccaatacatcctcaccctcacgtgctctctcctggactccggatgctctaccaacatgaagaaatatattgagtgcctccaggtgctcagtcccaggcacttgacactctagactatgcagcagcgctgggaggactcagctttccgagctccacaattttatgttgggagcctgtggcaactactgacaaaaacaatgtagctgccatcaagatgtagttcttgtctgctgcactgttttaaaggtgcccggtatttattttaatcaggaatggtaagacacactgtcatggaaatgactgtcatgaaggaagaagtttttagactcacaaatccctagaaataagaggttggttaggtgagtggggaaatgagaaaaatgtgggtaagagcctttatcatggtttctgtggaaatagatggatggggcaggataaacaggtttaggattggctagattgaataattccagtgggctctggaggataggggctgtctctaagtgtctggcacttggccctggggtgattagggaaggcaaatagtggcctggagtgtaatagcgctataggtgcctgataaaagaagcggctggagtatggtttctagattggttgcaagtgaggcttttaccatctctaggaattggctagccataagagggatagttcctccagtgttaggaaggcacaagacattaaagcattagaaatgcagaaaatataatggcataagtaaaacacaacaccaaatgttggtgaattaattgttggaataacttgaactctcatacattgatgttgggaatttacaatggctaaccactctgaaaaacttaatagaaacttcaggtaatttcaggtagatgtaaacaaacagctaccttatgacctgataatcccattcgtgtttagctaagacatgtctatgaaatgatttaaattcgcatgctaatgaaaaccttattggtggcctaagatttgaaacaacccaaatgtccataaaaggataaaatgataataaacaaacttagggttaagtatataatgaaacattagtccgcagtaaaaagaaacaactacagaaaatgcaacaatacgcatgaatctctaaatcgtaatgctgagtttaaaagccagatacaaaataacacatgtcatatgcttctgtttttataaaatccaagaaaaggtaaaactaatctatgctattaggaattaaaagatgaaagctcattatgatgttagatggtgggggtggatggcaaagatcacaagaaacctttctggagtgacggaaatattctttatcttgtttagaatactagtttctaaagtgcatatatttaacagaagttactacgttgaacacttaaatgtgtgtattttaatgtatatacattgtattctaagaaatacaaccaagaatttattttcatgcttgcttgtaaatacagataaatttcttgaaggatacaaaaattaatattagcttccaattttgaggtatggggtgaaatggacatataggggacagatataagaaggaaatttctcactgtatgaattattttttatttaaaaatgtaaatatattacctattcaaaaattaaatacatttttaaagtcaagtatatttaaagtacactgcctaatttccaaccttatggtaatgccattaaaaattctgagttattcttgcttccatacctctcatatgcagtccttcaataagtcccattgattatctctccaaagtttatctttggtataaattcttctgtcttcttttttacctcttatcctaacctaccaacatctcttatttatattaatagttcttcaaatgctccctactgtttcccttgcctccacttcttgcattttatagcccgtttttcacttagtacctggcacaacattttaaacatgtaaatcaggtaggaacactcctctgcctgttacatctcacacatagtatgttgaccgattgccatttggcccatattggctctacctctctatcttcccttacaattttttccatttgctcactactgtcttgccacactagcctcctttctgcttctcaatgcaccagtctctcccttaatgagctttcaacaagtctatcttcagatcttcccagagacggtgtagttctgtcattcagatcttagttgaaatgttgccaccttgtcagaaaggccctccctggccagctcacttggaatagtagtctcttccgctttctcttatatttttatcatagtgctcattacaatcagttgttttctctctggtatgtttgtttgttgtctgtttccatgctttaggatgtaaaatccccaggaacagggatattttctgtcttgttcggtgctgcattgcagacactacaatacagcctggtacatggttttagtttctaagatagtctagggagacaaatctttcctagcaggaataacaagccttcattctaaggattaatttagatcattagactatcttcactttaagtattgtggaaaacattaggaagcaaagtccctaactatgtctacaattatgaaaaaatcatattttaaaaaatctttggtagcaagaaagactataatatactcaaaaatgggaatgtttttccatgtgtttctttacttatatcacttcttttctgtttcttttaagaaagtaaacactgcactttttagtttatttggtgtatatagttttacaaaatatgcatttttgtgcctggctttttatttcctattattccattactgtctttgcatttgttcctgttcttgcatttctcccccccggtttttttacctttatgattttgtgtatctctttctccctttttctcttttccccatgttccatttttcccacttattattttctgaattggacataaattagaacaaaatattattgattatgcattatatttgttgaaaaactgtttattaatttttaaaataaaaaatctttttaaaataaaaataaatctactgaaatttaattatattgtgttctactatgtgattcttaattacttttcttctgtctagtaatatttacttaaaaaaatagttgtctttgctttagtggaacataggagacacttattcctaaaatgaaaacaacaaaggccaagaccacaatagggtgtatttaagaatacatctctttgtgaggaattagtccttcaatatgcagttctcgtctccaagaaggattatgtcaaagagtctttgtgaacatcatttatttttctttgcctatttctttgtcatcagaaatatgttgaatttaccatactacctacctgaccacattacttcttttcttgatctatcaatgatttcctattatacacttttttaaaaaaaatagtaacgtaagaaataaaataacctcttttggctttctgcccacatggacctagtaaacatgctgactattctgtaatatgtgtcactgatagaatgttgattttaaaacttagaagtaacatagtgacttttaaatcatatatacttcactatttatatataacatgtttctagtctcattctttgactatattttgttggcattttaacaattccctttgaaagtgtttgcagctttgttagccttcaaattcccaaagtacattctccattgcatcacaaattggttgcataagagattcctctgtgagaagagatatttaacaatgaagtcaggaaaaattagttattgttccttctattagaaggaggtgatatctgctgtttgacaggagcattagattactagagaggtaaatgtttttccattctccatatttataaggaacataaggaagaaatggaaacatattgtaacacctcaggtgggacatctgctgccttgaaatgcaaagatcagaattatagtgattatataggttatgggtttcaaactagaaatagattaatatgtttaatctgaattcagtaatacagtagcaccttttacctggtcttaataatatagccccagtttctcctaatatttagaattaatttattgggaatatataaagcctttattaacattgccttgggaatgtttatacttggtcctaaacctatagctattaactgaaagacgtgagggaacagaagtcatatccaatgcagaaatgctaggctgcagaagaaatcttcaccaacttcacgattttgcaggagactagctctgtctagttcccacacctgctgggatgagaggttcttttacaaagagtcttaccatataccaatctggggctttgacagctggctgaaatgaagccttcataaattcttttctagtaatttcttacattaacatagctacctttaccccagcaactcatttcaaaggcagggacagaggatctatattatatatttacttcttagaaactaaagcccctcttaatatctacattttttccttgtttagttttggtttagtcagacttcaatatgctacttattgctatcattctcatattatattcataaatcaacacagtgagataaaataactcaggctaaggaagatgaccttcccaagatctcacggttaaaaaaattgcacaatgaagaacttaaacccagatagatgcccaaacgagggctttttaaatgacatccattactttgcctagaaatcatggcattataaacattggtatcagttaatgatttgatgatactctaactttatccacatttctcagaacacacaaaaaattaatgattatataggttatgggttacaaattagatagcacatattaatagacatcacattcttattcttattttgggaacatttctaaaatgtgtttttgctggtagggtggattaatgagaaatttctttcaagcagaaaggtgaatagtgccacttttattaagatcagttataaacagacaaaatatttgaggtaatgggaaataatttaaaagtatttacacagtatattttaagtaggatactattcaaggaaagtaatttagtactgaaagatgggttaggtatttttaacccttacaaaaattggagtgaagaaacttcatgtgctgtccttactactgtttcaaaagaaaacaatagtgatgcttctcagaattaatgggaaggcaaacatgagatctaataaaggagaaatgaatagagaagaagagagagtggaaaaatattggaaactgcaagaacattgagaagtaaaaacaacaaaggagaaaaaatagaagagataagagaaaagcaaggggaatcattagagaacaaatacgagagagaaagagaagataaaatagagaaagagaaaccaacttaagtaaaagtataacttaaaaaatgaagtgtagaaatatttagcgagatgggaggggaagataataaaataaatattttaaaaggaggcatgaggaaatataaagaaaaatgagtgaattagtgcctgtggatgggaatcaaatctccaaatacctgctccatgaactttttaacaagagcctggactctaaacgtgaacagtgcatagcgcagcctttatctggaatgtgtgtgtgcccccacccatcactctttcctcttctgtgctgctccagcattgtcaggaacagatgaaattttgtttctgttgaaattgaaatataggatagagggagtggcagtcattcagatttctatttcagcttccactgacagtgatccttctaacattgttatgttcttctaatatagttagacaagaccaagcttgtctttgcaggaatttctgtgcttttattttgctaggacttacttcattttacctagaggaatgtccaccttatgaatatatatatttggtttctggatccataatgagcatgatgtgagcactatccatataacaaaagagcttagagggaagcacacaaagggaacacagtgaatcaaagatatttgatggtagagggttccagatgttacagagtcagtaggagaacagaagtggataacagggaataaaatgcaaggtacagtgcaagaacctgaaactcccaatctcagagatacttgaaagtttcttctatgacccaaatacatcctcaatttttgaaagagtatgaaataaccaactgcataataacatgcaagatgtacacaacttaagagtaagcagagagggattcccgacttttctattagcaggttttatatgcacagaaagactgataaatattaaggtcaataaatggccaagtgccaaaaaaaaaaaaaaagaaaagaagaagggtatcatatgtaaaattttatgcttctgttttggttaggatacgtgtgtttgcgtgtatttatttgtgtctgtgtgatgtacatacatgtgatgtaagatacttttttctgtttgagacagagtcttgctctgtcacccaggctggagtgcagtggtacaatatggactcactgcaacctccacctcccaggttcaagcgactctcatgcttcagcctctgaagtagctgggactacaggctcctgccaccacgcccagctaatttttatatttttagtagagtcagggttttgccaggctggtctcgaactcttggcctcaagtgatccacctgctttggcctccaaaaagggtgggattacaggtgtgggccacagtgcctggcctaggtacttctttcataattcccaattctgaccatacctgaaaacctctgctattaattaatatattaggattagatatattttgaaaagcatatcttttgatgttttaaatagatgtgccattataaatattttctttgatttcttaattcgggactttattgtttttgtttccctctcttcttacacaccgactcctcattcagttagttaatgaacctctttccctctacgcttcatagtccacattattttaaaacaaatgtgctgtgtaacagaagcatatgaaatatttttctgtatcacattgtagtattttgttctagctcaagatctttagcttttaaatttttttatttcaaccacaaaccattttttgaacatgcaccaaaaacatacgtatcttctttatgcatttcatatccaattacatcatgattctatataaatgtaaaatgttcaaaaataaaacttcaaacaataggatacaataatgtaagtgtagaaattctcctattattgctttcataccaataaattatcatgcacatccccaagcatgagcacagtctcaatttggaagccactgtacagagaagcctcagatcttgttttctccagagtgactgagagctttttatttagaccagttcatttggttgatgttctatagagaaaagggaattatttctggtaagtacagttgcctttataaaagtttttagataaacattcctaaggtagcatttatataaaataaattgtactaattgctgtatagttcaatactcaataaattttgacaaaaatagatacatataaccattataattaaaaacggaacatttctgtccccttgaaaagttctgtcattcttctttgctgtcaatcccagctcatcttccattcaaagcaaaacatgaagtcctcaataactggggttaagttttttctcagtcagaaaaattttcatatgcctcatacaaatcaggaacaaattcagagcagtaacatccaagtctcacatgagtgaacacttaaacagaagcacaggactgaaacagaagaaagagtgtggcttcaggaccagggtgttggctatcatgaaatgaggaagcataaacagtagaagtgatttcttaggttgttgagatagatagaataatataaatgtggcataccttgtgtttagttcaagaactataatctagatgtaacacctgaaaataaactcttttattgatattctacaggcagaagaaatgaagatagcaaacaacacagtagtgacagaatttatcctccttggtctgactcagtctcaagatattcagctcttggtctttgtgctgatcttaattttctaccttatcatcctccctggaaattttctcattattttcaccataaggtcagaccctgggctcacagcccccctctatttatttctgggcaacttggccttcctggatgcatcctactccttcattgtggctcccaggatgttggtggacttcctctctgagaaaaaggtaatctcctacagaggctgcatcactcagctctttttcttgcacttccttggaggaggggagggattactccttgttgtgatggcctttgaccgctacatcgccatctgccggcctctgcactgttcaactgtcatgaaccctagagcctgctatgcaatgatgttggctctgtggcttgggggttttgtccactccattatccaggtggtcctcatcctccgcttgcctttttgtggcccaaaccagctggacaacttcttctgtgatgtccgacaggtcatcaagctggcttgcaccgacatgtttgtggtggagcttctaatggtcttcaacagtggcctgatgacactcctgtgctttctggggcttctggcttcctatgcagtcatcctctgccatgttcgtagggcagcttctgaagggaagaacaaggccatgtccacgtgcaccactcgtgtcattattatacttcttatgtttggacctgctatcttcatctacatgtgccctttcagggccttaccagctgacaagatggtttctctctttcacacagtgatctttccattgatgaatcctatgatttatacccttcgcaaccaggaagtgaaaacttccatgaagaggttattgagtcgacatgtagtctgtcaagtggattttataataagaaactgagaaggaggaattctggctggaattcatatcattcatttaacaagtcctgtttttcactgagtacctcccatttgccaggtaccattgtaggcaatggaggagagttatgcataatgagagaataaacttattatatttaaagaatataaaggaaaccccagagtggttgaagtataatgagtaagtgtgagaaatttaagggttaagttttatgtgactgcaagggtctttcggtctgaggtaagaattttttcatattttaattgtggtaagaacccattttaatgttttaagcaaaggagcagttcatctacaatgctttcctctactggttagagcaacatcagcaagattttaggcagagattaataaactgtaaaatatcaaaaaccaaatgtatgttgcaagtatgttatgaaaaagactatagtattttatatatataaatatattaaaattatatatattttaatgtttttatatatattttatatatatgtatatttacatatatataaaataagtaatatatttttatatatttataaatatatatttttatatatttataaatatatatttttatatatttaatcaatatataaataaatatatatttcccccccaaaatttggtggcgagataagaaaggaagccaatttgtttcatggtaaaatgtcatgaaattatttcacttattttttcttcagagcttcacgatgattattagacattattagatatttagtacttcagattgtattacagattacataaatcactccagttattttcaacatagtgaagcagcttcgttgtctggggaaatacctgcagttcgttgtcttgtgctgtgccgattaatgacacagactcacacacggagtgggttaaggaacagaaagtttattaggcaagaaggaagagaagagcttccccatacagagggagaagcactctgaatggagtaaccccacttgtggggaaagcagtcagttatattgggaggctcagggaggtagtgtctgatttgcatagggcccaggggattcctttgaccaggtgtgtcattcacacaacccatgaaaagactggccctcccaccctaatcttttattctgcaaatgcggcttctacctggctgtcaccatgatgcctgcacatgtggctttacttggctggtgccatgacaactgcacatgtggcaacaaaggaaagtgagcgggaagagtcatattgagtggacctggctgttagccacctgcatttacttctgcaagcctgtaatttacatacctatgcttccagcatggcttttcaggctgctttctgttagaaaagaaatggtttgggggctgcttttttattaaaaggaaaagcctttctgaggactcttttaccctttctagctgcctaaaaataatttcttaataactcctgtattaatagtggggtctaatgtgagaaattaggtacttataaaatttttcaagtatagaagaccattatttatgctgggcatctattatagaaattgttaccagaaaaacactgtagaactaacctgctaagtgacctatccctgccataaccaggagactgagaggacaagaaaccactttcccagctcttggctcagggaacacatcaatcagccatggtctggcatgaagagaattgtagagagcacctctcatgttattgtctctctaattattttttctaaattaaattttgtatgagtatatttgatagaatctgtaatggtagtggcaaaagtctttgacaaacctgtctgtgtgttgacagcttcttcagaaagcaaacaaaaatggtggtaaaatataggataaaaagtttgcaatcttggaggtgagaaaggccattgaagtttgacaaagaaaatgaaaataaaaagatgtattaaatcttgatatctgctacatattttgatatgtaaaaatgaaaaaagtttatatgggcaaaaggcagaaaaacgctgaaaatatttctatggcatatagatgtggagattattttctgcatgattataaggtttgcatgtaaattgaatattttttccctactccaagattgtatgagagggcatccatgaataaaaattaaaataaaaattactaaaaatcgatataaacgataaaaatttatctaatacataaataatttgcttaaatgaatatgaaataggtacatagaaggaaatgtgggcaatgaacaaaggaaaaaaacgaaaaggcttataagcatgaaagtaagcttacccttaaaaatcaaccacagaaatgaaaaccactgattttgattagcatgtaggataatgttgctcatgtattatcaataaaaaagtacagaatagggtgaggtgccagaagcagctatcatgtgccactcatggagagggagacagggtggtgagtaaacactagctcttcacatggatcgtccatgaggccatgttaggattcatcaaggaagcaactgcaatcgatggacagcagaaaggggccaggcaggaaagcagtccacccaggattggcatagagccaggtgaggctccctaccatagggaaagggtgaataagaacctcctgggacccacacttctgccatgggcctctgcaatcctggcacaggagatctcccgtgaccccgaggggcttccagaccaacacagagagattactggagtctgggcagagctgcagctagggtcacctggagccccatgagccgtggggccctgagcaccttggtgccagctgccatagccacaccaacaagggaggccagctctctcgcatgcccctagaataggggctgcatccacggtgctgaggagcagactgaccgcaggccccgcttgcttcatcaagccaggcaaagcccactggcctgggtcgcccacgcagccaccccactcccacctgagcactcaggccagtcaggctctccatttctttggaaaggaactcccagaggtaaccaataggcctgagatttctggtactgtggtctcccacatgccgccctcaggctggggagggatcgaagagcgcaggaactatcctagaccttcagcaaggcatacgaacagctgtcatacggaaaagtggccagattattttccacttgggtccctgtcccagctactcctcactgggcagggcctccgagcctggggtcccagcacagctaccccacccccacccgttctttcatttggcggtggccctaagtttctctggggtagagctcccagagacaaccggcaggctctgtgccaccactagctgagtgtaaggtccttccttgctccccgcaggctaggtagggaacaaagagcctgactgcagctgtcctagggagagaaggccagattgtcttccttgcgagcccctgaccccggctactcttcaccagacacggcccggctttggcccacaacacagccgccccacccctggatccttcaccttagcagtagcagtagctctgggtggagttgccagaggcagctgacaggccctctgccactgctgccacccccagggctagggagggaacaaagagcctgcttgctgtgcttgcacatccagcatgccacagctgcactacggagaggaggtcagacagtccccccaacaagcccccgatccctctgctctccaccagggagggccctgggcttgcgcccacagcacaaacgtcccatcccgggctgatcattctggttggcagcggctctgaatttctctggggtggagttcccagagacaactgacaagccctctgccaccgacaccgccaaggtccccttccctgctcccccaagcaggggagggaataaaaagcccgaactcgccccaggtccaacaccagagcgggaagagaaacccacactcccagagcaccgagaggggtaaccgcatgagttcctgggctgctgtgggagcggggcgcgcctccctctgcaggaggagcctggaaaaggtgtggcctatctccctgcggtggcctctgcctgagggagccccgcagcctggaacacctagcaaaagaaatgatggtgcagtgctagtgatcggagggggttcccccaaggctcaggaactgacctggtgagggggtcacttctttccccgctgtacgggagaccaggctgtagatgtgaggaagtacaaaggaaccacaggcctgagcaagagtgtatttaccgtccattactcttaagcgacatctactggattgcagccaaaactgctacaacaccaaaaatattttgctaatatcccccagtgaaatcaaaggcaagaatccagccacaaataaagaccctgcacaaagccttggctatctgaaaacattcagaaacaaagccaagtgactatactcaaattacaccacaggtaaaggaacgccaatgcttccagatgagaaagaatcagtgcaagaactctgacaattcaaaaagccagtttccccatacctccagatgagtccaccagaccccaagcaatgattttttttatttgctttccttatttgtttgcttgtttggagataccttttacttttttaattttaattttttaatttttaggttcagttatacatgtgcagatttgttatataggtaaattgcttgtcattggggtttggtgaacagatttatcacccaggtaataggcatagtacctgataggcagttttctgatcctcacccttttcccacagtccaatctcaactatgcccaagtatgtattgttcccttctttgtgttcatgtgtattcaaggtttatctcaaatttgtaagtaagaacatgtagtgtttagttttttgttcctatgttggttcactcaggaaaatggcctccagctccatgcatgttgctgcaaaggatatgatctcattctttttatgactgcatagtattccatagtatatttgtaccatattttctttatcaagttcaccattgatgggcatctaggttgattccatgacattgctattgtgaatattgctacgatgaaggtacttgtgcatgtgtctttatggtagaatgatttatatttctttgggtatatgcccaataatgggattgctgggttgaatgctactttggttttaagtactttgtgaaatcaccacactgctacccataatggctgaactaatttatattcccaccagcaatgcataaacattcccttttctctgcaaacttgccagcatgatctatgattttttgactttttaataatagcccatctgactggtgtgagatggtatctcattgtgcttttgatgtgcatttctctaatgattagtgatgttgagcattttttttcatatgcttcttggccaagtgtatgtcttatttattttttttgagatgcagtttcactcttgtcacccaggctggagtgcaatggtgcaatctcggcccactgcaacctctacctcctgggttcaagagattctcctgcctcagcttccccaatagctgggattacaggcacctgccaccatgcctggctaatttttgttatttttagtagagatggggtttcaccatgttggccaagctggtctcgaactcctgacctcaggtgatccacccgccttggcttcccaaagtgctgggattaccggcgtgagctactgcgcccagccttgactactctttttttttttttttttttttttgatggagtctcactctgtcaccaggctggagggcagtggtgcgggcccggctcactgcaacctttgcctcctgggttcaagcaattttcctgcctcagcgtcccgagtagctgggactacaggcgtgcatttgcaaatactttaacctattctataggttgtctgtttactctgttgataatttattttgctgtgcagaagctttttaggttaattaggtcacatttattaatttttgcttttgtcatctttgtcatgaaatctttgtcaggggctatgctgagaatggaatttcctaggttgtcttccagggtttttatagtttggggtttcacatttaagtctttaatccagttggattgattttcatatatggtataagggaggggttcagtttccattttttgcatatggctacctagttatctcagcaccatttattgaatagggagtgcttttcccattgcttgtttttgtcagccttgttgaagattagatggtttttgtttttagttctgtttatgtggtgaatcacatttactaatttgcgtatgctgaaccaaccttgtgttccagggataaagcctacttgattgtgttggagtagagttttaatgtgctgctggattcagtttgctagtattttctttttttctttttttttttgctagttttctttttttgttgtatctctgccaggttttggtatcagaatgatgttggcttcatagaataaattagggaggagtccttcctcctcaaattttcagaatagtttcagaggaaaggtaccagctcttctttatgcatctggtagaactcagctgtgaattcctctgatcctgggctttttctggttggtaggctttttattattaacacaatcttggaacttgttattagtctgttcagagtttcagtttcttcctagttcaatcttaggaggttgtatgtttccaataatttattaatttcttctagtttgtgtgcataaagttgttcatagtagtctctgagggtttttaaaaaatatttctttggggttggtggtaatgtttcctttgtcatttctgactgtgtttatttttatctcttctcttttttgctttattagtctagctagtgctctatcaatctgatgtgttattctgaagaaacaaaacctggatttgtttatcttttgtatggttttttgcatctcaatttctttcagttcagctctgatttcagttatttcccttctcttgctagctttgggactgatttgcttttgtttctctagttcctcttggtgtgatgttaggatgttaatttgaaatctttccaatattttgatgtagtttttttttttagtgatataaactttcctcttaatactgctttatctgtgtcccagagattttgatacgtagtatgtttgttctcattagtttcaaagaatttcttgacttctgcccgaatttcgttgtttacccaaaagtcattgaggagaaggttggttaattttcacgtatgcttttgatgtattttattgtattgatttcaatgtttattgcattgtaatctgagaaagtgtggtttgtatgattttggattttttgaatttcctgaaaattgttttatgattgattgtgtcgttgattttagagtatgtgccatgtgcagatgagaagaatgtataatattctaatgtttttgggtggagagtactgtagatgtctgttaggaccattttgtcaaatgttgagctcagtcccgaatctctttgttcattttctgtctcaatgctctaatattgtcagtgggttgttgaagtctcccagtagtattgtgtggttatcaaagtctcttcaaaggtctctaagaacttcctttataagtctgggtacttctgtgttagatgtatatattcttaggattgttaggttttcttgttgagtttaaccctttaccatcatgaaatacccttgtcttttttgattgttattggtttatagtctattttgtctgaaattagaatcagaccatttgctcttttctgttttctttggcttggtctattttttctccatccctttattttgagcccctggatatcactgcatgtgagatgggtctcttgcagagagaatacagttgggtcttgcttctttatctgacttgccactctatgccttttaaatgccttgaagcatttaacccatttacattcaaggtcactcaaggttagattgtgtctttcccagcaatgattcctaacccataagaaattactgaaatgagagacatagaattcaggatctggatgtcatggaagctcattgagattcaggacaaatttgaaatccaatccatggaatccagtaaaatgacagaagagctgaaagacaaaatagccactttaagaaagaaccaaactgaaactctcgagttaaaaattcactagaagaagttcataatacagttagaagtattaacagcaaaatagaccaagctaaggaaaatatctctgagctcaaagactggttctttgaattaacactgtgagacaaaaataaagaaaaaacaattttaaaagtgaacaaaacttctgagaaagattatataaagagaccaaatctacaactcattgccattactgagagagaaggacagagaataaacaacttggaaaataaattcgactatatagtccatgaaaatcttcctaatcttgctagagaggatgatatgcaaatccaagaaatacagagaatcctggctagatattgtacaagatttacaaggcacataatcttcagattcaccatagttaatgcaaaagaaaagggatctagaaagaaaggtcgggttatgtatgaagggaactccatcaggctagcagcagacctttcagcagaaactttatcagccagaaaaaattgggggcctatttttagtattcttaaagaaaataaactccaaccaagaatttcatatcccaccaaacttagcttcataagtgaaggaaaaataaaatccttctcagaaaataaaatgctaaggtaatacatttcaacttagctagccttataacaggtccttaagggagtgctaaacacgtgaacaaaagaacagcatctgctgccacaaaaacacgcttaagcacatagcccatagacactatgaagcactacacagtcaagtctataaaacagccagctaacaacatgatgacaggatcaaaatctgacatatcaatattaatcttaaatgtaagttatctaaatgccctacttaaaaggcatagagtggtaagttggataaaaaggcaagacaccactgtctgctgtcttgaagagaccaatctcatatgtaatgaaacccacagggtcaaagtaaagggatgcagaaagatttgtcatgtaaacaaaaaacaaacaaaaaatagtaggggtcactatttcttatagcgtataaaacaaaccaacaacaattaccaaggacaaagaagggcattacataatgataaagggttcagttcaacaagaagactttatcctaaatgtatacacactgaacattggagcacccgactcataaaacaagtttttcttggcctacaaaaagacttagacaatcatacaataatactgggagacttcactgctccactgatggttttagatcgttaaggcagaagacgaacaaagaaattctggacttaaatttgacacttgactaattggacttaataaacatctacagaacactccatccaacaaccatagaatattcattctcatctacacatggaacatattgtaagatcaaccacacgcttcgtcagaaagcaagtctgaatacattcaaaaacactgaaatcatcccaggcacattcttgaaccacagtgcaataaaattagaaataaacgtcaagaaggtctctcaaaagtacacaaattcatggaaagtaaacaacttgctcctgaataactcatgggtccacactgaaattaggcaaaaatcaaaaaaattctttgaaattaaaacagggacacaactaaccaaaatctctgaaatgaagctaaagcaggaaataaaactttttatataaataagtaaataagataataagaggaaagattatagcactaaataccttcatcaagaagttagaaaaatctgaatttaataatccaactttgtacctaaaggaactagaaaaaaaaaaagctcaaagctagcagaagaacagatataactacaaatagagaaaaacttaatgaaagtgagatgcaaaaatatgtacaaaaggtcagcgaaaccaataattggtccttcaaaataaaaataaacaaaattggtagattgctagctagattaacatagaaaaaaagctgaagacccaaatgagtacaatcagaaataacaaaaatgatgttgcaactgatcccacagaaatacaaaagatactcaaagaatactataagcaactttatgcatacaaattagaaaatctagaagaaatggataaattcatggaaacacacaatctcccaagattgaatccctggaagagattgaaaccctgattagaccaacatcaagctgtgaaacagaatcaataataaaaaaacctaccaaccaaagtaagtcctgggccagatagattcacagctgaattctaccagagttaaaaaaagaactctaccaattttattgaaactattccaaaaaattgaggagtaggagctcctccctaactcattctatgaagccagtatcatcctgataccaaaacctggcagggacagaacaaaaaacaaatcatcagggcaatatcccttatgaatacagatgcaaatatcatcgacaaaatattagctaattgaatccatcagcacatcaaaaagttaacacactgtgatcaagtaggtactattcccgagaggtaaggctgattcaatgtatgcaaatcaataaatgtgattcatcacataaacataataagagacaaaaaccacatgatcatctcaatagatgcagaaaaagcattcaataatatccaacatcccttcatgataaaaacccttaacagactagattttgaaggaatatacctcaaaacaataagagccatctatgacagacccacagccaacatgatactgaatgggcaaaagctggaagtattccccttaagaactggtaaaggacaaggatgtacattctcaccacacttcttcaacagagtacttgaagtcctagccacagcaattatgcaaaagaaagaaataaaagatatccaaataggaaaataagaagtcaaactatttctattcactgatgatataattctatacttagaaaactagctttcacaaaaaggcaactagaactgacatacaattttaggaaggtttcaggacatgaaatcattgtataaaaatcaatagcatttccatacatcaataatgtccaggctgagagtgaaatcaaggacacaatcccatttacaataggcacaaagaaaattaaataccttggaatacagttaaccagaaaaccctctacaaaattaatggcaaaaacactgctgacagaaatcagagatgacagaaataaatggaaaaacattccatactaatagattacaagaatcaatatagttaaaatggccacactgcccaaagcaatcaacagtttaatggtattcctatctcaccaccaacaccattcttctcagaattagaaaaaaaagatagaaaattcatacagagccaaaaaagcctgaatagtcaaaacaatcccatgcaaaatgtaccacatgaacatatgcacctactctgtacccagaaaaattgaaaaaaatgtaaaaagaatgaaactagaggcatcacactactcaaactataaggccattgtaaccaaaacagtatgctactggtacagaaacagacacatagacccatagaacagaatagaaaacccagaaataaatccatgcacttacaaccatcagctcttcaacaaggcagacaaaaataagcaatggagaaaagactctctgtttagaagcccctactgaggaaagttgtgggcttgagtctggagcctaagaacattcaaccaagctaactctcaggtctctctattcaataaatggtgctgggataactggctagtcagatacaaaaaaaagtgaaacttgacccttatttttcaccatatacaaaaatcaactcaaaatcgattacagatttaaatttaagacctcagcctatagaaatcctagaagaaaacctaggaaatactcttctcagccacagccttggcagagaatttttggctgagtcctcaaaggtaattgcaacaaaaactagagttgacaagtgggacctcattaaacaaaagagcttctgcacagcaaaaggaactatcaatagagtaagcagaaaacctacagaatgggagaaaatactcacaagctatgcttccaaacaaaggtctaatatccagaaactataaagaacttaaacaaagcaacaagcaaaaaaacaaaacaaaaaaaatccacttaaaaatgggcaaataaggcaatcctaagcaaaaaagaacaaagctggaggcatcatattacccaacctcaaactatactacaaggctacagtaaccaaaacagcatgatactggtacaaaaacagacacataaaccaatggaacataatgagaggccagaaatagtgctgcacacctataaccatctgaactttcacaaagaggatacaaacaagcagtagggaaaggactttctattcaataaatggtgctgggataatgggcaagccacatgcaaaagactgaaatgtaaccccttctttcttttccatttgttttattttattttattttgttactattatactttaagttttagggtacacgtgcacaacgtgcaggttttgttacacatgtatacatgtgccatgttggtgtgctgcaccctacaaaaatcagttcaacatggattggagaattaaatgtaaaaccgcaaactataaaaaccccaggagataacttaggaaattccattctcaaataggccctggctagtatttcatggtgaagacaccaaaaacattgaccacaaaaaccagaaattgacaaatgagacctaagtaaactaaagagcttctgcagagcagaatgaactgtcaacagagtcaacagacaacccacaaaatgggataaaatatttgcaaactatgcacccaacaaaggtctaatatccagaatctacaaggaacttaaatgatcgagcaaaaaacaatctctttaaaaattgggcaaaggacatgaacaaaggcttttcaaagacctacatgcagccaagaagcatatgaaaaaatgctcgacatcgctaagcacatcaaaaccacaacgagataccaactcacagcagtcagaatggttattattaaaaagtcaaaaaataacatgctagtgaggtttcagagaagagggaacacttatacgctgctggtgggaatgtaaattagttcagccattgtggaaagcagcgtggcaatttctcaaagaaattaaaagagaattatcatttaacctagcaatctcattattgggcacatatccaaaggaatataaatcattttaccataaagacatatgcacacatatgttcaacacagtactattctcaatagcaaagttgccatcaatggtaaactgtataaagaaaatgtggtacacagacacaatggaatactatgtagtcataaaaagaatgagatcatgtcctttgcaagaaagagataaaaggaaaagagtcaaaattaatgaaacataaagtagacaaacattagaaaaaaatttaaaagccaaaaattggtattttgaaatgattaccaaaattgataaacccctagtagaatgatgaattttaaaagagaaacacacaaactaccaacattaagaataacaagagaagcactattagtcctaaagaaactgaagggataataagggaatatgaagaatagcaatatgacaaaacacatttgccaaaactggcacatcaagatatacaaaatctaaataggaatatattttaaaaggaaatgaatgtagagctgaaaactttctactaagaaaattccaggttcatatggctcaaccagggagttttctaaaatatgtaagaaacgggtaatgccaattgtatctaaactcgttcataaaatagaagaaaggataccattgcccaactttctttatgaggtcagtataaccctgataccaaaatctgacacaggattttgcattgcaaggattttgcattacaagaaaagatgatttctcaaaaacatacacatacaattttatttttatttttttgagacggactctgactctgtcacccaggctggagtgcagtcgtgcgatctcggctcactgcaagctccacctcccgggttcatgccattctcctgcctcagtctcccaaatagctgagactacaggcccaccac[131 bp omitted]caccctgcccggctacacataaaattttaaaacaaagcattagcaatccgaacatgacaatacataaaaagttgtgaccagatgggatgtatcccaaaaacgcatagttggcttaacatttgaaaatcaatcaagttaattgctatattcactgaatgaaggtggaaaaatgatatgatcttgccaatagaggcagaaaatcatctgttttaacatccattcatgtctgtaaaaaattctaagtacattggaaatgaaagggaacctctccagtccaataaagggcaattatgaaaaacctatagcaaccattataacatatgataaaatcttgaatgcatgcccccttaagattaggaagaatgcaagtatccatgctctcaccacttctattcaacatgtgctaaccactgaaataaagttttttttaaaggtattaatattaggaagaaaaaaataaaaatctatttattcatagaagaaatgtatgtgtagagcatactatggtgtctttaaagaactagaatttacaaggaaatttatcaagggttgcaggatacaagatcaacatttaaaaactaaatcttggtgagaatgtgaaacaactattaactctgaaaaacgaaacaaagtaaacttaaatgttattattcttcttcctttgatttttttgtataaagtgttaaggatataaaaatactagaagtcatgccataaaagtaaaaaaagaaaaaaaaattctctttgaatttttattttt[144 bp omitted]gcctcctgagtagctgggactacaggcgcccgccaccacgcccaggtaattttttttttttgtattttttattacagacggggtttcaccgtgttagccagaatggtctcgatctcctgacctcgtgatctgcccacctcggcctcccaaagtgctgggattataggcgtgagccaccgtgcccagccattctttgactttttaataatagtccttctgactggtgtgagatggtatctcattgtggttttgatttgcatttctctaatgcatagtcaagctgagcattttttttttcatatgcttattggccgtatacatgttttcttttgggaagtatcttttcatataaaaagtggtcatttttttgagaaaaaaatgaataaattcagagacaaactcttgttggttaaaaataatattgaatatatacatgtcaatgcataaatagaatacaatttaataaaataccagtaatacttttcattgtaaaattaattcaagattatctagaagagaaaatctatccaaggtgataaaactttcctagaaggattaaaaagtctccattttgaggactattttagatcttcagattaattttatcttatctattagagtgaacattaagaggtgagtaagatcctggattatatgcacaattatgaaaaaaaatcatgtttttaaaagttttggtggcaagactaacctactccaagatggggttgttattccacttaagaacgtatctaacctcattcattttgcttcctttctctattttcctctgtgcagctctctttatcattgttttctttttatggttatatggatttgtagactgtgcatttatatggactgccatgcgagctgtcacagcccaggcagtggagtgtggttggcttgtgggtagtaagaagaatttaccaacaactgtatagatttgaaaaggaaagttgtattagatggaaagaacgctgcagaggagtgcagcagggctcctcagcaagagaggactgaggacgccactgcagtagatttttccttagggtatttatggaccttaaagtgggagcttaagggtaatttttaccatattagccacataggtcatggtaaacaattacatttatagacattttggtgccttgatgtcagcagggattgcacaatgagtttagaatacatgcattccagagatgcatagaaattctggttactcacaaatttttggaaaagaaatctcataccagatgccagctttacataatagggatgtctaattacttctgaattccttggataaggagttttgcctctggatggtcttgctctcctcatggactagtatctctctgtctcttcaccatttgtttttaagtcatacgactatctttccatttatgtctctgctagtctttcttttcccttttctcttgatttttattttgattattgtaactttttctgtacttctctctctctcctttcttctttctttcctttttctactcttacactttgtttttgaactgtgaaataaattaaaacaaatgtatttggtgataaattatgtttattacccccaaatctgtgttcttatttcacttgtaaagtgacccataaactcagtgttttctttaaagcaaaagattaaactaatttttaaataaaattaataaaattaatttgcatttattttttctgactcaaataatttttaaaattaataatctttaatggaaaaatgtttttcatccttgttttagttgagcagagtgaaagggaacaaattacaaataccaagatcatgacacatcttttcatgctatgtaggagatcaccttccctttagcaattgttctatcctatactaagaaactattttctctaagaagaattatgcagcagtattcatgagcttttcaatatttcctttgctaatgtccttatcaccgtcaacatcctacaactgagtaaggtgcttatcttgcatgcaaaatttaaaggcgtgcccaaaaactcaatagtagagataaacatttaaatcaatattttgagaaatcaaaattaattttaaaatttgtgataaagtaccaaattttaagcaaaggcaggatcagcaactgccatgttgagccatgttggaacctgaggcaacaggaaaaataaataatattggtgaagtcttttttaaaaattatactttaagttctgggatacatgcgtagaatatgcaggtttgttacataggtaaatatgtgccatggtggtttgctgcacccatcaacctgtcacctacattaggtatttctcctaatgctatccttcccctagccccccaccctgtgacaggcccccgtgtgggatattcccctccctgtgtccctgtgttctcactgttcaactcccacttaagagtaagaacatgtggtgtttggttttctgttcctgtgttagtttgctgagaatgatggtttctagcttcatccatatccctgcaaatgacatgaactcatccttttttatggctgcatagtattccataaagtatatgtgacccattttctttatccagtctatgattgatgggcatttgggttggttcaaagtctttgctattgtgaacagtgccacagtaaacatacatgtgcatgtgtctttatagtagaatgatatataattctttgggtatatacccagtaatgggattgctgggtcaaatggtatttctggttctacatccttgaggaatcgctacactgtcttctacaatggttgaactaatttaccctcccaccaacagtgtaaaagggttcctatttctccacatcctctccagcatctgctgtttcctgaccttttaatgatcaccattctaactggcatgagatggtatctcattgtggttttgatttgcatttctctaatgaccagtgatgatgagcttttttttcatatgtttgttggctgcataaatgtcttcttttgagaagtgtctgttcatatcctttgttcactttttgatagggttgttttttttcttgtaaatttgtttaagttccctgtagatgctagatattagccctttgtcagctggatagattgcaaaaatttcctctcattctgtaggttgactgtccactctgatgagaggtttttttttttgtttgtttgtttgtttttttgctgtgcagaagctctttagtttaattagatctcatttgtcaattttggcttttgttgccattggttttggtgttttagtcatgaagtctttgcccatgcctatgtcctgaatggtattgcctaggttttcttctagggtttttatggttttaggttttccatttactcctttaatccatcttgagttaattttgtataaggtgtaaggaaggggttcagtttcagttttctgcatatgtctagccagttttcacaacaccatttattaaatagggaatccttttcccattgcttgcttttgtcaggcttgttaaagaccagatggttgtagatgtgtggcattatttctaaggcctcttttctgttccattggtctatatatctgttttggtaccagtaccatgctgttttggttactgcggccttgtagtatagttcgaagtcaggtagtgtgatgcctctttctttttgcttaggattgtcttggctatacaggctcttttttggttctgtatgaaatttaaagttgttttttctaattctgtgaagaaaatcaatggtagcttgatggggatagcattgaatctgtaaattactttgggcagtatggccattttcatgatattgattcttcctatccatgagcacagaacgtttttccatttgtgtcctctctttttccttgagcagtggtttgtaattctccttgaagaggtccttcatatcccttgttagttgtattcctaggtatttcattctctttgtagcagttgtgaatgggagttcactcatgatttggctgtttatctattaatggtatataggaatgtttgtaatttttgcacattgattttgtatcctgagactttgctgaagttgcttatgagcttaaggagattttgggctaagatgatggggttttctaaatatacaatcatgtcatctgcaaactttgacaatttacctccctctcttcctatttgaatacgctttatttctttctcttccctgattgccctggccagaacttccaatgctgtgttgaataagaatggtgagaaaaggcatccttgtcttgtgctggttttcaaagagaatgcttccagcttttgcccattcggtatgatattggctgtgggtgtgtcataaatagctcttattattttcagatacgttccatcaatacctagtttatttagagtttttagcatgaaggggtgaattttaccgaaggccttttctgcatctattgagataatcatgtgatgtttgtcattggttctgtttatgtgatggattatgtttactgattgggtatgttgaaccagccttgcattccagggatgaagccaacttgatcatggtggataagctttttgatgtgctgctggattcggtttgccagtattttattgaggatttttgcattgatgttcatcagggatattggcctgaaattttcttttttatgtgtgtctctgccaggttttggtatcaggatgatgctggcctcataaaatgagttagggaggagtccctctttttctattgtttgtaatagtttctgaaggaatggtaccagctcctctttgtacctctggtagaatttggctgtgaatctgtctggtcctggacttttttttggttggtaggctattaattactgcctcgatttcagaacttgttatttgtctattcagggatttgacttcttcctggttcagtcttgggagggtgtatgtgcccaggaatttatccatttcttgtagattttctagtttatttgtgtagaggtgtttgtagtattctctgatggtagtttgtatttctatgggatcagtggtgatacccctttatcattttctattgtgtctatttgattcttctttcttttcttcattagtctggttagtggtctatttattttgttaatgttttcaaaaaaccagctcctggatgcattgattttttgaagggttttttgtgtctctatctccttcagttctgctctgatcttagttatttcttgtcttctgctagcttttgaatttgtctgctcttacttctctagttcttttaattgtaatgttagggtgttgattttagatctttcctgctttaagctgttggcatttagtgctataaattttcctgtaaacactgcattagctgtgtcccagagattctcgtacattgtgtctttgttctcattggtttcaaagaacttatttatttctgcctaaatttcgttatttacccagtagtcattcaggagcaggttgttcagtttccatgcagttgtgcagttttgagtgagtttcttaatcctgagttctaatttgattgcactgtgatctgagagactatttgttatgatttctgttcttttgcatttgctgaggagtgttttacttccaattatgtggtcaattttataataagtgtgatgtggtgctgaaaagaatgtatattctgttgatttggggtggagagttttgtagatgtctattagttctgcttggtccagagctgagttcaagtcctgaatgtccttgttaattttctgtctcttgatctgtctaatattgacagtggggtgttaaagtctcccactattattgtgtgggaatgtaagtctctttgtatatctctaaggacttgctttatgaatatgggtgctcctgtattaggtgcatacatatttgggatagttagcttttcttgttgcattgatccgtttaccattatgtaatgcccttttttgtcttttttgatctttgttggtttaaagtctgttttatcagagactaggattgcaacccctgcttttttttggctttcaatatgcttggtaaatcttcctccatcccttcattttgagcctatgtgtgtctttgcacgtgagatgggtctcctgaatacagcacaccaatgggtcttgagtctctatccaatttaccagtctgtgtattctaactggggacttaacccatttacatttaaggttaacattgttatgtgtgaatttgatcctgtcattatgatgttatctggttattttgcctgttagttgatgcagttttttcatagcttcaatagtctttacaatttggtatgtttttgcagtggctggtaccagtttttctttccatatttggtgcttccttctggaggtcttgtaaggcaggcctggtggtgacaaaaatctgttagtattttcttatctgtaaaggattttatttctccttcatctatgaaactttgtttggctggatattaaattctggtttgaaaattcttttctttaagaacgttgaatattggcccccacttctttctggcttgtagggtttctgcagagagatccactgttagtctgatggacttccctttgtgggtaactacttgacctttcttcctggctgaccttaacattttttccttcatttcaaccttggtgaatctgacaattatgtttcttggggttgctcttctcgaggagtatctttgtggtgttctctgtatttcctgaatttgaatgctggcctgtcttgctaggttgggaaagttctcctggataatatcctgaagagtgttttccaacttggttccattctccccgtcactttcaggtacaccaatcaaacgtaggtttggtcttttcacatagtcccatatttcttggaggatttgttcattccttttcaatcttttttctccaatcttgtcttcacgctttatttcattaagttgatcttcaatccctggtatcctttcatccactcaattgatttggctattgatacttgtgtatgcttcatgaagttctcgtgctgtgtttctcagctccatcaggttatttatgttcttttctaaggtggttattttagttatcaattcctctaacctttttcaaggttcttagcttccttgttttgggttagaacatgctcctttagctcagaggagtttgttactacccatctttggaagcctacttctgtcaacttgtcaaactcattctccatccagttttgctcccttgctggcaaggagttgtgatactttggaggagaagaggtgttctggtttttggaattttcagcctttttgctctggtttttcctcatcttcttggacctatctaactttgttctttgatgttggtgaccttcagttggtgtttttgggtggacatcctttttgttgatgttgatgctatttctttctgtttgttagttttccttctaacagtcaggcccttctgctgcaggtctgctggagtttgctgcgggtccactccagaccctgtttacctgggtgtcatcgcagatgctgcagaacagcaaagactactgcctgttccttcttctggaagctttgtcccagaggggcaccagccagatgccagctggagatctcccgtatgaggtgtctgtcaactcctgctaggaggtgtctcccagtcaggaggcacaggcatcagggagccacttgaggaggcagtctgtcccttagcagagttcaagcgctttgctgggagatctgctgctcccttcagagatggcaggcaggaacatttaagtctgctgaagctgtgcccacagccgcccttccccccaggtgctctgtcccagggagatgggatttttatctataagcccctgactggggacgctgcctttctttcagagataccctgcccagagaggagaaatctagagaagcagtctggctatagctgctttgctgggttgcagtgggctctgcccagttcaaacttcctggtggttttatttacactgtgaagagaaaagtgcctactcaagcctcagtaatggcggatgcccctaccccaaccaagctcgagtgtcccaggtcaacttcagagtgctgtgctggcagcaagaatttcaagccagtggatcttagcttgctgggctccatgggggtgggatccactgagatagaccacttgactccctggcttcagccccatttccaggggagtgaatcgttctatcttgctggcattccgggtgccactggggtatgaaaaaaactcctgcttctacctcagtgtctgcccaaatggctgcctagttttgtgcttgaaacccagggccctggtggtgtaggcacccaagggaatctcctggtctgcaggttgcaaaaaccatgggaaaagcctagtatgtggatcagaatccaccattcctcttggcacagtctctcatggcttcccttggccggggagggagttccctgaacccttccacttcccgggtgaggtgatgccccaccctgctttggctcatcctccgtaggctgaacccactgtctaaccagtcccaatgagatgagccgggtacctcagttggaaatgcagaaatcacccaccttctgcattggtcttgctgggagctgcagactggacttgctcttatctggccatcttgccagccaccctctaaagtttggtgaagcctttaattgaaaaatttgagtctagtcacatatatatatatatatatatatatatatatatatatatatatatgtatatatgtaatttttgcctcatcctacccctgcttgcttttgtggtacaaagcaataatctctcatcatttatttaatatttttctccttttgaattttattataacatgtaaatttacttctctcaaacttctatttacttctggactaaaaagtatgcttctgaatagggttctgtctttttcacagtagaatttttgttttagaactagaaaggaagtcagcttggcattatgtagcacatttaaaaaaaattaattcttgcaaagctctggtatttttctttgccttatttagttgataactaatatagtttgcctaataactccctttggaagcattcagtgggtcacggtagtctcaaatctcaaaagcactttctccattacaatagagagattttaaaatctaaggttcctcatgtggcaatgaacatttatgaacaatggcaaaattggttagtcttactaggagagggaggatggctactttgtgagagtaacataagatccctgaaggcttaaatttctggagctcttcatatatatacaagaaacaagaagaaagagacaatagaaaaaatattgcaactattttacttgttcacctgatatcttagattgcagttgaatagacaggtcagagtattagcaggaatagccacaggctaaggtctaaattcagcagtggggcactgtgtattctctctcctaatagatctccatctgcatttaatgcttgggattactttactggtgaactaaacctttaattctattataattttccatagactcaagagaattgacatctggtgttaaaaaacaaaaaatcatacaaatgactgatatgtatcattttccttattaaatatggaagaaaggggaggaggatgcagaaatggttggctaaaagctccagagaaaaacttaacagattttatgattttgcggaaggtaagtccttgacctcttcattttcacattcagcaggtatgaaagtttcttctgttacatatggttctatcatttattcatagaattttgacagaaagctgtagaactgaaaaaaagcttgatatacaaactactagctgtattggcaattttacatgaaggcattactgaccctccacagcttctttctattaaccattcagatttatgcaactaccattatcccaggggttactcaaagacattgacaaaagatctagcagcattctgtccattcaatataactacttttaacatctaaatattttcaggattaactttggttgaagcatacttgaatgaattacatattaataccatcatcacctcatttgatcctcatgttacccccatcagacccaaagagtcaatacattaaactatttggtagatgaaaactcaggcttctgaaagctaagtgactttgccagaatcacacagtaagttaattgctcagtcaaggcatgagagtcagataaatgattcccaaaccagggatccttttatgttattacattgcctaaaaaactggcattcaaatggaatttagagggcatttaatctggccatctcatttgattgatgaataaattttctggctaagaatctatacatttgtttagtgctttatatactcagcatcagcatcagtataaattaaattttctattatgttctcagcctgattcacactttttagaaaatataaaacttatttcatactcaaataatttactaaccttgtgtagttagtaaattattactactaatattacatctctatttttgaaatttacattcaatatatttatttcattaggatgctactaatgaaattaactttttttttaaaaaaaggtgaatcatctcatttttatcaggttcactacatatatatgaagtagttgataaatgactcagcgttggccaattgcaagaataccacttaaaagtaaatggttattactgaagagtgaattatacattttcattttgtagacttaacatttaaaatggaagatggtgggaagcacacacatttctcagtcttgttggaaaagcaaatgacaacgagattttctgtttcttgtttcgttttgtttttagatgcattagcaagacaggtgtgggtagaatggagtagccatgaacatagacaaaaagtggagagagtgaaaacatatcagagtgaaaaaacatagataaatgtaagggagaagaaagaaaaaaaaataaagaacaatatttaaagagaacaaaataaatagagccagaaagaaacagagaaggggaaaagaacaggcaacaaattaacagggaaaagaagtcacaaccagaaaaaaaaagaaaatgaactgcttattgatgaataaagaaagagagaaaaagaaaaataaggaaggaggcggagtaagcacataagatctctaaacacttggctccagcagcccatctgaccacactcagactccaggcatgcacacacagagttgcctggagatgtttctgtgtctccaccttgcaaatgtggtgaacccttctccttcatcttccctatttctgcagtgtgtcatcatggccagaaactgatcaatccacgaattagctgaaatggcaagaacgattagagatacagtgaggagggtatggtacagagttttgacagaactttctctactaatttggctaaaatagaacactttactctgatgacgtcatcatttatggattttttttttttggtagaaacttattttattttgcttagaggaacgctcatctgattagtctctgcgtctattccaaccacaatttagagaaggtagagataattcaaagatggaaatgggacagggaagaaagttgatcaagatgtcaagtagtacagaatcccatctgttaagaaacagtggaaaaataacagtgaggctgggacacaggcagaatggaagagcttataaccttcaatttcaaagtccttcagaaatcctcaaatgtctcagggatattgttaaatgctaacacatcaagaaatacctcactctatgttagcatgtgggatgcataaaacatataagtaagtacagttgactccagaaaaacatgggtttgaaccacacgtgtccacttatatgtggattttcttccacctctgccacccctgagacagcaaaacgaacccttccttttccttctcctcagcctactcagtgggaagacgacaacgataagaactttatgatgatttgcttccacttaatgaacagtatttatatcttcctttccttatgattttgttatattttattttctgtagcttaatttattgtaggaatatagtatataatacataaaacaaaaatatttgttattcaactgtttatgttaccagcaaagcttctgatcaacagtaatcattagaagctaagtttttagggagtcagggtatgtgctaattttttattgcacaggggatctgcccccttaactcctgcattgttcaattgtcaactgtagaaggggctcttgatttaaggaaatatttatataggcagatagtagaataaatgttgagacaaatggctggcaaagggggaaaaggttaagacatgagcagaaaagctcatttgaaggatctacaaaatattttttcctattacaattttgcatgtgtttgtatgtgtgtgcatacgtgtgtgttcatgtggtatttgcatatgtatatatgatgatgtgttaaaatatgactttcataaattccacatgtggctgccagtaacacccagaaatttctgtattaaccactctattccactctagggatacataaagcagatagttttaatgcttcttaaaatatgtaccctaagatgacactatatagatgtgctgtctgtcttttggtgtttgtttgcttgtttgtttgcttgtttggtgtttgtttgcctgattttctatttctctcttctttcttccctcatcctctatcttcttgtctttcttttctaggtactgttgcagtagcattttctgtcaaagattttcccttccttccgtaccccatgtgctagagcacttatttatttatttatttatttatttatttatttatttattttgagacagagtctcgctctgtcacccaggctggagtgcagtggcatgatctcggctcactgaaagctctgcctcctgggttcacaccattctcctgcctcagcctcctgagtagctgggactacaggcaaccaccaccactacggcta[138 bp omitted]ctagagcacttatttaaaacaaatacactgtttagttaaatcatattaagaatatccttttatattacagtttgtattttgttgtaggccaacaattttcaaacttaaaaaatttactcccctaagacattttttgaatatgtaaccttaaatgtatgcatatttatttataaagtatatataaaccattgtactatgttatccattataaatattaaaaagtgaatttagaaaagaatgaaatgtagtgatacatataaaatgttatacactgactaaatatagataaattactatgttctttctatacttcagtggattatcatgtgcaccttctggaatgagtataccccatgaaaacaatctgaattttaaatatgaattttcttcacaatggacattgtttttctttttatttaaacaaggttgaacttacaaatcaaagcaatacgggagtgattttagactagcaatattatctttagttattcagatgcacaaaaagaacattcattcattgaagctgtgattaaaaaattctttatctatttaaactgaatagtatacacttgcattatcctactacttatcaagcagagcaaaaaataaaactcactctaaacttaagtaatataactacaggttatttctcatctttgaaatggaagaataacactacagtatctttatggctacttacagtgtatctatgctatgatcttatgagttgagataatgatattttaaagttttatacttgcaaattttatattgtagcatattttttgttaaagggctgtatcttgggtgtcatacttggaacagagaaagaaatgtgttgtgagtttattagtatttgaaactcaaaaagtgctaaataagctgcatgcaggtgtggagtggccacaggagtggtgttcaaacagagttacagctggagcactgtgcctgtgttaggtcaaaagtggagctatagcttgggattctcgtgaacagtctgggaaaagagtattcaaggatatcagaccaaaaggagtataataagaagtaaattagatgataagacagagggcaaggaagagagttaccagctaggaactgggaattacacaggaactgagggaagaaaatgtctaggaaaatttgggggtggtgtggacaaggagaaaaagggtctaatcccaagaaaagaactaaccctcaagcatagtatatccaaaaaactcaaagaccttcagatttgaagttaggttgtgtctccattaggaaacttacatgatttaggaatgtaggaatcccaacgtggaggataccagactcctaacatggaaaatgattctgtagaagcacatggttgaatgggaataaacctgtagctttgagaaccatattttgttttcatttttcattttaaatttggagaaattaaggtaacggagtttccccagaataggagagggatgggaagtgttgtttttagctgaagtactatatgtgccaaatattttttagctgtagaactagtatctagttggaagacatagcaataacaattaattctgcttcttaatgtactgcaggccagggaaatggaaagcgagaacagaacagtgataagagaattcatcctccttcgtttgacccagtttcgagatatttagctcctggtctttgtgctagttttaatattctacttcttcatcctccctggaaattttctcattattttcaccataaggtcagaccctgggctcacagcccccctctatttatttctgggcaacttggccttcctggatgcatcctactccttcattgtggctcccaagatgttggtggacttcctctctgagaagaaggtaatctcctacagaggctgcatcactcagctctttttcttgcacttccttggaggaggggagggattactccttgttgtgatggcctttgaccgctacatcaccatctgcctgcctctgcagtattcaactgtcatgaactctagagcctgctatgcaatgatgttggctctgtggcttgggggttttgtccactccattatccaggtggtcctcatcatccgcttgcctttttgtggcccaaaccagctggacaacttcttctgtgatgtccgacaggtcatcaagctggcttgcaccgacatgtttgtggtggagcttctgatggtcttcaatagtggcctgatgacactcatgtgctttctgggacttctggcctcctatgcagtcattctttgtcgcatacgagcgtcttcttctgaggcaaaaaacaaggccatgtccacatgcaccacccatatcattgttatattcttcatgtttggacctggcatcttcatctacacgtgccccttcagggctttcccagccgacaaggtggtttctctcttccacacagtgattcttcctttgttgaatcctgtcatttatacccttcataaccaggaagtgaaagcttccatgaaaaaggtgtttaataaacacatagcctgaaaaagggcaaaaaaaaaaagaataaaaatagactgtagaattttatctgaaattgatttgtttatttccaagtactgcaatcattgaatacctcccatttgtcaggactattctaggaactgaagaaagaaagtattgaggcagataaggtctatctgctctccaagagatacaacctagtaaaaatagaccgccgttaaggtagaaaataaacagcatagtttcaggaagagatactgctctgtaaaaactaaaacgaaaagtgaaatgataaactgtgactctggattgggagtaaccaatttgtgtttaataataaaaaaaggccttgaagagctgacattttggatcatatctggataaactgaagaagccaaacatgcaaacttttgtggctatagtatggtagacagagggcacaggcagtgcaaaaactcaaagatgatgatgaacttggtatatttgaagaatacaataaagtccatgttaccaagaatatagtaatttaatgtgaaaatgattaaacttaaagttagagatactggtagtgtcaaaaacatatggtctacatagtaaatgtgagttttcattttattacaattacaataagaagccattctgtggctttaagcaaaagagtgattcctctactgaagggtcataaatgacttagggctgtaaactcaagattctatgcagatatcaaagagttgaaaaatatcattaagaggaaaatattatatttgtaagtgcactttgaaagatattaaactaccaatttttcttacatacgtaagcagagagtggcaaaagaaagctggttacttttactgaaaaagatcaaaaaaaattttactttttttttctgcagcttcattattaatcctagcaaatttttatgacttttagctgtatgtttgaccttattgccaattgatttcactgtaagtttaataatgacagtcttttcatagaccaatcaggattttgtgtcagagagaagaaaccattccagctattttaaacaaaacatcatttaatatcaagagaggtgttcacaaaatcactgcaaagtctagaacagcagactataggctggacacccagagatgacttacagactaacacaggtgacctatgttgtcagggaagttgttcttgctacaatcttagccatctgttgtctgaaaaacactacaattttagccatgtgcctgggatcaagttgatgatccggaatcactttggacctaacaaatcgcccctagtataacagaagcctatcctactgcctccctttaactagcttactacatattcaaatctcaaatgagtacattaaatgggcagcatccaaaacatctggaaccccaaatgcaagggggtcaaaaattgagttttaaaatattttatttttgataaaaaccaaagtttatacttaggaatataaattttgtacatggtaaaaatattcagactatagaaaaagtggtctgaatcttcaaataatcctcctctattatcactctgtttattgtgttgcttcctgttttactgagaaaggtaacaggtgagaattccttaatctcccatcactaccactatacaacctgcatctgtgattaagtttcctttaacttctcctgaaactgggtgacctgatcctgctcctacagaagtaaacccttccacctgtgcaccagattccatcccgtcctctctactaaaggcaattactctggtaactctcctttctctcacctataacatgaactttgtcctccctattgggtgtaacctttagcgtgtaaccgcatttattccctcctaaataaaaccttcttgccaccttttcccctgtccatgtcacttcatgagtctttgtgtctccacatgaattttaggatttttaaaaatttctttaaaaaatgatgttgggattttcacagagattgtattgaatctatagattgcttcaggtagtgtggatattttaacaatattaattgttctattccattaacacagaaagtctttccgtttatttccatctgctttaatttctttcatcaatgttttacagtttaagtgtacaagtctttcacctctttgtttaagtttactcctaaatattttattttttggttctaatggaaatgagattaatttcttaatttcccttttagatagttcttttttattgtatagaattgaaatgatttgtttcttttgtagatttttaaatttataaatatttaattgacacataaagatcaaatatattcaaggtatatgaaatgataatttgatatacatatacattgtataatgattaccacaatcaaattaacacattaatcaccatccatgttgtacattagttaccaagaatgtgtttatcttagggctgaaagtttgtaccatttgaccaacatattccccttttctctgacttcaaaaccctctgacaaccactgttctactctctccttcaatgagcttttttttttttttttcagattctacatgtaagtgagatcatatagtgtctgtctttctgtgtctggcttatttcacctaccgtaatgtctattaggtttatctatgttgctgcaaagggcaaaacttccttctttctttggctggatgataatctatcacatatatgtaccacaatttttatactcattcatcaattgatgtacacttgggttgtttccatattttggctatagtgaatgatgctgcagtgaacatagcagtatagttatcttttagagatacttatttcatttcctttgggtatatatctagaagtgagattgctggaacatatggaagttttattttttattttttgaagaacatctatattgttttccataatgcctgtgccaatttacattcccatcaatagtgtgaaagggttcccttttctccacatccttaccaacacttgttatcatgtgtcttctcataatggccattacagtaggtatgaggtgatgtttcattgcggttttaatttcattttcccaatggttgatgatgttgagcaccttttcatatacatgttggctatttctatgtctgttttgggaatatgtctgttaaaatctttgccaattgtaaaaatcaggttgtttgttgttttactgttgacttgcgtacttcctaatatattatgagtattaaccccttatcatacatatggtttactaatattttctcccattcgataggttaccttttaatttggtcaattgtttcttttgtggcgcagtggaatttttagttgatatagtcccacttgtttattttttgttgcctgtgcttttgtggtcatatccaaaaaatgattgccaagactgttgtcaaggtgttttttccttatgttttcttctggtagttttacagtttcaggttttacatttaaatctttaattcatttccagttagttttagtatatgtcataagacaagacttcagtttctttcttttgcatgtggatatttagcttttacaacagcatttattaaatagacttttcttttcccattgtgtattattggcacccttgtcaaatcttagttggccatatatgtgtgaatttatttttgggctccctactgtgttccattgttatgtgtcatgtttttatagtaccatactgttttaattaatatggctttgtagtagagtttgaagcagtgagtgtgatgcttccagctttgttcctttttctcaaaattactttggctatttagagtcttgtacaagtacatacaaatttggttttgttttttccatttctatgatgaatgccatcggaattttaatagggacttgatagaatctgtaggtaatttaattattttagatattttaacaatattaattttttaaaattaatgtacataggtatatttacttttaattctctttttccatttatttcatcaatgtattatagttttcagtgtacagagattaaacctcctggttgaatttattcctaagtattttgttttaattttttatagttataaatgggattgttttcttgacttccttttcagataattcattgttactgttcagagataccactagtttttgtatgttcattttttaatctgcagctttatgaactcacttattctagaaggtttttttgaggacatctttaggattttctcgatataagatcacgtcatctgcaaacagacaattttacttcttcttttgcaatttggttgccttttatttcttacctacttactctagctagtactttcagtaatatattgagtagactcggtgagagtgggcatccttattttctttctgatcttagaaggaaagctttcaatttttcaccattgaatatgatgttagctgtgcgattgtaatatgtggcatttatcactgtggtaggttccttctaagcataatttgttggaagtttttatgatgaaggatgttgaattttgtcaatgccttttctgcatctattgaggtaaccatatggtttttgcctttcattctgccaatgtggtatatcacatttattgatttgcatatgttcaaatatcactgtgcttgctaaccatgaattatccttttaatgtgctgccagatttaatgtgttagtattctggcatttatgttcatcagagacactggattgaacttttcttttagtatccacctgtggcttaggtatcagagtaatgcaggccttctaaaatgagtatgcctattcaatttcaataaattggtattagttctttttcaaatgtttggtaaaatttaaaacagaatccattaggtcctgggcttttctttgctgtgagatttttgaaactattgattcaattttattccttattgatcggttaagattttttatttcctcttaatttaattttgacaaattgtgtccagaaatttatctatttcttcaaggttattcaatttgttgtagtatagttgttaaaacttacacaaattaagttttttctataatttttgacatatttataatatcatgtattcatttctacagcattagaaagaataatttcttcaccctaaattgttcttcaacttaaattattccactcttctttcttctccttgtactcttggtaaccaccagtcttttactgtctctatagttttaatttttctagaatgtcatacaattggagtcatacagtatataacctttcaaaactggcttctttcagctagcattatgcatttaagattcattcatgcttttttatggcttggtagttaatgacctttttattgctgaataacattctattgtaaatatagcacagtttgtttattcatacactcgttgaagaacattgtgattgtctccaatttttggctgttagggaatgaagttgctgtaaacattcatgactgggtttttgtgtacacatgtttcaaatcagttgggtaagtgcctgggagtgtgatcatatggtaaggctatgctcagctttgtaagaaacttccaatttggtcaagatgtctgactagttgcagacagatagaacagctgtcactgtgggactgggatgactggcacagtcctaacaggtcctcaagacacaaaagctgggcagaagctgggtggggctaccgtgcaatgggactcgttcctcacccccaagaactttgggggaatgggtgagttgaactggcaagaagcaacctactcttgccacaagcctctggaatcccaccgggaggagacccctcaaccactacagacacagagttggcaggggaagtgcttagaggagtggtaggagcagcatggtagccgatatggagcccagagggtttgttgcaggaacatctatagcagagcacggccagggatacccatctctccagacttgacttgcctccataggagactttagccctaggggaactgtcagatatgaattctgcagggcagtcttcccatcagatggggcagatccaaccttagtaccccctggtctgctgacctctcccagtgctccagcctggtttttttctgcttgcagtacagactcaggttccctggggacccgcatcttagcttctgcaatggcagaccatatctaattggtggagagctccagcggggtggcccctagggccatgcaccaacctgcctgctccctccctctgctgcagcttcttccaagcccatggccaaccacccctgccccctgacatcatttggctggcttgtatgtgtgcaggtggattttcccttcccttcaccaccagcttgtgtgagcacgtgtacgctgccctgcctctgctgccagcaggagtgcactctgctccccttcctcggccatactaccattgcagtcagagctgtagtgggcacagagcccaccagtcctgcctctgtcagtgacctgcccctgtgccaacactgccaccagaatgaaactaggcactgaaaacaatgaaccctcccctgccctgagtagccacagagggtgcacacacacctgaacccaccagtgtcctgcccccatactaacaccaccatcagtgcaccaatgcacacagtcaccaatgggggcctgctgaccccccaagttatgctgactctacccctgctgtcaatgccttcatggaggcaggcatctcagcacctgctagcagtctgctgcagctgacaagcatgcatcctgatttaatactgctggttctggtgctgctgagggcacctgtgaatgaggacagaccccccccccctactgccaccacactacaaaaccctttgactagcaccattccatcaacgtgtagtgaccagcagtccaggagcaccttagcacccccatcacagtctgttcataatcttgagaagtcagagaacaaagtagggtaggatataagtcccccagaattaaaacatgcagctggggagatgacagctgaaccttggtccccaaaatcttccagaaataaagccagttgactgaacccactttataacacaatcaaactctcaaagtcatctaataagataaaaaaaaaatccaaaggacaagaacttcaaagattgaaaaaacactagcccacaaaaatgagaaaaaaacagtgcaagaactctgacaagtcaaaaagccagcatgctgtctttcctccgaatgcctccaccagctctccaccaaaagtttttaactgaactgggttggctgaagtgacacaaatagaatttggagtatggatagaaatgaagagcaacaaggtacaggagtatgttgaaacccaatccaaggaagctaagaatcacaataaaacaatgcaggagctgacagacaaaatagacagtatagaaaagaacataactgacctgatagaactgaaaaacacactgcaaaaatttcatgatgcaatcacaactattaacagcagaatagaccaagcagaagaaatgatattagtgctttaagactggcattctgaaacaagacaggcagacaagaatagagaaaaaagaatgaaaaggaagaaacaaaacctctgataaatatgtttatgtaaagagaacaaatctatgattcactggtgtccctgaaggagatggggagaatggcagcaacttggaaaacatattccaggatatcattcatgagaacttcctcaacctagctagagaggctaacattcaaattcagaaaatacaaaaacccatttaaggtacttcacaggaagatcacctccaggacacataattatcagattttccaaggttgaaatgaaagaaaaaaatgcaaaaggcagccagagagaaaggtcaggtcacctacaaagggaagcccataagactaagcagacctctcaacaaaaactctacaaaccagaagaggttgggggccaatattcaagattcttaaagaaaagaaattccaaactagaattttacatctagccaaactatgcttcataagtgaaggagaaataagatccttttcagacaagcaaatgctgagggaatttgttactaccagactgacctgccttacaagagctcctgaaggaagcactaaataagaaaaggaaatatcattaccaaccacttcaaaaatacactgaagtacatagaccaatgacactagaaagcagccacacaaacaagtatgtatggtaaccaactaacagcatgatgacaggatcaaatctacacatatcaatactaactttgaatgtaaaaggggtaaatgccccaattaaaaggcacagagtgataagctggataaaaaagcaagacccaatggtatgctgtctcaagagacatgcagtgacacgcataggctcacatgcaatgacacgcataggctcacatgcaatgacacacataggctcacatgcaatgacacccataggctcatatgcaatgacacccatagcctcaaaataaagggatggaggaaaatctactaagtaaatagaaaacataaaaaatacagagattgtaatcctaatttcagacaaaacagactttaaaccaacaaagataaaaaaagacaaaaaagggtaatgacataatggcaaagggttcaattcaacaagtagtgctaactatcctaaatatacgcgcacttaacacaggagcaccctgttcaaacaaattcttagaaacctacaaagagacttagactcacacacaataataatgagagacttcaacaccctactgacagtattagacacatcacttaggcagaaaattagcaaagatattcaggaccttaactcagcactggatcaaatggacctgatagatgtttacagaactctccaccaaaaagcaacagaatatacattcttctcatcaccccatggcacatattctgaaactgtttcatggaggaaactgtttcatggagaggaagccacagggctgacaggaaaccagaccttaacctccctctgcacctgccctgaggctggctcttgtgctcagtgggtcctgagtgtccccaggtggtcctgttccctcttcagggaggcttgtttctgggctcatactgacattttttctaattgtgttccccaaaatggagacagagtaaaccgtgaatccatgcatctcagagaacacagaacagcagaattacacccactgatccccccacacacatttaggtaaatcttattaaaactgctgaaaaggaaagacaaatagaaatatatgcaggcaagtggaggtgagcagagggggcattccttccaaaagaacagaaaagatgatgacagcattcttctggttaaaaccttacaagcaagaggaaagttgatggtatctgtaaagtgttggatgaaaagtcaacccattattttataacgcatgggtgttctctaaaaagtgaaaaaaaattctatttctcttcgacagcatgagggtttcagtgaatccaggccctcatgagaccagtgaaaattattttgaaaaattacagggtttggaaaggctctaacagcataaagcaagtgaagaaatatttattcaagaaaatctagaaaactcggtaaggccagtcatcatgcttgatctaagatgatcttccttccttccacatcccagctcagcatgatgtaaactccactgccgacagatgcagccaagaagacaggacaccttctaccaactcccaccagaggaaactcttccccagggcccagtacgttggccctctgaccctgcacacagcacatgatgctgaggttcagtgctgaacaagagctaccgagagccagagactcacttcttccatggagccccactcatggatggaggctctgccccgggtccagtgccactgggaacactgggtctctggtttctagctctgtcctatggcagaggttccaccccacaataaccgaagtgctgagaaggtgggaagctcctgcccgaccctccactgagagctcagctcctaggctgaggaataaaacagctcaactttgtctacacctgcagaaccttgtttaggagctctgtcccaggagagagggagcaatggaattcagtcataaaatatgatccttaattagtcctaaaaatcctaacttcagtaacaacagaatgtggacaaattgaaagcctgccagtgctctcaaaaacagtggatggtgtggtggaaagcccttggaaggagatgggtggatgcatgggagatgcaggctacactgcagggctgctggcttgcaggagagaaccgagaatgagggagagctggggaaagttctcttgtggttgaaacaaatgccagacactcttcaatggagcccatgtttgtttggttcagtctgtgaagtaattcaaacctcagtgcatgattgaaaatagtacaattttccatctgcaagtggcagccctggatgactggatggtctataattgggacacgtatctagactcaacgatgcctggatggaaaatgtgcaggctgctccactgatgtcagctgtttcatcacagttttatgatttaataaaagtcatattttttttcatttttgcacatcaaatttttttctgtgatccatattcctaagcccatctttgagctcacagccctttcccaagaaatcaacatctagacctccctcttctcggggctccgaggtgattcctgagtggcatcctctccacctccctgctgggaacagagccagttgcagggctcacgggcagccttagaatgtctgctcctccggggtgtccccctgcttctcactggagaagaggcctctggggtggtcacagcctctttctccacatgaaccctgagagttcttcctgagctacacagctgggggaagactgccctaagagacgtgaaaagagagacatgggaagtgaggtgtctcagctcttgtctcccctgggtggtgtggcctgacctcaccagagccccagcctaacccacctgacctgtccccaggagctgtactgagcgatggctgcacctgctcagttacctgtggggcccagtgcctctgagagaggtgcccagtgagggctctgcagggctccccccgagcaggagctgggctgagggaaatcagcaggaggtaggggctgcccaggccctggggaggcaggcagcgtggagaggacacagaggtgcactgggagggcgcaagccagtcaggaccaccctctcagctctgagaaatgagctatgctcacggaatgctcacagtcaaatcctgctgggagggccatcctctgctcgggttctctactgtccagggcaggaatgactcatgtggccattcagaggcgaggccccaccaggaagcatccactgactgcccaaggctgtgcatccccatagcgctgagctcatgtccctgacctgtggcctctgggcccacactctgctcaaagttccctcagggggatgaagggagaggcgggccctagggcaagggtgcccaggaggagagaaggaaaaggcaagcatgtcttcatcagtggggttttctcctgagagcagaattcatttccacaccttccaagttccctcttgtggctggcacttctctgacctggagccccagatggcggggcactcagaagagggagggtcattcctgggagcagataaggcctcctccttctccagctcctgaatcagaaactgaggcctcccctggaccttccctgcttatgactggggcctcccacgtgcaaagcacaccttcatcttgcactgaagtctcaggacctggagagcacctccacacggggggctggatcctcctggaactgtaagccttgcccagaaagccctgaaggggagcagggaggcggcagcagcacagccttcttcagcttccaggggaagggatgagggaggcgggtggacgagcttccaaccggcatggcatgggatgctgaaaaacgcgatgggctctggcctattggagccatctctccttgtcctgtacctgccccttgggggtttagggcagaggaaatgttggcttgttgtgtgagtcagataaacaggtggggagaatgggcccgtatgccctggtttgcacaggaaaggtgtgctcaccagcaagtgtttcttctagaaattaagtaatcctgggacaggcttttcctccccagttccacaagactccaagatgtcagagtatcataaacacggagaataaggacacaggattaacccaacccaacctctgatggtttcatgtcatgtgaaggaatttttggagtgttgatgctgaagagtttacagagtgtggctacatcagttgccctaaaggatatagaaaacattttactgtgagagtagagaggaggaacacaagtagaagtatcaagagtcgctgccagccagcccataaataggtttcccatttgtatgacagccaagaaacctggtctgagacagctggggtcgcaaacaatgtcttggtgcagttataaatttctttatgcatgtatttttctaacaataatattttggtgtctttcttgggtcaaggtggcaggtcctctagtcacattgttggagtgcatggatggatgggttagtaaattatttctcaagattagtggtaatcaaaaggtggaagtgttggtggtggtcgtagttcagagatgcgggttgggagtgggaaaagttactggggagtgggtggttctctcctcatggtgtcaaagggttgatggatatgaggcaggttcctttgtgtgcagcaatgacctctgctgattttcagactgacagagatggtagtaaccactatcagatttctctgtatgaacagaaatgtagtgtagcatgttgtggcaaacagcaaggagtgcactgggatcctggaccaaatggacagcaagctcagggagcacaataggatccctagtatccaagggacaaaagcaaggcatgtccaatgccttattgtttcattgagagacttcccaggccatgactggtgttaaggtttagggcacaactgtctccagctcgccggggaaaagccaaagccacctccagctttgagccctgggccaggccgatgtgctctaggatggggtactagggtgtcctttccaggtgggcatgtgctcaagcggactgactggctatcagcacttgccgtgtttggttgaagtgatggcctatttggaggtttctgccctttggattataacaaataagtccacaatacaagcagccacatggacaatggtgagaccagcagtcaacagaggggtgcttggctgcagttggcaggtgttgatgttgttttcatttgttttttgagtttgtttttgtggaactttacgttcaaatgggctcatatcagatgagcagccgactgacccacgggaccctctatggctaatcatccgaggagagtttttaccctcaataggttctccagcccttatgagataagagcaacatcaaacatttgtaaagatatggaaataatattttaaatagcctcaataatgcaatgaatataagcctataagtatctcaaagggtgatggagaagtcctgaaagctgggatgagggcgactcagctaagagccttgaatttagggagagttagttctacagaagttggagatccattgggtgtccatttactggagtggaatttgaaggaattgtttgaggagatcagtatgtctctgagttaaaccagcccataattaagttctattgaatggggcctaagaggcatgaagttctatcaagtggctttttctgtatccagcattgtgtgttttgaaaagtaaaatgtgtgacttggttactgtcagcaaagtatgcaattttgaaggacattagtgtcccaccaaagcctcgtattgtgaacttattatgtgcagagatatgagccacttgatttatattttcagtgtctgggaggcaagagactttcagatttccttaccctgaagacagctcttaaacaacgtctgagctgtttataataaatgtggaaatggagccattggttcgatagggcacccaatgctggtgtgactgcctgatgtctgcctaattttggggatccccagccccatcctttgttgggacatatggccaagagagggagagcagaagcatgccccaagccccatcacttgtcatccttgcagcccgcaaatgccagtcactgtccactcagtgagtcccagcgttcttcccatgtggccgagaggtggcctcctccagcacttgggcacctgccaggtgactgtggatataggaagccagtcctgctgcaagcagaaatgacagagggcctgggtgttgctttatcctgtcttaagaaggcctctggagccatgctaagtgtgtggggtgctgttcccgtgaccccaaacacaatagttagctggatgtgtccaaatagtccaggttgtagacagcaatgttcagttgaatgatttatagtccaaggccaaagggagcagttacttgccttggaaactgtcgagcatcttaaggccacattgatcgcccagagacaccaggaggcatgagaagggtttgccaagtttctttagtgaaggagtttctgaggatactaacagaagagcctgttgattttaaattaggcacactgttgagccttttgttgaaggaaatttcatttaggggaggtgatttataagtagcaacaacagcgaggctagttgaaatttatgggtgaggaatatgttgcaccagaacccacaaggaacagcaggatgtggcatttgtatgtccttaatgaaagtatggggagcatctcctcagaggaggtgtcagcagtgctgcggaggaaggcagatgcagtgaggagccagcctgcgaagctctcatgtggtggccacgccgctgaggtgcccgcgtatcctgagaagggtgtccttcccaggcaaagacaatctgcagctaaggggctgctgagatgggcgctgagtacaaccaattagacacatctggaagagcaaagtctgcactggctgttggttaaagccagtcgttttgagaacattgggagtatggggccctaatgggtggggccacggcatgaaagttgtgacaatccaacatagggcaaccttcatgctattgtcttttcttcttcaccggtttaagaacaggcaagatttggctgtgaaatagagaagcaatgggaaaaatcacctctttattgattagatttgtataatagtttttaatcttcgaaggtccattttcacttctgttggaatatattaactacataaactggaactctttgagttccattttatcaagccaatgcacaagtgccaaacacctcattccattttaatttaattcattgtgtcagagtgtatgcccaatatgagatattttaggacaaaggacattatgatcatgtgaaatctaggcaaggcaaccgctaaagtgcggtgtgtctatttcttcttccaaatatattgatttctatttaattatcttaagttcacatgggatacatgtttaaatcttgaaatctaatgaatttcctaggtatagctattattggagccctggtattgatcacaaagtttgccaattggtgcaatcccaaaaatgctaaagtgaaattacaatggaccagtatacagttccaaggtcagagtctggaaggcgtttcacagaactaaagacttgagcaccagccatgctgcttccttctagagttatctgggagaatctatctcttgcctttgccagctcctaggggcgcctgcgttccccggctggtggctgtgtgactgacctccgcttccatcccacacctccccagtcttggactctgctgctcctctttctcctcatcaggaccccagggcatatggcatgcacaggccagggtgactgtaacatccaagggcctctatcacgtcagcccagtccctttggccctgcaggtgatgtctttgtagagccccaggactatggcatgggcatctttggggggcattcttctgcctgctgcaggatctagattcccctctctagaacctgtagtgtagaggggcacgaagccaaccagcttcattttcaatttttgtcttagaagttatttcagtacagaattttgtatataaactttggatttctaattggtcaaatgatggacatttatttaaatttagttatatatatacattatatataccaaagtgatatataattatataaataattataatactgttataattatataaataattataatactgttataattatataaataattataatactgtcataattatattagaaatatactattataattttataataattacatttatataaaatatctatatgtagtttcatgattatttagttccttttcatttttggaacctatgctaatatttcccctctattgctcctctttccctaaggtctcgagttcctctgagcctgatgatgagccaggacaggaaggggcctgggcctccaggcagcagcatctctccaggatgcccccagccacagcataaggaattcctacacttttgttatcttaaacaaaaccttctagaattccttctaactctaggagactgaaatgtatttttctttctttcaactgtctcctgtctgtccctgactccctcactccgttttttaatgtttggccatttatctcatgagcttactaaaaataaattgtatactcagcaatggataacatagaagaaatggataaattcctagatatgtacaatcttccaagattgaatcttgaaaaagtagaaacagaactattactagtaaaagactgaatcagtaatcgaaagcgagcttggaaccacttccaaaagtttttttgtttgtttgtttgtttgttttttgagatggagtctcgctctgttgcccaggctggagtgcatggcatgatctctgctcactgcaagctccacctctcaggttcacgccattctcctgcctcagcctcctgagtagctgggatgacaggtgcccaccaccatgcccggctaattttttgtatttttagtagagatggggtttcaccttgttagccaggatggtctcgatctccagaccttgtgatccacccatctcgacctcccaaaagttttaagatgaagaaatacttctaaacttattttataaagtcagcattgccctgaaatcaaaaccaggcaaacaccaaattaacataaattacagaccactcttactgaaacacaaagatgcaaaaagtactcaacaaaatattggcaaatcaaactgaacagcacattacaaggatcatttgccatgatccagtggaatgtctctctggaatattgggatggtgcaacatctaaacatcactgaatctgatggaccacattaacataatgaaagactaaaatattatctcatcagatgcataaaaatcatttgacaaatttcaacatctttccatgataaaacctcttaacaaactacaaataaagggaaattatctggacatattgaaagccatatttaaaagcccacagttagcatcatagccaatgctgaaacactgaacaagcttccacttagatgatggagaagacaaggatgccctatctcaccaattctgttctacatagtattgtaagtcctagtcagagaacttaggcaagaaaaagttactaaatcagaaagagaggagtaaaggtgtcactgtttacagatgacatgtcttgtatgtagaaaatcctaaaaattgccccccaaaatcaaaacaaaaccaaaacaaaacagctgtaagttgctaatttgtgtgtataaaattggtgttctgcaagatgaataagttctggagactggatgcacagaatcctgagtctagataacttgactgcacagtacacttaaaaatttgctgagagagtgtatctcatggtaggtattcttatcacaatacaaactttaaaagttgtatatgaggacattggtactgctttcatattatttattatgaatgaatttccaaaaaaagtgttatcagtaatgagttgaggtaatgagtaattcatatacaggaatagcctcaagagaacaagaggaagagatgcatttagagtagaaatcctcacactttagatgcattttaaatgtctggataatggagtacttaaaaagggatgtgtctgtctcttcccccaactattgagaattagttcctgagtaaatcaaagaacattattttatccagccccggtaggtcctgaggtccttgtctctggcatcacagaatgggttagagtgcagggctggcgtagagctcctgagacagtaatgtgatgttgtccaaagctccatgggtgaggagagccacaccacaggtgggacccaaggaaagagcccaggagctgtgctgggctcagcactgaggaagcaagacctgggcctgtggatagggggagctgcgctagaaacaaggaagggcaggagggaagaggggttggaaggaaagtagccctgggatcagaatggcagggctgtcctttgcctattcccatttgtctcgcagaccaagtgtcctccaaccaccaaatgtcaagtgacatgcgtgccacatgagtttaggaggaaaggcactctacacaacgctcaactaccaggaggtaggggccatatcttaacttttctacttataaaaagagtcagctaggctgggcacggtggctcatgcctataatcccagcactttgggaggccgaggcagacagatcacatgaggtcaggagtttgagaccagcctggctaagtgacaaaaccctgtctctactaaaattacaaaaattagtcaggcatgctgctgggcacctgtaatcccagctactagggaggctgaggcaggagaa[137 bp omitted]tagctctggggtaaaatccacccctgggctgtggaagcatccagtcacttctcagactgggacggtgtctctggggaagacaaaggtgggttcagaagaagatgagattgctgggccttctcctgtgcctgctgacacctcccgaaggtgagcatctcagaggccagacacgggctgtggcaataactgtgatgtcccatgactgacagggactgactgttcttgttcccagctgtcctgtcccaggtgcagcagcaggagtgaggctcaagactggagaagccgtggctgcccccttcctcacctggcacgactccggattctccatcacagccagtggttactgcggaggcccggtccaccggcccctagacaaggggttgcactggctgaggagcatcgattataagagaaacacgaacaaccgccgcctctcaagagcctcatctccatccagagactcatccaacaagcagcgctccctgcggcggagctccaggaacccacaggacagccaggtattcctgtgggagacacagtgaggggatgccgtgtgaacccagacaggaccctccctcctgggggcctgagatgtgcaggatgcactcgacacttgggtccactgaagagcaggctcagatgggaagtggcgaggacttctccttagaatctgaggctttcttttctctaattctcagatgtcctcagggacatttcattctcttctctgtggctctgatttccccctttctcactgcaggcaaaaaaggatgaaataactttctccactggcagataggctgtttcaatttcatagaaaccttcccttcatccggctcccacgtggtctgctttttccttcatctgcttccatgtggtctgctttccttcctgaaaaacaggtcatgttcaggattcacacttgctcgagaaattcttccctcaaactccagttcagaccaggcacaccctctcccacatctgtccccacgtggacccttccatgagatgaccccacctgtccccaggtggacccttccctcagacgagcacacctgtccccaggtggacccttccctcaaacaagcacacctgtccccacgtggacccttctctgagaggagcacacctgtccccacgtggatccttccttcagatgagcacatctgtccccacgtgcacccttccctgagacaaggacacctgtccccacgtggatccttccttcagatgagcccccctgtccccacgtggacccttccctcaaatgagtacacctgtccccacgtagacccttctctgagagaagcacacatgtccccaagtggacccttccctgagtcaagcacacttgtccccaggtggaaccttcctccacacgagcacacctgtccccacgtggacccttccctgagacaagcacacctgtccccacgtggacatttccctcagaggggcacacctgtccccacgtggacccttccctgagacaagaacacctgtccccacatggacccttcccttggaggagcacacctgtccccacgtggacccttccttcagacaagcacacctgtctccatgtggactctttgctcagaggagcacaggtgtacccatgtggacccttccctgagacaaacacacctgtccccacgtggccccttccctgagatgagctcatctgtcctcttccccaaggcgagcacacctgtccccacgtggacctttccctgagacaagcacacctgtccccacatggacccttccctcagaggagcataactgtccccatgtggacccttccttcagataaactcacctgtcaccacgtggacccttccctcagaggagcacaccagtccccatgtggacccatccttcagacaagctcacctgtccccatgaacccttccctgagacaagcacacctgtccctacatggacccttctctcggatgagcacacctgtccccatgtgggcccttccctgagactaccacacctgtccccacgtggacccttccttgagacaagcacacctgtccccacttcgatgcttctctcagataagcacaactcgccccacctggacccctccctgagacgaactcacctgtcgctacgtggattcttgccttagacaagcacctctgtccccacgtggacccttccctgagggaatcacacctgtccccaggtggacccttacctcagacaagcatgcctgtccccaggtcaatccttccctcaaaagagcacacctgtccacgtgaggacccttccttgagacaagcactcctgtccccacatggacccttccctcagacgagctcacctgtccccatgtggacccttccctgagacaagcacagctgtctccatgtggaatcttccttcagacaagcacacctgtccccacatggacccttccctcagacgagctcacctgtccccatgtggacccttccctgagacaagcacagctgtctccatgtggaatcttccttcagacaagcacacctgtccccacatggacccttccctcagatgagctcacctgtccccatgtggacccttccctgagacaagcacgcctgtccccatgtagacccttccttcagaggagctcacctgtgctcagacaccaccagggtcctcagacactaatagggtggctcagacactaatagggtggctcagactctaagaggggggctcagaaaccaccagaagggctcagacaccaccagagggcgcccagcaaccacggaatgctcagaacctaccgggggcgctcaggacctacaggggtcgctcaagacctggctcaggagcagatgcaaagtgaagctgaggtttccgttttctctttggggattccttgtcctgccctgcaaaagccttgctcagcagctattattgtttcttccctggaattccccagttcctctcatctgaaaaggacttagagcagaaatcccatttaacttttcacacttcattttcagtctccttctagtgatatttcagtaaaatattaataagaaataatgaagccacagtccaaatgttagcaccatgcaaagattcgtgtgtcttctccactctgtcagttacgccttaggaaactcttctctcaatccactgctcagtgtacactatggcattgtgttttcttctttgctttcatctgctttgcagggaaatgaagcaccatttattgggacgtgtcctccatttctgatgggctccccgtggtctccacctcagatggttttgccaccatctttaatccgttaatgccttcaatcgccctcaccatccatgtaatgaagcaatgaatgcctttacttcatctacttgtgtctccatcagtcagttcacttctctccattctcacaaaggacagccacccactacttcagagcctcctgcagccttgggtggtaaacctattaaaaagcccctgctgtttagaaagggtgtgtattggaaacttaatcccaaattccatagtgtccagaggtgagaatgttaagaaatgattaggccgagagggctctgccctcatgaagcaattaatgccattatcatcagagtaggttacttattgtggtagcagattagttactacaggcctgggttcctcattaaaaaatgagtttagccccctttccatcctttgcacatgctctcctgccttccacatgggcatcacagcaagaaggctcttgccagatgctagcaccttgacattgacttcccagcctctagagctgggagaaaataaatttcttttccttacacattagccagtgtgtggtattcactcattgcaccacaaagtggactaagacaaaaaatcagtatcaagaggtggggctgttgtgataacaaatatcccaaaatgtagaagtggaagtagtaatgcacagagactggaataatttggaggatcaggttataaaaagtctagattgccatgactagaacactaggggtattcttttgaggactcagaagaagacagctgtgaggaaattctgaaacttcttagagattatttaggtgatgatcattagaatgttggtagaaccgtggacaataaaggccgttctgatgaggtctcaggagaaaaagaagaatagctcatcggaaaatggagcaaaggccatccttcccttaaagtggcaaggaatgtggctgaattgtgctcatccctaggtctttctgtaaagtggaagttcagagccatgagtgaggatatatggtgggagaaatttgaagcaaatctatggcctcacttctagcaggcactttaggactctgttccctgtgtccaggcacagcactccttggctgcccatgatgtggctcaggaggacctaggtgtggctcaagccatcactttaatggtacaagtcatcaacttccatggcatccatgtattgctaattctgcaggtgtgcagaataccacgagggcatggctttctccacctagatttcaaagaatgctgtggacagcctaaggtctcgggcagtgagttgttgcagagacagagtcaccacactggacccttagcacaatgccaagcagaaatatgggtttggaggcaccacaaagagtttccagtcagcctaggagagctagaggcctgagagtcccacctgtgagaggggctgagtggactgaacccagaaaatccatagaggcaagactgctggaggccttgggggcccttccccctccccagtgtgcacaagatgccgtcaaagaggatgattttccagctataagactttttttttattatactttaagttttagggtgcatgtgcacaatgtgcaggttagttacatatgtatacatgtgccatgctggtgtgtgcacccattaactcgtcatttagcattaggtatatctcctaaagctatccctcccccctcaccccaccccacaacagtcccccgagtgtgatgttccctttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcgttgttggacatttggattggttccaagtctttgctattgtgaatagtgctgcgataaacatatgtgtgcatgtgtctttatagcagcatgatttatagtcctttgggtatatacccagtaatgggatggctgggtcaaatggtatttctagttctagatccctgaggaatcaccacaaggacttctacaatggttgaactagttcaaaacccaacaagggaaaaaaacattaagtctcagctataagacttaatgtttttttcctctgttgggttttgaactaggcactgctttctccttccctgtctctgagctttggaatgggaatttctatcccatacctgccccattgttcactgtatttgaaagtagataacttgttttgactttataggctcacagatggaaaaaatttatatcaggctaaattgtgccttgagtcacactcacatctgatttagatgagactttagacttcagacttttgcactgatgctggataagactttggagacaattgggatggaatgaatgtagtttgcattgtgataaggacataaattttgatattaggaatggaatgctatgacttaaatgtgtctcccaaagtttaggatttggaaaaaatctttaatgcaacagtgttgagaggtgggacctttattatgtgattaggtcatgaaggctctgtcctcatgaatggattaatgtcactgtcattggagtgggttagttattacaggagtgaatttctaataaaagatagtctcctttctctcgtggacaaatgatctcttgctcacccacctctgctgtgagacgacacagtgagaaggcccttgtgagatgtcagtgccttgatattagacttctctgactcaagcaccataaagtataaattccttttctttagaaattgcccagtctctggtattcggttatagtaacacaaagacagactgagactaagccattgtaacatgtgtgaggtgatatctcatcgtggttttaatttgcatttccctgatgattagtgatgttgagcatttgactctttatgttaagtgaaataagccaggtataaaaaattactccataatctcacttacacatgcaatctaaaaatgttgaactcagagaagtagagagaagaatggtgccaaccaggggctggtgtcaggggcatgtgaaagctgaggcattggtgaaagggtacagagttttggtttgacagaaggaattagtttgaagatctattgcacagcagggtgacttccatggtactaatgtactatatacttgaaaactgataatagagtagattttacacgtttacaccataaaaaataagtatgtgaggtgatgggcatgtttatttacttgatttaataatttcacaatgcctgcatatgtcaaaacatcacgtcataccaccataatatatgaaatagaatatgtttttctagtaagtgtgatgcctctgtttctcttttttttttggaacaaaacaataaacacctttattacatgggtgaagacaaaacaaggatttatttgcccttccgggccttgattttcctaagatagaactccaactctttgccctctagcacatacccatctgctcagccacactgtcctggccttgaagcaatgcatgcaagaagcttgccctgctggaactgctcccccaggagactgctgattttggcattctttttcctttcatgatatttcttctgaatttttttagatcgctttttgttcaaaatctcttcttcctcaggagtcagcttggctcccttcttgcagcccaggggcggcgcatagtgggactcgtaccactgtcggtacagtgtgctgtcaatgagcacaatgcaattcttcaccagggtcttgggacgaaccagctcgttattagatgcattgtagacaacatcgatgatcgttgttttatgagcacaacattctgagccccaggagaaattcctcacgtccagcctcagggcacagtatttcttgttacctccccacacacggactgtgtggatgcggcgggggccagtcttggtgttggcagctgggtgccccaactcatacttccgcttcttgtggtagggctttctcttgtccctggttttgtggcacttgtgccagttgtcccaagagatgtccatcgctcggcactggctggaaagagggcctctgtttctttaacaacagtttctggagattgtttttcccttgaacaatgtttcctctctgctgtctttacacagttttcctttcccaagggttgatttaagacagtgacaatttatctattctgtatctggtagtttcatggagaaatttaatgaatagccacttgaaaccatgtggtgctactgagacaccatctgaaggagacagattttctgagtgtaggccacaaccatatgttaacacattttaaattcaaaatcagggtttaaattttgatattttacaatggcttctttgattccttcccaagatctaaccattgagcgtgtgaaaagggctgggactcagtttactgctgtgcttggcatgatgatgtcctgcagaaattcctttggctttctacatgtagctcagcctccatatcagccagctcgcttggaggtcagagtacttctcaaagatcctcagtgtgttgtttcattttgagaggtttccagcccttgtgagacaccccttggttttacaatcatcgcaaagttgtttacgattccaaaaacatacctgccatctgtccatatgtttgttctgcagcttttgatttcctaaaatgctgtagtaactgcaataagttctaccatctggattaattttcacctcagatggaagagtatattttaagataaagataaagtagtaacagtatattctcctcggtaatatccatttctatattttgagctatggtccatcaataaataatgttctgtcaggctcctcaatggagtgcctgaacatctaaggaaggtacagaaggtacaaaacagaagttaaggtacaaaccatggtgaacacaagcttgctatgctcccatgtctcctgtctgtcttactgtgcacctgacactcattttaacctcaccaggaagtcagttaactctcaatcagtttattgtaatgcctctaggtaattatatgtggcagtttcagcagaaatgaagaaacaacttcactagagaatctaatacagaagaatgcaagtggccctgggcttgttttcataaaagcagcatgcaccaggcagttgattctcttggctgtcggcactgaacactcagcatgctggcttcgtcccctaaataagcttcatcatgcatggataggctggcagcaatcccgaggccatatgcagatacacagccaactgggaaatgggacacaattcttctccactcctcctctgaagaatggtctgacaatgccctcttcagttccttccctctgccaccctgaccaggactatgccatatgtgcacagagacacaaaattcctgatgggaagaatgaggctggatcaaccagactagcggtttctcactgaggtaatgtgaggtcaacttctagggtggacaattcaggaaattatccagcagttttgtaattgatggctatgggaaaatgaaccactgagatgagtaattacttatattccattattccatgtgagaaacagacatcacagttcaccataactaaattttcataacctaaattgattactttaaatttcttcctacatcttcacttaagaatttttaaccatgaatgtgtcttacctatattcccaatatttaaaattgggctgtcaagagagtctagagaattcgagaactaagaacagtgaaactcctgtatgttcagcagctcccaaagcaacacaatattccccaggaacactgttctgtgcttcagcacaaatcatgcttgtgtatttcctaatggctccaatagtgaccctccattcccatcaaacatttggcctcccctttctccactcccctccattcatacattatactctcagctctgtctagggtatcataaaagccagcagacggaccctcctgatctcctgaacgtgaaacctaacactatcatgcgatcggctcctcttggcatagtgaccttcaaaggcatctcatttgaataattacctttttttcccttctgtaacaaagtgtttctttccattgtgccttcccataagcattttaacataatttactgtccgactacagttattaatacacacaaatgccacaacctctttctagcccaggagacctgattaattcttctctggggatgagcacaccctagaaacacatcccattcacataaacacgggcacaacgatgacatgttcttgagtctacaccattctccgtccaactccacgagcccctgaagaccaagacaggctctttcctgcctgtgcaagctctggcccagggacagcctgctgaggaatgggctcagctgggtctgggtgctgggttcatctcttcccctctcctgtcccaaagcaggtccatcaccctgctcaggtctgaacaggagtgtccaggtttgtctggccatccgactttttcaatgtatagaagctctcctattacctactgtattcattttatagggcttttatgacaaaataccacagatcggatggcttacaatacaaaaccaatttcctcacacttatggaggatgaaagcctaagatcaagctgccagctgggtgggtttcctctgaggtctcgctccctggcgtgcagatggcgccttctcgctgttctgtggtaacatggccgtccctcggggcgtgtgcaccccccctcctgcttccccttcttataacaacagtcagattgcattagggccccactccaggaatctcactttaacttatttagctctttaaaagacactaatccaagtatgatttcattctgaaggaccaagggttgggacttcagcacatgaatttaggagggacacagtctcccctagcagcctcctccagggatgtcaaataaaaggaataaaaggacactgatgctccagagggccttgaaagcttgcagctgctttgttgtggtgggacatgggtaagcccgcaccttatctatgatggcagatggaatgactttagttttaccaaaccagatgacaccaactatttgactgataagcctggaccctggattttgtctgtattaacctcccatcctctgttcagcaagtgagacagcaagacaggggctgcaatttataagctgaaaaaagactcagaagttaccatgataacaccaatgtagtggaaaacatgtatcccctttgggtcagcccatcaactgaggttggaggtcactaggctgtgagagttgggctgtgtaaatatccctggaacaagacagtaaaagtccattgttctttttaggttaatgcaaattgatcttgaatgtggggcagcagaaatgctgaagaaggtattgactaaactgataacgaaatgctatgtggctaacacctctcctattctcgtcagactggaggagatattaggaacagctgcattcactcgggagaccaccttatttaactcccagtaatctactgtcattctccatgtcccaactggcctctgcatgggccatgcaggtctgttgtaggaactgtgcagtggcctcctaatgcctacctgggctaactccttaacaatcttcatgattggatcatcttcccctccccagggcgggtggtgttgctccagctgtgggactccccatgggttggcagctctaccggcatccagtttgccttctgcttggtcacatgcgtcaccactttaactctcagttggaattccctggcagttgtttggagggtcacgcctaagaagatatccattctcatgtgttctaagatggaagctatgtatactaaacagggtctgggtggcagtcccccaggtcgtatcactagttcaacctgtctgacttctgtggcccttccataatcacctattgctgctatgggcccagataactggtaggtgttgccagttagagcacatttgttgtctggccacgctgactggctccttggctgtctctcttcctttggtgccattgtttttcatcacagtagggtgcatcccttgcttactcagtttcttcttttctcctaagtcagcaactacctggggcacatgaaatgttggctgccctcccagggggcttaacatggaaatcagtgcaccatgccatttggtaggcactgaatacataattgtagcttttattttgcagtaaacaattcattgttgggacttcaataattctcagcataattagcatgcctcatttcaactcccagaagatgtcctgcaactcttctatagtctgccattgagaaggagctgtgtgggcatcttcctcattggacctggccccgctggagcctgcaaccacttaccataaaggtgccatcatagggctggatggtttgtgatgggtgccattttactcatcttgagtccagaaagtataacactctccaccccctgtcccatagagaagccaccctgtgatccactctctccccttgtgtctgaatccaagtctaagctcccccaattccacagtggtggcatcccacatcgtggttcactgccttctcttaggtgggggaaagttctgtggggctaacttctgctggcacagttggcccacttttatgttggtggtgaccaccacaagtaccatttggctacagactgtgtcctggtattccaaggcttttgtgtctggaaggcatcctttagccagcctgctaaaggttgttctggatgtggagtggccctctgtcacatcctccacttgtaaggcatgacatgtagtgcggttgttactcctaaacagtatatctcacttcagcttccttctgtctttgagaccagggtcttagggacacacacttatgtccttgcctttaacacagtccccacctaaacccctcagggtaactgactacatccaattcacagggctgtccctgcactagaactcccaaggtttgtattcatttcactgtgactttagcttcttcagagccctcatcctcccttttggaacagtcgcagtggggcaccttcttgactaagtgccatgggggcctaaggagtttgccgaaatggggaataaaggatcgccaatgtcccaggaggccttggaaggtttccaactgctttggtgtgttgggacatgagtagacctgcatcttatcttatctataatgaaatatggaataactatagtcttatgtaaccagatgacaccaagtatttgactgataagcctagaccctggactttgtctgcattgacccccccatcctctgttcaccaagtgagacagcaaagcaggggctgcagggcaagaacctttatggagtcatcctaaccttcatctccttcccactggagctctacatcggacaccaggacttaggcttccaggacgatgtagtcataatagtcctaacgcattggtgtggcagtcggcaacactttaaatggcctaccaaataaacaatggtctccaatttgctatcctatccctgcaggcggcatctcattatagttacagctgttcttgtggctgacacaccctagcctgtgcagtgagctctgcctcagtggttgctcagagtgcagtcaggagtggccaacagctgcgacagctcaggcatctgactgtcactttgtcacattgtcacatccacctcaggcaacaggtcctccagaacttttggcattttggaggcatccctgtacacttgcagcaggccctatccatcaaggattgcagctgttgggcccacagagatgtgcatggcctgcctgggatttccccacaggtctccccttccttgacaccgttgtctaagaacttgtgggattttctttgaccttgttctgggcctcccaattgtcatgctagacccctattgactgtaataggcgtggcaccatgtccaaaaggctaaagaggagacctggagcccatgaacaagatctagggtgtattgaggacttccatacaatgtggcccaggaagagtgtgttggacaggaaaaccactaccatttgtaaaacatgtgtagtttatattatgattttcacttagcaccctctacctagcaacctccagatttaacaaagagcctcaatcacctggacatcctgtgttccaagggataggccagggcttcagacgtccttcacagacaaggaataaacttctgggtggacagctcctggatttcttagctcagagctctgaacatacattcttcttaaactatagggtcattctcacagtgtgcttaaattaatgctgccaggcatttctggcatacatagatctgaacacgcacctcgtaaaacaatgtataaaaaagtgttcatcaagactttgtattaggaatatgtatatttaaacaaccattaaatactgctactcatttactataatattacaatggctgcacagcaaagcattggtgaatactgacaaggctccagaaaagaaagtcttattcactgttggtaggaacataaaatggcacttcctttttggaaaatattttcatgatttctttggagttaaacatgttaattgaacagatgactctaaggtactttattcaactgatttttttgttttgttttgttttgttttgttttgagatggagtttcgctctgtcacccaggctggagtgcagtggcgcgatctcggctcactgcaaccttcgcctccctggttcaagcaattctctgcctcagcctcccaagtagctgtgattacaggcatccaccaccacgcccagctaattctttgtatttttagtagagaaggggtttcgccatcttggccaggctgatcttgaactccttaccttgtgatccacctgcctcggtctcccaaagtgctgggattataggcatgagccaccgtgcctcacctattcaactgattttaatacttacttctacacagatactttcatgggaatgccggtatcagctttcttcagtagagcttttcctcctccatgaattttgcttatagggtgataattatataaacaattcccatataattgggccaggcgcagtggctcacacctgtaatcccaggactttgggaggctg[134 bp omitted]aaggcaggagaattgcttgaacctgggaggtggaggttgcagtgagctgagactttgccgtgtcactccagcctgggtggcagagtgagactctgtcacaaacaaacaaaccaaaaaaaaaaaaaaaaacaccaaaaaactgaaaaaacaaacttcccatataattagagtatatacttctattgttacttttttcaatttattaatgacatactgtaaacaacattaaaaataataatccctttcatttctcagccccagcacagctgcctcctccctggggtttctgacactctcaggatgtgggttttcacactgtgtctctcgcacagtaatacgtggccgtgtcctcagatctcaggctgctcagctccgtgtaggctgtgctgatggacgtgtccctggtcatggtgactctgccctgaaacttctgtgcatagtttgtgccaccactgttagggttgatccgtcccatccacccaagctcttgtccaggggcctgtcgcacccagtgcatatagtagtcggtgaagatgtatccagaagccttgcaggagaccttcactgaggccccaggcttcttcacctcagccccagactgcaccagctgcacctgggagtgggcacctgtggagaggacacaggagtggatgagatctccctggactggactcaatctctttctcatcactgggactagggagcctcctacctgtagctgctgccaccaagaagaggatcctccaggtccagtccatggtgaggagctgagctctcaggggattctctagaggacggatgtggttgttgggtgatgctctcagggcaaggacagatctgtatttacttcagtaaatctcaggttatttgcatattcatgaggggtactatttcatagcttcatagctctagacttgatccaagatgagaaagagaacacacattatttatgggccatgcaacagtgggacgctgaagccctgtcctaatccttgtttaatgatgtgtgtccccttgtatgcccagaactctgctaaaataaattgtctctgctgaaaacaagttcccacaaaacatggtcctccaagtgaacccatacttaaatggcactttgacaccttcatacttttctgggctttgctttctgcctgtcttactactgtctctgctaagattggcaagcactgaattaataaaactatcccttttctccatctcctaactattaagatatctgaaaatcctagaaatttctccttttaaatgtgattctcattgacttgttaggttagataaatcctacaaatagtctttactaaattcttgtttaacttattaaagcatgtttgttcaagaaaaggaagacatcaacccctgggaggaacccctccccagcctcctgtgcacctgctcttgggctgcaagtctgtgctgcggggaggcccgagcgctccctgccacccacaccttgcactgcagggagcttcctgttgggtctcacagagcatttttctctcagcctctgtagctcactaggaagtgactgtgccctggctcagaatgctccttcagtgacaacatgagcggatgacaccacctcttgaaatagtgaatgggcctttggaaacccaatgtcctcttcagggaggctccaagagaagaatcactaaaatcaccagggagtccctttcctggaggtctagatgcactggatcactggaaacaaagggaggctaaaactctggggggggttggaggtggctcttttctcaatttggctcttgcagacaaatactgcatctgagaatacctgaagctgcagatggatgtggattaaagctcactccacgtccactgtttcaataactcctactcaaacatacagaagcacaaacacaaacatactcacacacactgtggctgattttcacagttatgggcccctaatgtttccttcttcatagtatcttactcatgggaagtgctgccgaccctgaccctaggcctcagcatgtgactttctttctcaaacagatctaaagcaatcacactgacctctttaatccacattaatgatgctgttgaggaggtaatgtgtggggcaggggagcatggtatgttcttacagttgactctccctggtttggttgccctcttcacctgagcacctttacaaggaatctccagtgatacagctgattttctctctttcctcccttccgcagatgctgcacccagggctaccaccttgagtctgactcctcttggctaattttatcatttgcatgatagaggaaggctgaggaggaggggtctgtaatatggaagtacttccttcccccacataaactaagattttagagaacaccttccctcggatgagctttctagaaaagtctttttgtgcattttttctcagtgattactcctccccagttcgtggctatagggaatctattttaatcgcttccatgagaacctgaaggccctggagggcaagtccacacaagtgtggggtgtacagcctctaggagcgctcaccttccccctagtccacacttgtcctccagacattcagcgtaatcaccaggtaagtgttctcaccaatgtgtttccaggagcttctcttccaagtcagcaagtctctgctgtaattgtggatgtgcctatctctacagcttttggagggagtagttttttcagcaatttcagttcttagatggattaaaaaatacttgatatttagatggtttggagatatatatatatatggtttggatatggttggataatcactctatttggggaaataagaatgcagatatatatatatatatgctttggatatttagatggtttggagatctcatatatatatatacacacacacatatatatatacacacacacacacacacacatatatatatatatataaatttttcttttgagatggagcctcactctgtcgcccaggctggagtgaagtggtgtgatctcagctcacttcaatctccacctcctgggttcaagcaattctcctgcctcagcctttcaagtagctgggattacaggctagtgccaccacacctggctaatttttgtatatattttttagtagagacggggtttcaccatgttcaccaggctggtctcaaattcctgacctcaagtgattcctctgccttgacttcccaaagtgctgtgattacaggcatgagcctctgtgcccctctggttcagatgttttttgatgtagaaatggagctaatgacttttaagatcatcatatatgtgatcaaaaccctgaagtctcctaagaggtcatgtgtgttctggtactggaagcagaaccctaatctccctacataaaagtggcatctggacagacacaactgaacacgtagggacaaagggaatggcacagcaggacacttttgaggaagtttcaacagtttcctttttattcagaggaagctgcagcaggtgaaagctggttatacctcaggtgatgtcattttctggaaggctgttcttgctctcgtgctgaatcaagtggatgcacctgggccctcacacctgggacaggaactctcattccctaacacaaggtgctcggtgagaaagttttttccagctgaagtgcagagaaaggggagagaaggagttgtctttggtgtcccaggatgtgtgtcaactctaggataaagtcacctttgaggggcgctggtctacctgaggggattacatcagttctgccttcaataacctgtggctgtggtcaggagagtgactcatgcccttctgctcctcctacctgcctttcattaaatgtgcaatgaatgagtgatccctcaccagagagtgtcgtggtctaaacatcatgatctcacacaataacatccccacgcccaatctcatatacattattgaccccactcaatcagcaattggcaaataatttgctcttgtagacttggtgaatacatttactcagcgttcatgtcaacagcctctcagccacatttagcaaagtgattgacaaaaatgaacatgtctctatcagcaaatagaaaatataaaatcaccaagttggttgaaacgtacactattaactctgaacaaatataataattaattaggcatatcacaatggcacacgtttgttttaccctaaaactatcccctgagctttgccaagtcagtctcttgtctttccccaaaagccctgcctatcacaaacctgttttttaaatccttttaattttactgtatttagcaggtctcatgaatggaattgtacaatacttagtctcttttgtccatcttccttcacttagaaaaaatgttaaaatgttgttttctgaattaataacccataagtttttatgactgaatagtattccactgtgtgagtatacaaatatttgagaatcaattctgttgaaatacatcatgtttacttttgtgtttggtaattatgaatatcggtttatgacaatcgatactgaacaattgtctatattcttattttcagataacattttttcttggtgaggtgtttgttcagattttcagtcattttagaattctgtttatattatgctttctgttgagttttacaaattctttttatagcctagagacaagaccttacaaatagtaaaaagaaatagtttctgattttgaatagattcaatatacatacataatttttaattgttataagcacataatagtatatatatttctatttgttgggtatatgtgatgttttggtacaggcatacaatgtgtaatgaacaaagtaaaaaaaactacaataaatctataaaacattgatgaaagaaattaaagaggacacaagatggaacaatattccatgtttatgaattcaaagagtcaatattgttaaaatgtccattatacttaaagcaatctacagactcaatacaatccctatgaaaacaacaatgatattcttcacagaaattaaaaaaaatcctaaaatatatgtggaaaaacaaaagatgcagaatagcccaagccattctgagcaaagagaacacaactagagaaatcacattacctgacttcaaaatttatatttttattattgttaatttatttgatctaaaagttatgtttcaaacaatgagaataacaatacgttaaatgagtctgatgtatgtatacttgaaattaatggcatcaattttatgaatgatggaggtaattgagaatgttctgtgtaaggcacctgcactagatttgatgtggaataatgtcattttgaagatggagacagattagttacacacgcatattgtaggccatggtgcaaagcaggctcaccatgcaaaagtgaccaaaacaaggccacctgggttgtacacctcagcagctgtgttacccactgggacaaagctctgaaggacatcctgcctccagggaagagaagaacaaagcccagggtgtccctagctgtttttccctaaatcaagattttatatcctctaggagaaacaggaacaaacctgagctgttgcagacagacaggatgtccttggctctgtgcacgttcgggaacaagatcaacttgttctgagtctctatttagtgatttaggtttggggaaataagaatgcagatctgaaattatggagctttcagaaggttttcttgtgtctcagtgcaatttcttcatgtgttattttggcttatggtattgataggcccacaaaaactagatttaattcaataattcaagtgatagagcaaaattgaaagagctgagggggtttctagcaggatttagaaagtttaaaatacttcatgttagaaaatgtatttgctggacattgatgggactggagtacagaaggatgtgggggagtccaaggattgtgctttcacacacaccacaatgacttctgctgtcccttccctccctccctccctccctccctctctctctctctttctttctttctttctttttctttcttctgtttctttctttctctctttctttcttttcttcttttctttctgctgagtgagcacagaagtacacacagatataaaattcactgaatcaccattagctgttcttccttgtgcctcccacccagttcaggaggaattgcaggtcctacagaattctagttctaagagagtgagaatctttatatggctgattattccagaattttctataatgatacagctgttgtttcttttagccagtttttattgaattctattcttttctattgagtcgtaaaacttatttctatattctgttgcaagtttgttttaagatatattatatatataatattcttgaaatcggaaaggttctgttcattttcttaatgtaattatttaaatatgaaacttattttattagaaattacaaataatttttgcatatatttatgacatatgttgtttagttatgatacatgtatacattatgaactgggtgactcaagccacttatattcatcacctcacaaatttatcatttcttagtggggaaattttaatgtttttttttagtaattttgaaatatataccacctgatcagctatagttgacatgctgtgcattagaaaagcataacttatacctcctgtctaactggaacattgtgcactttaacccacatctccctttcccagtccacccctccagcccctggtaaccaacattctactctatctctgcaagtctactgctttaatatactacagtgaaatcttgaattactcttcctccgttcctggcttgtttcacttagcataaggtcctctagattcaggcatgctgtcacagaggcagggtttccttcttatttaaggaagaacattactctgttgtgtctgtatgcattttctttattcattcatccattcatgggaatttaggatgtttccatatctttactattttaaaagatgctgcaatgaacatgaacatggagtgcagatatctctttgacatgttgatttcatttcctttggatacatagccagtagtgagactgctggattctacagtagattttgtttctttattttttgaggaacatttatagtattctccataaatagctgtattcatctacattttcactctccatattctgagttctgtttctgtcatttcagccatctcagccccattcagaacccctgttgaagaggtgctgcggttgtttggaggaatgagggcgccctttttgttctcatgacttttgcactggttctttctcatctttgtgggcatatccaccttcagtctttgaggttgctgacttttggatacatttttattttcttttatcctattggatgatcttgagggtttgattgtggtataaggtggattcagccaactggcttcatttctggaaaaatttaggtggtcagtgctcagctcccaacacctggactgtgtgctctaactctgggggaacttatacaagtccctgacttggttctctggctccttaaggttaggaatccactgtccttggggggctggaggtgtggcagctgtgacagagtgctagtgggtgtctgggggcctgcctccctgcaggtgttcaccacagtggcagaggcactgcatctgtgggtgtgtggggccctgctggtgactgtgttcaaagtcacgctggaggtggtgttggctcaggggtgggacacttgtgggcacaggtccgggtgccgtattcatgccccacaagcaggagcaatttctgaatgtgtgagatgatctgctattctctgtgcagaattagtgcaagtgcgggacgctgacaggagcgggcctggctttttccccaccaaagctacctctgccgtggtggttggggtggggggaggggactgcactccacgcaatggtgggacaagaaaagcaaaacccacctatacagacatgtgcctgcaaagtgatgtggggagttacgtgggcctgggggaacctacagtattcggaggaagtgtgtaagctggtgtgtgcacatgagagctgcccgattggagctctccaccagtcaggcatggtctgccagggcagaaattttggtgcaggatcccagggtgcccgagactgccctgcaagcaggtatggccaggctagggccccaggagaggccagtagatggaggggcactcaggtccgtacattatttgagaatatggccaagttttatgtgaatgagtgatgacttgattgtaatgcagcattttattccagtacacaaacatatctcaaattgtttaacattcacctgtaatggatattcaatgtgttctctcagtttctggcttttatacagaaagcagctattcagtgtgggaatgtgaaaaaaatgagaaaactgtgattttattctgacctcattaacaacaaagctgaacagctacaaataaaagagagaaaaagcattcaacatatctgagtcgatttcaccgagcaaacaagaaaactgaaatctgacaagataggagcctgcaaagagaaccaggacctacctgctagtgtacatagggcaggtgccactggatggcatttgagatagaaacagactaacctagaaatacttaatgacttttttttagtatgcatgtactaatggtgttagagtggcctagtgcttgcaagcttttcctagagaacttgaaaaatccacggacaacttcctcatctggtgtcttgtggtgttgactggggaaaagaacagcagctcctgtggaatgcctggatgcacctccactacctccaggggaaatccaccaaagcatgtgtcatgtgagctgtggtgaagtcaacagaaacaaaaggaaacagaggacaccaaggaaacttgatccagaaacacctcccatctccttcctcaggaaagaaatccttactctttagggtaaggatagtgggtaaaaagctggggacactggtgaaaaacaattctgtatgggaaaatacattccagccctggggaaagagttaaggacaggacaatctgcaaggccactccccagaactatgcttactactcctgcataagaagaagactcagtcagaaggttggaggacgtcccgctttgtccaagctccttcaccacacagtcagcaatttaaactgtcagtagggtgcactttccacagctgaaagagacagactccctggggaaaactaaatataaagacccaggatcaaacagggacacaaaagcaagtatcatgggaggaacttgaaatctctgtggacagcagaagctgacttcaactctgataattgtggcatccataaattgcaaatatagccctgaatagatacacacaaatgtctataatgaaggcccagcagaatggaatgtgtgaccatcttcaggaagaaaataatgaatacatgagtacaagaaaataaattacaaataaaagtcaaacttgaattctatatgtattaaaaatttcatttaaagagaaagtcaaatgaataccctgtaagacaattcgattctgagaaaatttattgccagtgcattcatccttcagtaggtgctttggcaaattttctgccagggtgagtagccatatgatatacatctgaaacatgaatctatccaaataaaacaggtggtcaagaatgaaaaaatgaagttgaaatgtagtttttatatttttaattgttctaatatatgtctatgtaaagtaacgataaaaatgcacatattatattttatagcacatataagtgcaaactgagaataaactaagacaacggatgagaaacagggtttagaagaatacagttataatagctctacaacctatgaagaggttttacattatttgaattagaatctgattatatacaattcgtattgtatatcttatggccaatataatattcataaaggatgaactaaacgataagttaatagagaataaacatgatcataaaatgctaaattaaaacagaaattaacagaaaaatagtaataccagttttaaaacagaatttattatagttgttttaaaaagcaagacccaactattagctctgtatagaaatttgctctacataggaaagttaaatacaggaaaacatggaccatgaaaatatgaacgaaaagaaagcgtgcttagctatgttaaattcagacaaggtagacataagactttcaggaatcaaggggcatattacatagggtaaagggatcagttttctaaaaggcatcaccaaagatttaaccaatggatctgcaatagaaaataggctaacatctataacagatagagacttcgacacttattgtgattgacaaaacaaacgtgataaaataggtaaatacataagtgaccagaatcaacttatttcactagtttcatttatagaatattcaatgggaagacagcaggaacccaaactgtgattaaccagaagatattagagggacatggtgattgaatttgatgtggttacctgagttgaacaaagaaacaaacaaaaagcaataggaaagtgagactttatctcaaaaagaaaagaaaaaggaaaaaaggaaactgttaaaaattggcaaaattcaaataaatcccagagctgaataaacagaaaattatcaatgtaaatatattagtcccatgtcccatttttttaacatactaactttagtgaaaactcggagatggatgtgaacacactgtattttccttacaattgttctgataatctataattattccaaataaaaagtgtgtaaaatataaagtaacaatcataaaaataatagttcaaagaacttataaaataggcttctgaaaataatattgttactaacattattatggataattattttagaggataatactgaaatgatcatcaaagtagtggacagatgtttatttatttcagaaaaagatgtgaggcatctcatattaaacactagtgatggaagtgtttatagagttattttatcatctataatacgatggatgaaaagcattatcataagcatttgatggatgaaaagcattactcataagcatttatttagccaatatcatgaatgtattataatttcctcaattgtgcaccacttttgtgttaataccatgtgaacattttccactgcgtgtgtcatatctaaaaatttgaactagtttgtttcttattaacgtgactcttgtaaatgctgtaggcattgctaatgttctctgtaatttctctactggtgactttttcctaatattttaacatgataaatttggattaatacaactatgtaatttaataatatattttaaacttcatagtcgtacacacacagacacacacacacacacacacacaacagccaagcaatgacacatatatgcgtccatgcaaaaatgaatgtatattaaacaccaaaacaacacacccattttttctatattattttaattatttaactgaatgtaacttgtatttgcagtttcatttttgaatgaatgtaaatgccattcttgccaaatatattacttaagtgtacagtggtatttacttttttttttgagacagtgttttgctcttgtcgcccaggctggagtgcaatggcgtgttctcggctcaccgcaacctccacctcccgggttcaagcgattctcctgcctcagcttccccaccatgcccagctaattttgtatttttagtagagagtgggtttctccatgttggtcaggctggtctcgaattcccgatatcaggtgatccacccaccttaccctcccaaattgctgagattacaggcatgagccactgtacccagccagtatttactttttaaatatcagtcagttattaataaattgaataataagacaaacatcacttaaatttttattaaatcattgattaaagtaacattgtatttttttaaactaggcaagatataacttttctatttgaaaaattttttaaaaaactttttggtgttaattttcaatacaaactctagtctttatttgccaatatgcctttataataaagaacatccagtgataggaaactgaaagcagcccatgctttgcaggattcaatcacaatggcagcttgctggagggtggtctgagagtgtgcaaacacattagggatttggacttcatgaaagcactagtgagcccctgggctgagcacacagagggtagcatgagttgcagagcccaatctgtggtactgagggaaaaagaggaatgggtgggggttatgtctgcaggaccctagaaaagtgtgatgagggcagagagtctgcaggtagagcatattctaaggagaactgttactctcctaaacttggttggcttcagtgatcatgaaaagaagtgaactgatttaccagacatgggggacagaaagtaaaaggacttcctgtttcctgcatggagagtgaggaagataaaatattttgacagaaaaagagaagatggagaaagtttgagaagcaaaacaccaggggccaaagtggaggacatgagcccttaaagcggtgtttcatctgcacaaacagccaatgaaaggaaaagaaactggaccccacgcatatgctgagttgttagaaaagcatttacaatagtgtgtctgacagcacagaaaacaaaaaaattgtgcatagagccagactttggattgaatatacacaattaaaaaaaattatactgagatatatcattgctagtataactctgaaaataggcagagtttaaagttgaattgaacccctgttctaagttaatgttttataggtgaaagaaaccatgagttacaaggaagacatggtaagagatcctggggaagacttttgcttgaccaggtcaggaatcaccaaggtggaaaaggaaacctcaccctccccaggtacctgatatggagctgcctccaaagagccccttggaggtcctgagtgtcccctcgtgtcctgagccatccttgctgtcctgaacacctgctggtggttctgagcgccctctggtggatctgagcgacccctggaggttctgagcgtcccctggtgtcctgagcgccccctggtggttcctcagtgcctactagtgtcctgagtgtccccttgtggttcctgagcgccccctggtggttctgagcaccccttggtgtcctcagtgccccctagtggttcctgaacctcccctggtttcctgggcaccctctggtttcctgggtgacccctggtggttcctgagcgccccctagtgtcctgagcatcccctggtgtcctgagcgccccctggtggttctgagcatgccctggtggttctgaccgcccgctggtgtcatgagcgccccctggtggttcctgagcttcccctggttttctgagtgtcctctggtcgttctgagcacccgctggtttccttagcatcccctggtgtcctgagcactccctggtggttctgagaatcctctggtgtcctgagcaccccctggcagttctgagtaccccttggtgtcttggtcacatcctgtggttctcagcacccccccaccacagtctcatgagcgccccctggtgtcctgagcgccccctggtgcttctgagcaccctctggtgttctgagcaccccctgcttcttctgagcgctccctggcagttctgagcgccccctggtgtcctgagcacctcctggtgtttcctgagcgcctgctggtgtcctgggctccccctggtgattctgcctgccccctggtgtcaacaccccttagtggttctgagcagctcctaggttccttagggccccctggtggttctgagtgcctcctggtgtcctgagcaccccctggtggttctgagcgccccctggtgtcctgagcaccccctggtggttctgagtgcctcctggtgtcctgagcaccccctggcggttccgagtgccccctggtgtcctgagctatccctggtggttctgagtgctcccttgtgtcctgagcgccccctagtgattcatagcacctcctagtgttctgagcgccccctggtgtcctgagcgcctcctggtggttctgagcaccctctggtgtcctgagggcccctttgtggtcctgagcgccccctggtgtcctcagcaccagctagtggttctgagcgccccctggtggttcatagcacccccaattgttctgagtgccccctggtggttctgagcaccccctggtgtcctgagctcctcctggcagttctgtgcaccctacctgatggtcctgagtgccccctggtggtgctgagcaccccctggtgtcctgagcccctcctggtggttctgtgcaccctccctgatggttctgagtgccccctggtggttctgagcagcatctaccgcatagtcccctcctgtctccctgcagtgagctttgtgtctgggctcacacagggtttccctcactgtgtcactcacagtaatacatggccttgtccttggctttcagattggtcattgtaaggcagactgcacttgaaagggtgttgcttgagattgttaatttatttgtattcatggagagtaaccctgagaattcatacttgattgctcactgttggcatccacacctatccctgttgtgaagcgtgctggaccaagctcatgctgtagccagtaaaggtgaaaccagaggctttgcaggagaatctcaaccgctgggctgtaaaatttttccccctctgactccatcagtaaacttcacacaggacttccatgaacacagaaaacagactgagaaaatccccatgaggagcagccacagctggacctgttttacaaaggccactaatgttgacggggatgagaagggaatccagatcagtgcagaccccatggtgtggacactgaggaagggcacagacatggggtggctcctcgccagggcctgagggaacaggggataagctgcctttcttgagaaggggaggggacacatttccatgtctttctttttgtggtcatgggtgcaccgctcagcattgctcatccatcctctgtgtctacatttcagggaagtcaaggtcaaaggatttctgggtctggatgcacagagttaatctgcccattactcttttttattctctagtgtggacgctgttcaggtattttcataatagcaaacattatcaacaaatatgtccagtaagaaaataaaaatatgtttccagagaaaatggacacctgtctctaattggtacatttagagctgcaaactactgttcttgacaataaggcaaagttaggttacaatgaaaaaaatacatatctacgccttgtcagggagggggtttataattatcattatcttgagatcattttgccacagaacaattcgacattggatatatgtgtttgtgtaaggaaacagtcaatgtggacatatgtgtacttatctgaattgagttcacatggagacatgtttgcttgtctgagacaagagtccacatgaggaaatgtctgttttctgaggaaagagtaaatgtcagaacatatgtggtagtctgaggaaagagtccacgtggggacatgtgtgtttgtctgaggaaagaatccacatgagtaacggtgcatttatctgacagaagagtccacatgttgacaggtgtgtgtccccatctgagggtaaatgcccattcagggacagtgtatgcctgaactgagctgaagtttggggaaatatttctcaaccaaggaaagaaaataatcctgtgggttatttgcttgtcaagaggaaaaaacctgggtcacgtagaaaattgattttaaaaaaaattaaaaaattaaaggtctttagtgaatggcaacatcttatatgcaaatcaggaaaattacctcattctttgttgcatacatctcatgaaatctccaccctcacaaaataagtaatgagataattttatacaatctgcatttgatccttgggttaatgaactgctaagtacttttttttaattgtgtatatttaggtttatattttccatcataaaattatgtgcttagacaaattaattgtgtcatatctgaaccattgcatatcactataaataattttaatcttcttaaacagtgtctttttaacttattttatacccagtctctaagctcctggaatatcctctatatgtttacttgactacagttttggcttttatagaatttcaaataaatcaaattatacagtgtcattgaaatgacttcactgaagaaactggaaaatgaagttgctgacctaaggaactttgaaaatgaggaaactctataataagtgtaaagaaactgaatataagcactctattctagtagataaacatgtttccaacaaggttacagctttacatttctgatactgctatgcatgtgtcctgaaattgtgcagctaagtaatcaaatggcatatggttggatggggttcctcactttgcagtgagtggttatagacagtcaaggaaggaaggctagaaaggtccatgtggtagcataattgggtagagagaccagtgtgttctcacttttaatgtaatcaaattacagaaggttagatacatagtttactaggccagtcagttgagaggtcctacaagtacttataccacgttaacaatgcacatacccagtattacaattttttaaatactattctttaacatcagaaacaagcagtctttagaaaaatggctgattctatgtacgaaaaagataatatagaaaatgagtttagaatttattataatagcaggaaacagggaagtgttcaaaaacaaaagcatgaggtgagctgtaaggatgcaggatccaaactaaatgagctcccagcacataataaagctgtggtggtttgaaaaataaaatgaataatgtagcatggatcttcttcagagtatgaaatagacatccataaaccaatacacatattaataagtgatcaaataaagaaataataggaagaagaacacatctttttacagaagtattccaactatgttaggttgatagtcctccaatcaagtaggtgaagcttaaacactcatgagttgattgtagcctgagactagagacacggaaaaagtaatcatattagtatattttataatgagatttcagatataataccaaagacatgatctgtagatgaataaaattttattttttaaatctaaatttgtataaacacacacacacacacttttctgcaatacacactgataagggagtaaaagacagccacagacttggagaaaatacttccaagtcacatatttgttaaatgaattcttttaatttgttaaatgacttttataatcaatatgcaagtaaacttacaactaatcaaaagaaaacaatacagttaaaaatgaaccaaatatgagaagaggcatctcagcaaaaactatatgaaaattgttaaatgtaaatttttattaaggaaatgtgcatttaactaaaaattagataccattactcacctattagaatggttaaaacacataattctcataattgtaaatggcaatatgaatgtggaaaaccaagaactatcatgcattgatggtgggaattcaaaatgctacatgcacaaatgagtttttttggcatttttaaaaatagagataaaatgtgatttgtgtatgtgttccaaaatatttacaacactgattcagaaattgatgtttacacagatacctacagaggaagttctgtatcagttttattaattcaatccctgaaatttgcttgcagaataaatattgtatgaaaaatctctcaagtaattaaaatttctcaagtacacatttatattgtttcttttccttaatgacttaatgtcattttctgagaaagtcttcaatctaataatctttgtcatttcctccatgccagtacagctgcttcctccctggggtttctgacactctcaggatgtgggttttcactctgtgtctctcgcacagtaatacacggccgtgtcctcagatctcaggctgctcagctgcatgtaggctgtgctcgaagatgtgtccctggtaatggtgactctgccctggagcttctgtgaatattttgtgttaccattgccagcgttgatccatcccatccactcaagcctttgtccaggggcctggcgcatccagttcataaagtagtcggtgaaggtgtatccagaagccttgcaggagaccttcactgaggccccaggcttcttcacctcagctccagactacaccagttggacctgggagtgggcacctgtagagaagacacaggagtggatggaagcccccttgactggcctcaatcccttcctcctcactgggatttggcagccccttacctgtggctgctgccaccaaaaagaggatcctccaggtccagtccatggtgaggagctgtgctctgggggcttcttctgaggagggatgtggttgttgggtgatgctctcagggcacaaagatatctatagtcatatcagttatttgcatattcatgagcgatgctatttcatacctaacacagcatgagaaagaatggagagatgacacatggattacccaacaggaggatgctaagggttcaagctataatccccttagaggccatgtgtgccctgccacatccctaagctgtatgttgacagagcttctggagaacaattttctccagaacagtggagaacactggagaacaattttccctagaacaggacttcactgggaacccacacttgaatagctcagaggtaatttaaagcatttctaggctttaatacatgaatgtgttatttgggggatgagtgtgtttctccaaaagttgcacttatttatataaaataaaagcttaattgatctccagatgcttactattaaggtatgtagcagggttagaaatctccagtgtaaattgataaattcttgcaattgaataggatatttatggaatcttcagcagtctttgtcaaatacttattttagatttttttagaagaatgacacagatcttgagaggaatccctccccagcctcctgtgcacctgctctggggctggggcctgtgctgggtgggccttgagcgccccctgcagcccagcccttgcactgcagagaggctcctgtctgggctcccagagcattttcctccctgtatgaagtggctgtgtcctggctcagaatgcttctttagtgacacgtgacaccatgtcctgctgacaccatcgcttgcaatagtaaattggttgtaggaaagccagtgaactctgcagaaacaccccaaacaaggattctatgaaaccaccagggagccccttctctggagctccggaagcactggatcagtccacactcacaatgagtccaggagctcccaggggctttgggagaacacctaatctcttgtcggttcctttggatgaacatctcatcagataatttctaaacctacaaaatcatgggtctcagagcccactgcgaaactcctaatacacacacacacacacacacacacacacacacacacgggtggttagagtccccacagtaatggacacacacacacacacacacacacacacacacacacacacactgtgtctagagtcctcacagtaatgagagggaactgtgtcttactccctgtgtctagcgcattggctgtgtgcccatagtgcctctaggcctggggatatgcccttgtcaagcagaacaacagcaaacactttactggagatggggccctgcacacactgtggcttccctgttctcccagaacctgggatcctgcagatacccctaagaagagtccaggctcccccaggagggtcagccacagcccagccccaccgagttggtgcagcctgcactgaactgctgacctgtggagagggtcacagcagacccacagcccagccagccccactcccagaggcacatcaaggaagggggcagaacccttgggactcttgatgggcatcttttcaggagcagacacaggaaccgttccaggaacaggggacctgggaaggtcagtagctggtcagggtttctgaggacgagtgtcagtgatgggaccagcctgtcccttctcatatgggatgtctctcctggggatcctgtactgtcttatttgtgcaggtccactctgtgggacttgtctttataaatctcaaatctcaggaacaggagagctgtgcttcaaaagcccccatagagaagacacattcccatcctgctgtgattgaaacagctccatcctgggcatggggagggctcatgtgtcccacctgggatgagaagcagcagccacacgtgagctgaggaggacccaaggctgcttcccagcacttccccacagagtgaaatgtgtctgtttgccccaaatccaagctggtcctgtgacttgcttctttcaaatttcttggcctggaaagtgcaggcaccagctgtcaatgtcaccactattgtgacactgtacacagaaccagggaaggatcccagggatggggctgaggacagacactagctaagtggacccattgaaaacatgcagatctgctggggttcacactcctggaaggacagatcttggagggtttggaggaggaaggcgccactgtcggtgactcaggagctgctgctctgcgggtcacctcgttggcaagtaacagtgggtaggtgagtgtggttcatcccctacagggacagcccctcttcaccaggaaagaaagtggctttgttcatactggtttccccggccgtctggtcatcctctcttcctgaccttcttcccatggccctcagggctgtgaaacatggacaaagacactttctactccaaccgttgattacccaggtcagctccctctagaaaagccatgatgccttcctggttctgtgtgcctggctgaaccagaatggacacacatggatataccaaagtgtcaaagtggaggagaggaatcttggcaaatatcacacaggaaagagaaaggaattcgtttgtatgcaatgagagggtgcagggcatgtctggaggctgcaggagccagaagcttcatatttttttagtgacctcggttttgtctcccctgttgttgtgaggcttccctgagttctcctcctcagatagactctgtgccttttcacacaatgacctgtaggagatgtttacaccaaacaagaagcctcaaacatggtttatattctgatctaaattttcggaggataaactcaagacagattcaaagaagtgattataaagtatcagtatgtagcacttggttgagaaaaccttaaactcatattatttttatgaaccacatgcataacaaaactttgtccaattcctccactttatcagagactgcctgcaggatgaatttcaatgccatctaatttagagtaggagcaaaacttaaaatcctctataggtctgagtgccactaacaaccaaaaaaaatttcgaccattatgaagttttaagagatgccacaatgacagcctgggttgataggtgatggcattttccctgagcatattctgtgaagagtgattatggtagcttttccttctaatgaggagaaagcaacagagaaagtaaaaaaaataataataataatcacgaaacagaaaaaagtggcccaaattgtttaacaaaaaaaaagcactagaaactgccacaaattaaaaggagatatattgattacctagcagaaaattcaaagtaaaccttataaatatgttcactgagctaggggaagaatgcacgaacaacatgaaagtattaacagggacaaaaaagggagagagatgagatacaatgatttgtggcttaacagtagggatacattggccaggcgcagtggctcatgcttgtaatcccagcactttgggaggccaaagagtgtggatcacctaggtcacgagttcaagaccagccagggcaacatggtgaaaccccatctctcctaaaaatagaaaaaaaagaattagctgggcgtggtggtacatgcctgtaatcccatctcctcagaaggctgaggcaggagaatcgcttgagcctcggaggtggaggttgcagtgagccaagattgtgccactgcactccagcctgggtgacagagtgagactccatctaaaaaaaaatgaaaaacagtagggatacgtctgagcaatgtgtcctcaggcaatttgtcattgtgcaaggatcatagagtgtgtttacacaaacctacatgaaataccctgctacacccaggctgtgtgggatagcatagtgctcctaggtaacaaatctgtatgtcatgtaagtgtactaaatactgtgggcagctgaatcaccatagtagatgtttatacagatgaacatatctaagcatggaaaaaatgcagtgaaaatacagtattataatctaatgagacctttgtcatgtatgtggcctgttgttcacccaaatatcaaaatgtgcatgattctattcaagttgctgaaaaaaaaagccaaaaaacttccaaataaatatcttacagggattaaagcttttcttcagtaatgcaggatgtttgagaagtttcccaaaaaagtaaaaagtcgacaagttcatcaccactaggccggccttacaggaatgccaagtgtctctggcaggtttcctgaacaaggaagtagctgcatcagctccactctgttatctgccaattgatagatttgcatagtttttaattttaatttctcttctgttttttccctccataaactccttctcccttcctttcataattctgtctattaatgcaactcatatttagctgacaatgctggggtcattggaataaatttctatttttcctccaccaattctaataagctgtctccaggggtgtccatctccgttttcttttctgccattcccatgggataatttccttgttcctatgtgagtccagccctcatcaccacgggccatccaaccatcatgcacccaggaacagcttcaggaaatgtaccctgccagctgcctatcagcctccacctgcacagtgatcattccttcagctttcactcaggccggagggctttccacccaaaagggcctttcacacccactcccagcacagttctaggaccctgtatacctcccagatacaggtacatatccttcccctttgttgttaattttgtttaatttatttaaaattcactgggaaatcactgatgatgggagtgaccagcctgtccattccattttctgtccaccatctgacggcaccacctgtgaggttggccaccctagtgtgctgtgctcatggggccatctggacatacacaaacaccaggtgtgtgagttattagaggaggcccgggatcagcaggtggctgtgccccacaggacacaggtctgtcctgcagtagagcccgcatgacctggaatcatacgtgtgcatgacccgtggtctcagcacatcagctgaggccagcttcaggcaattcctgtgtaacctgccctgggcgcccacagaggacagatgcatgacaaggatgtaagggaatgctgcggattaggggaactgaagctcaatctttactaaggctttactcggcacctggaccttatggaagactaagaagaagagaacaagagtccagccccaaatagctcctggtttagggtcagctttagtgggattttagagagtagaagacacaggggtgatgctggagtggttttctttgggatacttggggcagcagaaggtgggccgggatcaggactccatctggctggttctcattatctacatggattctcatggtggaaagtgagagacatgacctagaacacagcccccagggctgatctcagagacgcctgctaagtgaatgactcagcagaaatgtggtggggttttcatcttggatctatttttctttataaaaataatctgagagatgtgtccagcctcagtgggctgtttctccctccaggagacagagctaacacaattgtatctgtgaatccgcttggctttccatcagaagataccacagactaggttgtttcaaataacaaatattaattttcttattgttctggagtcttgatgtccaagatctgggtgcagaaagggatagtattttgttttttgagaggcctcttccaggcttgcaaagggccaccttctcatgcagtgcatccccacatggcctctcctctgtgtgcatgtggagagagaggtctctgatgtcttccacttcccataaggacaagagtcctactggattagggtcccacatttatggccacagttaacttatttgccctcttaaaatccctcactccaaatacagagccactgggattggggtttcagcatatgaatttaagagaaggacacgatgcagccaatgacgtcaatcaagggatagtgagaagccttgaaatattttatttgtcaagaaggtaaaatgggccttgtgggaatttgttgaaaaaaaggtgccagtgactgttaaaaccttaatggtaaacagagaaatttctcccttctttcttgcctgcagtgaggatgtgaggaagcagaaccacaaacaataaagaaagaggagccctggggacagctgaggtgctggcgaggagggagaccactgagcagatgaggaagccccgccctccctgcccctgctcctgacccggcctcatgctctgtgggccccgcgccccctgctggtcctgagcagcacctgcgtccgcgccctccgcctcctggcagggaggtttgtgtctgggctcacactcacctcccctcactgtgtctctcgcacagtaatacacggccctgtccgcggcggtcacagagctcagcttcagggagaactggttcttggacttgtctactgatatggtgactcgactcttgagggacgggttgtagttggggctcccactatgatagatttccccaatccactccagccccttccctgggggctggcggacccagctccaccagttactactgctgatggagccaccagagacaacgcaggtgagggacagggtctccgaaggcttcaccagtcctgggcccgactcctgcagctgcacctgggacaggacccctgtgaacagagagacccacagtgagccctgggatcagaggcagcctcccctatcttcatgtctggatccctgagatactcacatctgggagctgccaccaggaggagaaagaaccacaggtgtttcatgttcttgtgcaggaggtccatgagtctcagaaagtatttcccatgtgagctggaccctgaatttaaggaaatgtgtggtggtttcctgtgggtgcctaagcgaggatttgcatgtaggtagtgcctttgtataaagaggtgaaaagggatgagggaggccccagtcttttaggctcaccctgggatgaggatgcttgctttgccctttgagaactcagttctcttcctggggcctcaactagccatgtcctggctcctcttttcccaggtgaggaagtagattggaacagcagcttaatgtaataatcatgtgagttcagacacaccaggattcacttaatgtaatttatagttcaggacatccatcatgtttagagggaatctctctgttctagggagtgggccactttttaaaagtgtttaaattaaaataaattttttagatgaacttttgctcctttgcgcaggctagagtgcagtggcccgatctcagcttaccgcaacctccacctcctgggttcaagtgattctcctgcctcagtctcccaagtagctgggagtacagacacgcacaaccactcccatctaatttttatatttttagtagagataaggtttcaccatgttggccaagctagtctcaacgtcccgacatcaggtgatccacccaccttggcctcccaaagtgctgggattacaggcctgagccaccattttaactaaggcactgggagctgccctctgagaccttttgagtcctggaattctttctgagaccttaggagagactcgtgggacatatcttcatcattctcaatgtgtgaccctgaggatgtggcctgacctctgtacacttctgtgtgaaagagtagattgtgaattgcagtgacaatttcatatgtaaactctataataggccagcactggaggatattctcatcaccaagattactgcagttacctttcctggaaaccagagaggaactctgtgagccctcacctctgagtgcacaaggaaccctggtcctgactgacaggtctcacatgcgacatgggggaaaacaaatacattcaaatccagtgttttcacccatatattgaccaatctagcctgatctatctgtctctgaaaagccttttccttcattgaattgcatgaacatacccttgggtatggggtattgcaatgtgggtatttggtgtttgtttagtcaattatgtaattaataggctacctccatgaatgtgtgtagcagtagagttatcagaagttgggtgagtcatattatcaggacaaacctggactctcttcttgggacctggacaagtggccaatcttctgtggtaaagcaaaggggaagagacagatccaacatctagaagcagggtagctcctcacttaccagctggtgtctgggccttttgtttgaacagaccaaaacgacctaccttcaccttcagggaaatgatgaacttcgtatgaaattgagattaattttcacttacagagaagaaaatgtcataggcatgtatatatctatgtgggtgtgtacgggtttccacgatgtgctcatacacagaaaggaagcaactatatttgccgggaagagaaccgaagggcttctgaatttgtaggtgttgttaagcacaaatgtgtcatgttactacatcatgttatagagctggcggtaaaacctcccaaaattgtcatggagacaaatgcaaagaaataaagattcaaatcagatgcctttgatctgtaatgaacagaccaagagaaatcaaccattatggaaagagtgatagttaaatgtagtagtaaattccacgctgaggtgagagggaagttccatctgacagctcactttcacctctgcgaaaacttcagagcacagactaagagcagacagtgaacttagggcaagtgggggccagatgtttgaggaggctagagagtgagctggaatccttgtgagccattcggagaagcagcagtgtgcaagggtgtattgagtcctcctgagttaacagatgctgaatagataccagtttcactgccctcattttgatttatcctcaagactctattggatttctagatttgaacactggaaaagctgatgaaactcaacatgactaggaatatttctgggaagatttatgtaatgatgtgagtgtatttaaaattaggttatgaaaatttcattatctaaaatgttggtatcagtatctattaatttgttctttttttcttagagacagggtcttgctctgtctctcaggctggaatgcagtgtcatctatgaattttatagtattaaaaatgatcaccctgattaatgttaccatattatgcccttgagggattttgctccatgtgtgcctgtgacatagttctagtcacagatgcaggagaagtggtctgttgaggcaattcttcctcctcagaggagaatataaactgtcatctcctcaccttgcttattccattttcagaattgcacatgacctttgggaatgctgtcaccatgtcttacagggtgggagtcgactgtggtatgaaggtggaatggagaagtgtaattttgggaaaatacagaacctgggcagataaagttttgaattaattgggcctggagccactcacatcctggtgtcttgttgaattgtttgtcattttaaattctggttatttagttcaagtttccttgattctctttctgctaaaatattcataatcatctaaataaactggaaaaaaattactaatttgaaaattaacctcatttctgctaaggtcaaaatcagtttgcgaggcacagagtgatgggcatggacatagcagattaccaagattgcattcacagcctaggtaatcactatgttttattttaattaggaaacacttctgtacattccttatatttattaaactcctgttgagaaacttcaactgttatatgttgatagatcctcccaataataaaactaaatgttttaaaacaggaattcctattacaatgttagctttactttaggacacatttcttcacctcatttgaaattcgcccagatgcactgattacagtgtgtcagttaagaaacgaccaggaaatgagatcacgtttctggagcaggacatggctttgggatgctttgcaaacaaagtggtttctcatgtcttcttgaaaatccattgaaatggggaagttaaggacctcttagaagcactcttccaccccatatacttgactaataaaaaggtggaagtcagtgcagaaaaatagataacatgaaagctaaagtaagatttgtaccagttcgttgtgccaaacatgtaatcttaacctagagtgggatcttagctgaaccctcaggaggtaaatttcctgagagattcaaagatgtctttacaaaataacaacacttagcccccgattttaagttaaaataatggaaaactcctggtaatctacttcacttagtgtaaatcagttaaaaacaaaattctggaaaacctgtgaaggtgggacttgccgaggaactgagccttgggggcctttggacacttttagtaggattttcttcagctttgactctccatggaatttgaacaagtttcatttactgtctactgtttctctgaatgacttgaagtaattacttgacaaaagcctacagccttctcagttgataaacatgttttatgttttcaacctgtgacatgccgatgttttcatcaggtaactgaagcacagccactacaggaagcaattgttataaagtgattctgtaaggtatttccattatcaaatgctgaaccgctattaccagcaacaatattctgcaaatgttgaaaaaaatggcattgctacatagaattaatcacaaattttaaaacattttcttatatttattgtttaaattcataagcatggaatgtttatttttccatctatttgttttatctctgatttttttcacctgtgttttgctgtttttctagtagaaatatttcatctcattggcttagctctattcctaggtattccactgtcttggtggctattgggagagcaagttcttgattccactctcagccagaacgttgttggtgactagaaatgttactgtgatttttgtacattgattttatatcctgaaacattcctaaactaatgtatcaatactaggagacttttggcagagccttcaatattttctacatatagaatcatattatcagtgaaaacagagggtttgcattcttctttttcttttatttggatgccttttatttctttctcttgcctgatctggtgaatacttccagtactaggctgaatagaagtggtgagagcgggcatccttgtcttgtttctgttcttaaggaaaatgcttccagtgtttgcccattcagtatgatgttggctgtgggtttgtcatagacggctcatcagattgaggtgtgctccttcaatgtctataattttgagggtttttatcatgaagcattgttagattttattgaaagctttttttcctgcatctgctgggatactcacatggtttttgcttttgattctgtttagtagagcatcacatttattgctttgcataggttaaagcagccttgcatctgcagaatgaagcctacttgattgcagtgtgttaactttttgataaactactggatttgatttcctacattgagaatttttaagcctatgatcatgagaagtatttgtcttgagctttcatctcttattgtgtctctgccatattttggtataaggctgatgctggcttcacagatttagttgagaaggagcctctatgccttgattttctttgtgtagcttcagtagaattggcatcagttcttttttgtatgtcgggtagaattcagctgtgaattcttcttgtccaggtttctttttcttggttgggtctttattattgactcaattttagaagttggtttcactgtatttagggtttcaatctctccctgattcaatattgggagattttgtgcttcccaaaatttactcatttcctccagattctctaacacgtgtgcataaagtttatagtagtctgagaatttgtgcattcttctgggatcagttgtaatatcccctttgtcacttttgattgtacttatttggatcttctttttctttatctttctaaatccagacaggtgactatcagtcaatctttattttacaaagaagaaactcttgggcttattgatattttgtatgcatttttgtatctgaatttcattcagttcttctctaattttccttttctgtgctagctttgagattattttagttcctttaggtgcaaggttaagattactaatttgagaactttctaactccttgatgaagtcatttatgactatcaacttttatggtgcccaaataaattaccagattcaatgctattactataaaactaccaacattatttttaaagcattagaaaaaaaacttttaaaatttatatggaatcaaaaaaagagttttaaaaacaaaagcaatcttaagtaacaagaatacattcaaaggtatcccactagaagacatcaaattatgctacaaagccacaggaaccaaaatagcttggtacttatacaaaaagagacacatagacgagtgaaagggaatagagaattctgaaataaagctgcacacctacaaccatcagatcttaaaccaagacactaaaaacatgcaatgaggaaatgtatcactattcaataaatcgtgctgggataactggctagccatatgcagaagatggaagctagatgtctacctttcaccattaacaaaaatcaacaaaaaatggagtaaagatttaagtataagacctcaaactataaaaatcttggaatacaacctaagaaatactcatctaaaaattgttttgggcaagaaaattttggcaaagtccccaagagcagttgcaacaaatcaaaattctgtctgtggcaccttataaaactaaggagcttctacagagccaagaaactatcaagagagtaagcagagatcctacagaatgggggaggctattcacaaactatgcatctgatgaaggtccaatatccagattctataagaaatgtaaatcaacaagcaaaaataataataataatcacattttaaaaataggcaaatgacatgagcataaacttctcaaaaatacataaagtggccaggacatatgaaaaaacgtttaacgtcactaatcatcagagaaatgccaatcaatcaaaaccacaatgagatgctgtctcacaccagtcaaaatcagtattactaaaaattaaaaaaaaaaaaaaacagatgctggtgaggctacggagaacaggaaacgcttgtacagtgctgggtggaatgtgaattagtccaagcactgtggaaagcagtctggagagaggctgcggagaacaggaaacacttgtacagtgttgggtggaatgtgaattagtccaagcactgtggaaagcagtctggagtgaggctgcagagaacaggagacacttgtacagtgttgggtggaatgtgtattagtccaagcacggtggcaagcagtctggagtgaggctgcggagaacaggaaacacttgtacagtgttgggtggaatgtgaattagtccaagcactgtggaaagcagtctggagatttgaaaagtatttgaagcagagctgccacttggtccagccatctcatatgtgggtatatacacaaaagaaaataaatcagtctaccaaaaaatacacccacttacatgttcattgctatgttactcttaatacttaagacataaatccaacctatgtgtccattaatggtgaatttgatcaagaaaatatggtacatttacaccatggaacactatgcattcatagaaaaagaataaaatcatgtcttttgtggcaacatggatgcagcgggaagtcaacattctaagaaagagatgatgagagtcaatgggagatgaagctgatgttttgggtgtgcctgtgtgtaaaattgagaaaagaaatcacctgggcacatagactcttaaaatagccaagtctggagccactcatatcccagtttccatttcattaggttttaatcttcctcatttttagtgagttaaatttgcttttctttactcttggctaaaataaccacacatcctgaattagaggcattgcaatcaaaacgtcgtatttgaagcttccaagtcccaagttaggtcaaagttagtatgggattcagtgtgatagataggagacatggctggatactaagaatgggctcagagttattttacctaaattaggaaaatttgttcacttcccttatattagatttcattggaaacctttgatctaatatcatctctgatagattatacctcaataattaagctggaggttatgaattagtaatttaaatgaatagtggaaacctccatttagaatatatttctctaccaagtgtaaagttagctcagatggcagaaataactgcactcagcagagcttgtcaataaggcaaagacatacacaaacacatttattgcaagggtagtgcatgactttgaagtgatctgactttgaagtgacacaaaaggattctcacatcttctagaacacatcaaaatggacaagggaaggaattgtaaatgcagtcctaagtcctagagacctgactaatataacataggaagtaaaggcaaagaaaaaagtagcataaaaactaaaatatatctgtaactctatctatccatctatgtatttatgtgtccaactatatctctatcaaggtacgtatgtatgtatgtatgtaggcatctatcttctatctgtttatccatagtagtggatcattatgcaaagcaagcagctctaaaattgtttataatactatctaaaatagcataattgggtggagagaccagtgcgttctcatttttaatgtaataaagttacatacaattagatacataagtagtttcaatgagtccataaacatgggttcatataaacatgtacatttactagacatataggttgagaggtcctagaagtacttataacaccttaacaacacacatatccagtatcacaatttttaattttaacactattctttaacatcggaaataatcaatctttaggaaaaacggctaatcctatgtatgagaaagataatgtagaaaatgaacttagaattaattgtaatatcaggaaacagggaagtgttcaaaaacaaaaggatgaggtgtgctgtaaggatgcaggatccaaactaaatgagctcctagcacctaataaagcggtggtgacatgaacaataaaatgaatgatgtagcaaggatcatcttcagagcatgaaatagacatccgtaaactaatatggatattaatagattattaaataaataaataatgggaagaagaacacatctctttgcagaagtattccaaatatgttagcttgatagtcctgtaatcaagtgagtgaagcttaaacactcatgagttgattgtggcctgagattagagacatggaaaaaaaatcactattattgtattttataatgggatttcagatataatgccaaagacatgatctgtggatgaataaaattttacatttttaaaatctaaattggtataaacatgcacacatatttttctgcaatacacgctaagggtgtaaaagacagccacagacttggagaaaatacttccaagtcacgtatttgttaaatgagttattttagtttgttaaatcacttttataattaatatgcaagttaacttacaactaatcaaaagaaaacaatgcatttaaaaatgaactagatctcaggcaaggtacctcaccaaagattatttgaacatttttaagtaggaactttttattagggacatgtacgtgtaaataaaaattagataccattactcacctattaggatgtttaaaacacacaattctcataatgaaaaatggcaatatgaatgtggaaaatcaagaaccatcatgcattgatggtgggaattcaaaatgctacatgcacaaaatgaggttttggggggcatttttaaaatagagataaaagtagagttaaaatttgattcatttgtgtgttccaaaatatttacaacagtgattcagaaattgatgtttacaaagatacctacaaaggaagttctgtatcagttttattaattcaatccctgaaatttgcttacagaataaatgttgtatgaaaaatctttcaaataattaaaatttctcaaatacacatttatattgttccttttctttagtgacttaatgttattttctgagaaagtcttcaatctaataatctttgtcatctcctccatgccagcacagctgcctcctccctggggtttctgacactctcaggatgtgggttttcactctgtgtctctcgcacagtaatacacggccatgtcctcagatctcaggctgctcagctccgtgtaggctgtgctcatggacgtgtccctggttatggtgactctgccctggaacttctgtgcatatgttgtgttaccattgccagcattgatccatcccatccactcaagtccttgtccaggggcctgtcacacccagtgcataaagttgttggtgaaggtgtatccagaagccttgaaggagaccttcactgaggacagaggcttcttcacctcagccccagactgcaccaactggtcctgagagtgcgcacctgtggggaggatacagtagtggatgagatctttcagaaatggacacaatccccttctcatcactgggacttgggagtcccttacctgtagctgctgccaccaagatgttcctccaggtccagtccacggtgaggcactgagctctaaggagattctgcagaagaggcatgtggttgttggatgatgtgcttagggcacagacacatccatatttacctcagtgcatctcaggttatttgcatattcatgagacagacgatttcatagctcaaagcctgatacatgataagaaagggaagataaatgacacatcagccttacaagagtgagatgcaaatggtctaagccctaatcttacttgagaaaatgcatgccctgctctatttaccaacatttgtgtacagaggtcctttcactgaagaataagccctctcagaacaggctcctcactgtgaacctacatgtgattagtatagaggccgcctggattatttttgggaccatcactgtctatgacactgagcacgtgccttggccctatcctggacctgtcaggcaccagcacagctcactggtgactctggaaaggtgactgctgatgtccctctgagatctactgggccctcctgagacagtgtctccagcacgtgcctcatgtcctgatcccccaggatcttcaatagaaacgctcttgttttacgtatttgccctgtgatgcataattacagctgattttctcatctcaggaacaatgggaatcagaagaggtaacaggagtttgaagttctttatgaactctctactctcaaaataattgtcaatgaatttgtgttttgaataattttgggttacttttcaactccatttattagatttttgtaaagtatttacatacttccagttcatatccatagatctgtatctttacatattgatttttgactcacttggtctgtgcacctgccacaccctcagatccatcactgccctgtcattcacacaatgtaggcaacattacttaacactgaaatctgaatttcttattcataggaatatagtttcttcaactaatcggtacccattgaattagtaaaaacatgcccatccttcatattctcactattaagatattacagtcctagaaactcactttaaaaaatagctctcattatcttaagttatatgaatggtttggatgtactagaatatttaaagcacgtcagctacttcttgaacagttattttagattgtttttttcctgacaaaggaagaccaaggccctgagagaaaacctcctccccggcctcctgtgcacctgctctggggctggaacttgtgcttggtggctcccaagtgccccctccagccgagcccttgccttgccatgaggtttctgttgtagctcacaggcattttaccccacagtctctagctcagcatgaagtgggtgtgtcctggtttagaatactccttcagtaacacaatgtactgaatactccttcagtgacacaatgtactgctgacaccatgtcttttaagaattgaagagccttattaaacctatttaactctacagggagacccaaagcaaatattctgtgacacagagtggaacaccttctctgaaacttcacatttcctgagtcagtggacacgaaatgaatacaaaaacttgtaggattttgggagtgccttgtttcgtccttgagctcttgcagttgaatgttacatctaagaatacctgcaggttcaaatacactcagaataaaaccaactttgtatctactattccaataacacatatttttctttcttcttagtttctagcctataaaaattgcctcctacactgacactaggcctaggcttatttttttttattattataccttaagttctagggtacgtgtgcacaacgtgcaggtttgttacatatgtatacatgtgccatgttggtgtgctgcaccaattaactcgtcatttacattaggtatatattctaatgttatccctccccactacccccaccccacgacaggtcccggtgtgtgatgttccccttcctgtgtccaagtgttctcattgttcaattcccatctatgagtgagaacatgcggtgtttggtttttgtccctgcgatagtttgctgataatgatggttttcagcttcatccatgtccctacaaaggacatgaactcatctttttgtatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataacactttgggtatatacccagtaatgggatggctgggtcaaatggtatttctagttctagatccttgaggaatcgccatagtcttccacaatggttgacctagtttacagccccaccaacagtgtaaaagtgttcctatttctccacatcccctccagcacctgttgtttcctgacttttaaatgatcgccattctaactggtgtgagacggtatctcattgtggttttgatttgcatttctctgatggccagtgatgacgagcattttttcatgtctgttggctgcataaatgtcttcttttgagaagtgtctgttcatatccttcacccacttttttgtcttagagatctaaggcaaatagaatacaagtggagacttgggaagtgcatgaatagtttttttttttttttg[135 bp omitted]cctgcctggctaattttttgtattttttagtagagatggggtttcaccgtgttagccaggaaggtgtcgatctcctgacctcgtgatccacctgccttggcctcccaaagtgctgggattacaggcgtaagccgcagtgcccggccaagtgcatgcattttttttctcagctaggaaccctgcaaatgccctatgataaaagaatctgaggtcaatggatttgccaatatcttttcttcaaaaaatatatgtcagaggcttcagatttccctactgtccttgtcatattctctgccattgtgtttcagttttcctatgttctcctcagatagagtctgcgcattgtcacactttcatctttaacccagattaactatcctgctgagaaaacaaaacgtgcatcctggaagtattatatgttcttacaattgaatcttaataattcagtcatctttttttctctgggctgtggcctatacacagagtctccagaaatggaactgacactttcctttttctggctacaacattataggattatttctctattggctaattttatccacttttgtgataaaggaaggctgcttgaaggggtctgtaatggagatggactaccttaaccaacatagataatgttctagatatgtatttctcctgtatgttctatctggatatatttattgtgtatttctcagagagtaggaattttgatgacttatccaggaaaggatctatgtcaattttcacccaaagaaatataaatgagtttggggtctatgagatctctcaccctcacactagttcagacatgccctttctgtttatttagttcagatttacatataacaaaccacacagccaggctcatctaaattgccacatgcttgtttaaacacattggagcagcattaatcctcacattaatctcagagaatcttggttccagtccactgtttacgttagttgagagcagcatcagggacacactggagtggatatttcttcccgaaaaaagcctcactcccaagtatactaaagagttgccatggagccattgtgtggttggatttcttcttatcagcctgtcatggaggatattttgaatgatgtagactttacacttagatggtaatgactcccattgttgttgaaatggctggcagcccacaatcctgtttctcctctcaactcacctgaatgtctccaagaatcccatgaacctcaggactctccttgttagatgactctgaggattgttagtctgctcagtgctacacacagaggtagctaatagaggattctcagtccactgacatgttgggctcataacataggacacatatccaagagtggccaattcatggcaatgccaatagatatttaattgaagaggcattatttttagtgcatcggagtgtgaaagcttcatgattcatggcaataaagccacagactgaatgctttgcagaagtgagctcattgttagaagaggcctgcccaccaagaagtcagtctctttaactaaagcacttgaaaaatggtgtcctgagaccttgtgaaaattcatttcctggagtaaagaaaggggaaagctattcttaaatcattggaagaaaccatatcagaaattttatcaacacagcagtcaaattccagtaagtcaatgcttgggtttatgtttcacaactcaggaagcaataaagaaatctacataatcggaaggctactccaacagagggaattttgacctatttaattaataggccagtattcactcaaagacacactcctgtgagatctccaacttaaacagatctctgtaacctgaagaagttttctcaacagattctttttctctagacactcgcaaatgcaaaaatacattttgtatatttgtgcatgagtgatctagagaagtccttgtcttgttaatgaaagttcatggaaatatgataactgcatcacttactgtgaactcacacttcactagtctcaaaaatttctcacccatgtgatggagcaatgggtgcctctaagaatatgctgatttttggactcaacatgttctctttgcttgacttatagacccatgtctgacatctgagacacaccctggggagctgtctccagataacaataatgtaatcttcttcatgaacacaactctgcattccccacatacctcagccacaccttaggggagaggtgttaacttcaccgtccaaaagcattttataccctggagcctgaaaaataatttggatgtgataccaccttgtacttgtaatatagagggcagaggtcagcatccccctggatttgaatgtgttttattgttgtatttattttcttgcagacatgaattacttgcttgacaaaaactacagccatgccagttcataaaattttccttattctgattttcccatctgtggcatttgaatttcaatattaagtgagcgatgtgcatacctcacaggagcaattacaaaataactctttttagctccttagtgttactcaaatgctgcactgtccttactgccaaaaatcttctggaaagttttaagtaaaactgaatcatatgttgcatccttaagttaaaagttgcataacattcagaaacacatgaacttttttgctgaaggtacatctgctaaaacttacaacacagggtttgctttctcaaggacacaaacgttatcaccgtatgacttgattcatcaaaagcccacctattttcaattacatcttcaatattagactccgattcattaaatgcagatgtagcaaagcattctaggggattgacgtgctatgcagaagcattcaacaggatgttaaagatgccttcccaccaaatcttcctaattatctttttattgtcatcaacttggaaattctttattttagaagagacatcagaaaaaagcagcttcaaacattgtcaaaaggccttattatttaacgttatcaacaaatgcagcagtaactccaggatgtcaattcacaggtttatgaagtgaaaatggatgggttacaaaagttgttttgagagaacgatcctgtagttgtagaatcaataccaagggtggcatcagtgtaaggttgaagtggcagtttctgggatgatgtccttgcaaaagtaatttttttataaggtggtggtgtcttcttcccaagattgtggttaagcagagtatatttatgatagttcttgttatcaggaatatgggcttaagaaccctccttcatggtcactcctagtttcatttgtcagagttttaatacaagtggctccattttgattttgacaactttcccactctctttctaacactactggggggaaggtgaccctgtgttagcttgaacagcacaggataaattccatatccacatcccattttgaccacacaagctcatcctcttcacaactattggccacttgcattcccaagtgagtctctacacaacacagtggagggttctgagcaacgggagagaaggaagtcccatcagcctctcccacgtggctgcaggagccacagtctgagccccacctgagctgcagggaaagggcttgagcagtggactttttacagcaagaaccacatctccactttacagggatcaggaacagcaaaaggaaaatcaacaactaaaacaactaacaagaaatagaatgtgctaggagcaaaagcagcccctgatcagcgctgatactgatttgcatactttagtgtcagaagaagggtcagaaataaaacctgtgaggttctacgtgaccctgaccctggcccagcctctctcttggctgaggttagaattcctaaatactgttttcttcagggaaccccactgaggtccctgtcctgagtgtgactggagaagactcaccgggttccactcagcttccacagggctgtggccctggtgaccactggcagagggattgttctgcatttagtgcctgtaagaaggtttcctcctggtacaacaaaactgtggtatttcagagacgtagagctaggcacagcatcatgaaataagggagggtccctggaggaaacatgtagatgtagaggcagccccacaccctggcagtaaaccagcctctcatctccacccacacctgctctggggctggccctgtgcttcctgcaacctgctcttcccctggtggtcttgagtcccccttgtggtcctgagtcttgctggcggtcctcagtgccctgacagcaagttttgtgtcagggctcacaaggacacctcctcactgagtctttcacagtaatactcagccatgtcctagccagccatggagctgagcttcagaaagaactggctcttggttgagtcattgttgatggagatgcagacctgggtaaagggtgcatgatgtgtattccttggtgatcttgatgatgatcttggtgatcatgatgtgtattcctggtaactgtgccccagccattctaatctgttgcctaggggatggtggattcagctcaaataatattcactggtaaaaaaaagaacccagacacagcacaggtggagggcagtgtctgagggcctcatgggtcctggacctgactcctgcagctgcacctgggacaggacacctggaataagagggaacatcctggtgagtcacacaacgagctcacttgtccccatcaccccatttcttatttctagattctgacactgaaaaactgtcatccatcaaagacatgtaaaaagttgatctaattgagagacagattaacgcctttcatggggaaattgtgctcaggctgatgacagagcagtatctagggaggagagaggctgacaacacccagcattgttctcctaaacagagtttgaggagaagtgtgcatgtgccaggagccccacatatataaggggtaggaaccacggcgaccctctgtctcagagcctcttctcaggggtgattttcctgctcaggcatcagatcaatcacacagactcttcctcctctgaaagagcatccctctgctgagtgttcaaggcatccattgtcaccccaagggcaggagggcaggtgacagaaacaagcaggtttgctggacagagagggaagaataggagtaggaacgggggaaacacatggtgcccaggacctgtggcctacagtcctcctgcttctttcgggttcccagctggagatagtacactgtgaactttcctggcagtcgtgcttctggagggaggattaggggaaatgctgagtaagttctcctctttgctgagcacagagttttcactctctgtggtatgtggttttatccctccccggttgagtcacccctgctcatccctccctgttgctccccaggttttgcttctttgcttataggagaactgacaacagcgaggcaagggattgggttaggaggccaagggcaagtgtggctcctcagtgaaaaatgtcaaatgtaaagttgagttcccttcctctttcctataagaaaggctagggtttggaaatacgagggtctggaggaggtgacaattggttccctttcccccaaaagaagccagccaaccagaaattgcttcttaagagcctgatttgagactgagactaagaagtccagtggctaagaagtggtctttgcccccagagagtttgaggtctaataaattgttatattgtgtggcagagactgtgtgtgttatggaaggacgatgggaaaagatgggtatgatgagctgcagctggcagaaaactcttggaatatgctggttttacaaggacaaataggatatgtgtgtgtgtctgtggaaatggagcaggaagtgtgtagcatctgaccatggagtcacactgacctgggctcaaactccagcttctcagttacattcattcatccatccatctattcattcattcagcttatagtgatggagggtcaggaactgttgtaggtttggggaacacaacagacaacacccctattctatggaactttcattgcagtaaggctgcagagtgaccttgggcaactcaaccgcccatcccttagctttcaagctgcagtactgccccccaccttacaggctgtggattccaaagagccgtaatgatgatgataaaataagtactatttattcagcactaacaacctaccaatactctgctaagcattttgcaaggataatttcctctactcttcacaacttccccaggggacagggttttacaggtgtggaaactgaggcttacagaattgaaataatgatccagaatcaagtgacagagacaggattcaaacccagcaatcataaccactgcagtcaaggtggcccacctgaagtgtgttgggagtggctggaactgacacctgaggggctctgtgacccagcagaattctgtgcttttcctggggagagcttcttctaggaagaggtggccacgacagctgatagaaggctgtgacctgagtgcaagcctcatgccagccaccttctgtatgtgagaccgtgctgcttgccaaaagctgttagttccttccattctggctggctgggagagatttctcatggttgcgcgtggggagagttgacatgtttatgtggaggtaatgactgtgttggctccttaaggaagaattaggatgagagcccagttccctgtttggggacttgaacttagattctctggtggcctggaaaaggtggataccttgcaggttaatgtaggaagttaccatcccatgacaattttattttactcttctttcctttgcccattagctactgcaaacttaaaattacctatagtggagagtggtagtagtctacttcaaaaacagcaaattcccagggatttgccctcacttttggaatcttagctaaatatttttttctctatgggatcaccctcttttgcatctgactgaggcaagccttaaagatcaagccgatgtcagagcagaggaactgctgtttggtaaggatgcctcagagatgaaaaggggaggagggtggtctcagagaaccagaagaggattgggaaagttggccctggaagaggacttctcactccttccccaagccttgccctgtctcttgacctcccttgactccctgctcttccaggtcagctttgtccatgcgctggactgaatattgccagcaggtagtcataaggacccatgcaatcccccaaatcaatactgaatacaaagaaagctgttgtttctgcttctctggcaggagaataggaagtgaccactggcttgagaagggctatgctaccaaagtaaaccatcacgggactggttctgaaatgatccaattccctgtctctttaggatgaatctctttaatccaagtacattaaattggaatgtagtgatcattcagattcaactaatgtttattttatgaagtggctactatgaaccaagcactgggataaagctttagtacagttaggccattttattcacttgaagagcaaagggctcaaagtttacctttccatgatctatgagaaaaaaggtttaccaagcaaatgagtgctatatgcaagattgtcaaggtgaggttttaaaccacttacaaggacaaactgcttcccagaagcctgccaatgcttcttaagtactcccttgtgtgggcaaacacagatccaggagacaaacgggaaggacctaggacaaaaagtcagcaggctagattccacttctagttctgcactgaagtagtcacatgcctgctattgcatggtgtcatctagtccccatttcttgtccacaaaactagcatgagccccccacaaaagccttgctgagcaaggggttcagtgtgccccttttgcataaaaaagggagaaaataagaataaacatgcacacacatttgtatttgcttccatgttcacaatgacatccataagcttattcaagaaattaataatcatggttacctatggggagtggagaggtaggagtgagacctgggcagatggagacatagatgggaggaagattcctccccaaggatatattgggttttgttgaaccgtaggaatacattacccatttaaaaatttaattcgtgggaagggcctcctaaaatccagacataatactatgtagaacttccaaacaaaaagaaagtcacgttggcattacctgttctattatactgatgttggctcttcctaatcattcgttttttttctaagtgctcccactatccttaaattgttcatttctagattcttgcctggggtggatgatattcctcagtgccaggtcactgggcagagatttttcactgtattggatctcttctgctttctctttcttatttgtgaaaatatgtgtgcatacagacatacacacatgtgcacacacacatgcacgtgcacacacacacacacacacgagctgactcccttaaaccaggtagctgacctccatgggtccacactctaggtccaaactcaactgaaggaaagtgaactgaaggaggcatttgtgaatttgattctccaacctaaggactttgcttttcaaaccaagggtgttcagaagggcacagactgcagaacatgaagacttctgttaccattaacatagttccctggctccatgaggcatgaacagcctctctgagaatgcaccaacaactcagcacgccttgtaaacaggccataattatagagcttggttttgactttttttccagggccttaaagttgatatatttttacatttccctggattggagggtagggggcatggctttgggtttagcatttgctctgctgattatctgtgaaaaaccttggcagtgctgtggggaattggtgcggtggggaatggaggcttgaagagtcagttgacctgcagaccaagatagagctgaaggtggaaacttggatgaaacctttaggctgtcccttccagtcctcagcgagaacctagggatcaccatgtgcaatgctatgtggatgtggcgtgtcacaccacaggcaccagagggagtttctgaggttgcagaggtgactgggcaatatcttccaagctccctggtgtattctggtttggccaagcaatgtgttgctgcaagagctgaaggaaaagtcaacacatgggaaggaaaagcaatccattgggtgactacattaatggatggggagagacttctaggacacagactttggcaaaatatggtcatcataaagaaaatggctgagtatatctctaggctttcgagtattgtcatttgcactgtgttatttttccctccaaggggttatttggggaaaattgtatacatcccagggttgaacttccaaacaaatgcaagctgcaaccagccccagagctacatatgggcatgtccctagggtggctttagaaaagcgtagttctctctgtgctcagctcaacctgccccctctgccctgagacgcacacacacacacacacacacacacacacacacacacaccactccccccgcccccccacccccacagttccttcccttgcagaagagatgagaaaacctctctttctttctactgtagagcaattcctttggaggacaaagactgttgcaatgagctttttgtctcggcagagtttgctaatacatttaaaaatatttattgtgaatgggttggaggaggttgctgtgggaagccctgtgtgttatgtatacctttgcatgcttcagcaatgcctgcccagtgctttggggactcagcagatgtccacagatgatgatagtgactttgaggaacccccatatttcttgaatttttcataatgagtgtagaaagaggtcccagcactggaaaggaaggtggggagctgttcccctcattgcttacagtggtctacctcttgtaaacacaaacctctaccttgaggagcacctttctgaggtcaagtgtgcttctgagagggcaggtgccagccatgcatcacaatctagggaggtgggaagtgtgaagttgcatggaggcagggaacctgggctctagacacgactctgcctctaacattctgtggaaacctcaggcttctgtcactttgagccttggttttccatgggtaaagtgagaccatggagacccacctcacataattgttgagaggattgtttaaaatacatgttttggccaggtgtggtggctcacacctgtaatcccagcgctctgggaggctgaagcaggaggatcacttgagaccaggagttcgagatcaacgtgggcaacataaagagacctcatctctataaattttttttaaaaaattagccaggaatggtggtacaagcctctagtcccagctacttgggaggctctggtggaaggattaactgggtccaaaagttcaaggctgcagtgagctatgattgtgccactgtactccagcctgggcaatagagtgagaccccatctctaaaataaataaatttaaaaaattaatacatgtggaacatttcaaaaacatgaaataatagggaaaacaatgtagtgaaacttcattttctctcatccaacttcagtaattgccagctcccagttttgtgtcatctctattcccactcccagccccttcccattacccctcaatgccagaatatgaggacttcatggcatggaacagtggcatggaagtgccctccagagtatctaacacatagcagatgcttagaaaatgtttgtggaatctgaactatttaatagtacatgctttataattattacctactgtagcatggcgagagggtacagtatttctcactgccttatggatgagatgacctagtctcaggtcaagtgacttgcctaagatcatgcagccacataggaatatggtgctatcctagaaccatggtttccaaatcccacacgtgtactcttggcagtatgctctgctgcctctgtgttgatttttccttttgaatatcttcttagagaggaataggagacttgtaaagttttatgtgggctcacagtttaaagagaacctgtttatggggttgtaataaccatgtattcacggacacaactgcttatgtctgcaaaagatcagcaattcatcagacactttgtgagttattttcttctctgattgtcagagtgaaaggtgagtaagatcacttctctcagggagctcacagtcatatgcactgagtcacatgacatagagtggagcgtgatgagcgtaatggcaacagcatgaaccaagtactgagggtgcatggaggaaggttgtttaactcctagcttctgtcttcattaagaattatcaatacttccagccatttatgacaaacccacagccaatatcatcctgaatgggcaaaagctggaagcattccccttgaaaaccaacacaaggcaaggatgccctctctcaccactcctattcaacatagtattggaagttctggctaggacaatcaggtaagagaaagaaataaagatattcaaataggaagagaggaaattgaattgtctttgcagatgacatgctcctgtatctagaaaaccccatcatctcagccccaaagcttcttaagctgataagcaacttcagcaaagtctcaggatacacaatcaatgtgcaaaagtcacaaacattcctatacaccaacaacagacaagcagaaagccaaatcatgaatgaactcccattcacgattgctacaaagagaataaaatacctaggaatacagctaacaaagggaagtgaaggacctcttcaaggagaaccacaaaccattgctcaaggaaataagagaggacacaaacaaatggaaaaacattccattctcatggataggaagaatcagtattgtgaaaatggcccacagtaagttgtagactcaatgctattctcattaagctaccattgaaattcttcacagaattagaagaaactattttaaaattcatatggtactaaaaaaagagcttgtataaccaagacaatcctaagcaaaaagagcaaagctggaggcatcacgctacccaacttcaaactgtactacaaggctacagtaaccaaaacaccatggtgctggtacaaaaaaaggcacacagaccaatggaacaggatagagaactcagaaataagaccatacatctacgaccatctgatcttcgagaaatctgacaaaagcaagcaatggggaaaggattccctatttaataaatggtgctgggagatctggctagccgtatgcagaaaattgaaactggacccctttcttacaccttataccaaaagtaattcaagatggatcaaatagttaaatgtcaaagccaaaactataaaaccgtagaagaaaatctaggcaataccattcaggacataggcacaggcaaagatttcatgacaaaattgctaaaagcaatttcaacaaaagtgaaaattgacaaacaagatctaattaaaccaaagagcttctgcacatgataagaaactattgcagagtgagcaggcaacctacagagtgggagaaaatttttgcaatttatccatctgataaaggtttaatatccagaatctgcaaggagcttaaacaagtttataagaaaaaaaaatactaaaaagtagggaaaggacaggaatggacacttctcaaaagaagacattcgtgcagccaacaaacatatgaataaaagctcaacatcactgatcattagagaaatgcaaatcaaaaaccacaatgagacactatcttacaccagtcagaatagctactattaaaaagtcaaaaaacaacagatgctggtgaggttgcagagaaacaggaatgctttacactgttggtgggaatgtcaattagttaaactattgtggaagatagtgtggaaattccttaaagatctagaaccagaaataccatttgacccagcaatcacattactgagtatatacccaaaagaatataaatcattctattacaaagatacattcacatgtatgttcattgtagcactattcacaatagcaaagacatggaatcaacccaaatgtccatcaatgatagactggataaagaaaatgtgatacatatataccatggaatactatgcagccatagaaaggaatgggatcatgttctttgcagggacatggatggagctggaattcattgtcctcagcaaactaatccagggatggaaaacccaaacaccgtgtgttctcacttataagtgggagctgaacaaatgagaacacatggacacagggaggggagcaacacacactggggcctgtcaggagatggaagggggtagggagagcattaggcaaaatatctaatggatgctgggcttaatacctaggtgatgggttgataggtgcagcaaaataccatggcacacgtttacctatgtaacaaacctgcatgtcctccacacgtaccctggaacttgaaataaaaataaacattttttaaaaagagctatcaatacttccaaaagttgtgaccctggaaccatggcaatttgtactcacgcttatacaatcctagaagctgactactaggtttaatcttttcatgaactaggagtcttcattaggtcaatgtaccagattaacaatgaccacaccaggagaggtgccatctatttatctattaatcaatattaacactgaaattttaggccaactgtaaagagctaaccaactgtgaagtgtgggaacttgatctacacttctgacagcaattgcaaattcaagggtcccgataatttgttagaaggactcatagaactcactgaagtctgttgtacttaaggttatggtttattacagggaagggatgcaggtcccttcttcaaccaagggaagaaatgcatagggtggggtcccagaaagcagcaaacgcagagcttccgggtgtcctccttccatcaagtcaggacagtgtttctttctcagcatcggcatgtgacagtaagttcagagtattgccagccagggacactcatgcaagccttgtgtccagagtttttactgaggcttgatcacataccacctgcatggttgaccttcagtcaccagcccttctggaggtagacctgatacaatgtggctcaaaacccccttcatagatctcgttagattgtccagtggccaaagccccaaggcaaacaaagacactcccatcaggcagggcattctatggagatcacttcccagaagctgagggtgggggccagctgctgcaaaggcgctctttagttgagcggggtggggggtggggggtggcgggaccagggtgggaccagggaccggaatgtggggcaggatgcagagtggagaggctcgctcaggtgaaggcactactgtgtcaccattggctcctgggtcctggctccaggtggggagaagcagtttctctttctggggcaacaaataaaatccctccgggcacaggagtgctcattgctggttggttatgccagtctgtctctatttttagaaagaaccacaagaaggaggaaaagaatctagagaaataagtacagttggttcctccctgaggcagaagctgggttctgtgggatgaagcacagatgcaaagccattgtcctgccacccagcagtgcagtcggagatggatggcatgaatctagaataccatgggaatgggtccttgccctgggccagtaaacatttgagactcagagccaggagataggatgagaagattgcagtgatgagacccacaaagggcagcagccatctcttaagggatcaacttggagaccaaatccatcacttcttggaggtccagtagcccctgcaccctctgcgctttgcagagacatcctgcagttcagggaagaaacggagctgaagggcatgtggaagaagaatgtcacagagatgcaaggggttggattattggttggcttaaggtcaaatcattatttgctgcctgaagaaaaaaaaagaccttgcttagggacagaagtacttgttctggtcttaggtcagatgagggggtaaagcaactcttccaactgtcatggaattgggtattttgccaccaaaaatttcatgatccaataatgatgatcataatcagtgaatgctggattaaactgaaaatagtacaggacttctctgagcctttactatgaatttgcccattaaattccctaaaagagaaggagaagctatgcgtattgaatatctgttagtacctggaaaatccagttttctgtttttcagtatgggggagaacagaaccccgcttgagggttgaaacaaattcctctgaacacagtatggggaattcagaagagattaaaagaacatatgattggaattattcagatctggatgagaagcctgggccagctgtttgactagtgtactagtgtaaccctggtcaagcaaccaaacttcttgggtcttaattttcttatgtataagatgagactaataattcatatctcaaagttattgagaggaataaatgaaatcaggtaagtaaagaatccttaaaagagcctgtaacatagtaagcatataagaaatggatggatgcatggatggatggatgcctggatggatggttagatggatggttagatagatggaaggatgggtagatagatggaaggatgggtagatagatggatagaatgatggacgcctggatggataggtagatgggtgggtggatggatggaaggatgggtagatagacggatggaatgattaatcttggcccactaccttagctagatagggtcattgttctagcacatacccagaccatcaagcatgagtttgtgtgtatgcacatgcttgtgtgtgcacatatgtgcataaatatatatgcaagcactcatgcatgaattttcctgaaccttttccaaagacagaaaagttagaagctcttccaccatgcttccataatatcctggcagtggctatatcacaactactccactgcactgtaactgtttcatagcccatctatctctgctagaacactaagcatcctggaccacaaaggtcatagcccagtccctgcaacaccatgaatgcttataaaatcattgtaaaatgattcttctcaattgtctaggcaggtagggccactgcaccagtgacatctgagaggcctgacccgaccagcctatcagtgtatcttaacccctcttgagggtcaaaacaaattcctctgaactcagcactcactagtgagttggaggaggctgatgacagggctggtgtctagagtaggatgagatgagctctgggagccataacagtgcagaggttcctgccatcagcatttcagggtatgggctgagcatttcagcatttcagggactgggcacagcagctcacacctgtcatcccggcacttaaggaggccagggcaggcggatcacctgaggccaggagtacaagatcagcgtggccaacagggtgaaaccctgtctctactaaaactataaaaattagccaggcgtagtggcgggcgcccgtaatcccagctacttgggaggctgaggcaggagaatggcttgaacccaggaggtggaggttgcagtgagccgagatcacaccactgcactccagcctgggtgacaagagcgagactctacctctaaataaataaaaaaatgtgccacggaagcctgctccgtactcacctcaccaaatgtcagagtcagggacacagggcatgccccacagggtgggatgacaggaagtccacctgggccctgaccctcctgaccgcccctcatctgggggtacactaaccctttcggactgcagggtgccctgaacattaggactgtggggtaccccaatcctttaggactgtgaggtgccctgaacatcagggatgtggggtaccccaaccatttaggactataggctgccctgaaatgacggccagggggtaccctgaccttttagggctgtgggacacactgacttcttaagactacggctggtgcctacaggagtccaagggataccaggcctatgtggggagggggcagaggtagaaaagcaatgggggaggtgcggggcatcggctgtccctgccctggagaggatggggccagccaggtaggtgtgcagccaggaccactcaaggactcaagggagagatgcggtcggggagagaggagtgggggacggggagagaggagggggggatggggagagaggagggggggacggggggtggggagagaggaaggggtgccggggagagaggaaggggtgccggggagagaggaaggggtgtctgggagagaggaaggggtgttggggaaagaggggaaaggggacagagggggcggggacaggagccggaaccggggtcacacgtggaaggccaggaccctgggtcaggagtgggagccaagacccggggtcacatgtggggctggccacctgactggagtgtggtcttcagtcatgctgtcaccaggctgtgggacctcagggatgcagtgagggagccaggcctcgggggcccagcctggattctgccgactcccatccctcagcctcaccaagaggccactgacttcgtcactgcacagagatcccatcctggggttctggggcctgtgcaggagaaacacaggtgcagggccacgtgcccacaccgctggcatctgtgctccacaaccaaactcctagagccatcatcatctctgggctgcagtgcccgccggtgacaactccctgaccacctcgctgtggtcacactcctgtccccgtgggtagaaaatccagtgatgcgtgtagacaaagagccctctgcacacctggaaccccagcgccttgggaggcccaggtggggggatcacctgagctcaggagtttgagaccagcctgggcaacatggcaaaacctcatctctaggaaaaatttaaccatcagacggacacggtggtgcacacctgtaatcccagctactaggaaggctgaggcaggagaatcgcttgaacccgggaggcagaggttgcagtgagccgagaccgcaccactgcactccagcctgggtgacagagcaagaccctgtttcaaaaaaaaaaaaaaaaaaaccatttagccatttgcatgatgaggaccatagagaataaaaaataaaatgaaaagaatctcaacaactcactctccaattcctttaggaaaatgaaatgagaaacatacacatgtaaagtatttagtattccctgcagtttaagaaacagaatccagggccaggcgaggtggctcacgcctgtcatcccggcactttgggaggctgaggcgggtggatcacctgaggtcaggagttcgagaccagcctggccaacatgctgaaaccccatctctactaaaagtacaaaaagtagtagccgggtgtagtggcacatacctgtagtcccagctactcgggaggctgatgcaggagaatcacttgaacccaggaggtggagcttgcagtgagtcgagatcgcgacactgcactccagcctgggtggcagagcaagactctgtctccaaaaaagaaaaaagaaaaaaagaatccttgtcagtctacggacaagaatgccagtaccacaccatcatgatgagggtcacttctgtgggacacacaagacacagctcacacctgcccctacacacagctatttctgaccccaaacagcgaggcagtcacttcagacccaaaaggaaggtgaagcctgcggccctgcaccatccgcgtgccactgcactgacttaaagtttctcacgggctgggtgtggtggctcacgcctgtaatcccagcacttggtgacgccgaggcaggtggatcacctgagctcgggagttcgagaccagcctggccaacatggtgaaactctgtctctactaaaaatacaaaaattagccaggcatgatggcaggcacctgtaatcccagctactccagagactgaggcaggagaatggcttgaacccgacaggtggaggttgtagttagccgagatcataccactgcactccagcctgggtgacacggcgaggatccatctcaaaaaataaataaataaataaagcttctcgtgaatgatgaaaccaaaattaccatcgcgtctgcactgtatggatctgtctgctacaaccagcaggaccacagccaggctgcaactcactttctttacaaaaagcaccagggatgaccaggaattagtccccaccaggtgacactcacagccttacccacacgtaggagccccacggacatatggatcaaatacaatacgagagacacacatctcaccccattctgtgcagccaacacagtgcacattcagcatacggtttggtttgctttttgtttttttctgagaccgggtctcactctgcctcccaggctggagcgtggtggtgcaatctcagctcactgcagcctccaccttctgggctcgagtgatcttctcacctcagcttcctgtgtagccaggaccacaggtcccacgcccagctaattttttttttaagagatagggtctcactatgttgcccaggctggtcttgaactcctgggctcaagcagccctccccatttggcctcccaaagtgcttggcacagggtagattttaagttaaaaatctcacaaaacaggccgggtgcagtcttatgcctggaatccagcactttgcaagcccgattggggtgttttttttagtagagatgggttttcgccactggaatccagcactttgggaggccaagtggggagggctgcttgagtccaggagtttgagaccagcctgcagagcataggctcagagactctgtctccatgaaaaaaaggcacacacacacacacacacatgcacacacacgcacaggtgtggtggtggacgcctgtagtcccagctatttaggaggcagaggtgggaggattgcttgagcccaggtggtagaggctaaagtgagctgtgatcacaccactgcactatctagcctgggcaacacagcagaaacgtgcctcgaaaaattaaacgtttacaggccaggcacggtggctcacacctgtaatcccagcactttgggaggccaaggtgggtgaatcacctgcagtcagaagtttgagaccagcatgaccaacatggagaaaccccatctctactaaagatacaaaaaaattagcagggcatggtggtacatgcccgtaatcccagctactcaggaggctgaggcaggagaatcgcttcaactcgggaggcagaggttgcagtgagctgagattgcgccactgcattccagcctgggtgacagagcaagactccgtctaaaaaaaaaaaaaaaaagtttagaaaacaatatacataatatgaattttttttcctaagacagaatttcgcttgttgcccaggctggagtgcagtggtgcaatcttggctcaccgcaatctccgccgcccagattcaagcgtttctcctgcctcagcctcccgagtagctgggattacaggcatgcaccaccatgcctggctaatttctgtattttagtagagacggggttttaccacattggccaggttggtctcgaactcctgacctcaggtgatccccctgcctgggcctctcaaagtgctgggatgacaggcgtgagccattgtgcctggccatgaatccagttttgatacaattttgagaaacacaaatgtctatatacagacatacacaggtatatctattatccatgcatgcgtgcctacacacactcacaaatgtgtgtgtgcatgtgtgtatacttatacattttggtgatatttggtgatattcttctagccccatataggactgcaggaacataaccaaatcttttttttttttttttttgagatggagtcttgccctgtcacccaggctggagtgcagtggcacaatcttggctcactgcaacctccacatcccaggttcacgccattctcctgcctcagcttcctgagtagctgggactacaggtgcctgccaccacgcccggctaaatttttgtatttttagtagagacaga[136 bp omitted]ccgggtgcagtggctcacacctgtcatctcagcactttgggagaccgaggcaggcgtatcacctaggtcaggagttcgagaccagcctggccaacatggggaaacctcgtctctactaaaaatatgaaatattagctgggcgtggtggttggtgcctgtaatcccagctactcgggaggctgaggcaggagaatcgcttgaacccaggaggcagaggttgcagtgagccaaggttgtgccattgcactctggcctgggcaataagagcaaaactctgtctcaaaaaaacaaaacaaaacaaaaagaaaaacaaacttgcaaacctattataaaacagccaccccctggctgggcacaggggctcacgcctgtcatcacagcactttgggaggccaaggcgggtggatcacctgagttcgggagtttgagaccagcctggccagcatggagaaacccccatctctactaagaatacaaaattagccaggcgtggtggcaggtgtctgtaatcccagctacttgggaggctgaggcaggagaatcacttgaacccagaaggcagaggctgcagtgagccgagatcttgccatcgcactccggcctgggcaacaagagcaaaagtctgtctcaaaaaaaaaaaaaaaaagaaaaaaagaaaaacaaattttcaaacctgttataaaacagccacccccttggcctgacgtcatgcctcacgcctgtcatcccagcactttgggaggctgatgcaggccttgaactcaggattttgagaccagcctggccaacgtggtaaaaccctgtctctaccaaaaatacaaaagttagccaggtgtggtggtgcatgtttgtaatccgagctagctggaaggctggggtggaaggatgacttgaacctgggatgcagagtttgcagtgagctgagatcacgccactacactccagcctgggtgagcgagtgagactctgtctcaaaaaaacaaacaacggtcactcccaaccaactcacattaaaccgttctctcaagggctatggataaacagttcgaattttaagaacacaggctgccatgagacattttaaattttttttgtcagcagagggtagaaagttacaaaactcaatgacaggaaattgcaaatttctaagattatagtaggcaaaatatcaacgtaatctttttttttttttttttttttgagatggagtctcactgtctcccaggctggagtgcagtggcgcaatctcagctcactgcaagctccacctcctgggttcacaacactctcctgcctc[211 bp omitted]aggtacacaggtaaataatcagattttttttttttttttttgagacggagtctcgctctgtcacccaggctggaatacaacggcatcgtctcagctcactgcaacctctgcctcctgggttcaagcaattctcccacctcagcctccagaacagctgggattacagccatgggccaccacgcctggctaattttttgtatttttagtagatataggttctcactatgttggccaggctggtctcgaattcctgacctcaggtgatccgcctgccttggcctcccaaagtgctgggatgacaggcatgagccaccgtgcccagcgtagatttattggattctaaaatgcacaattctctatgtttcggtgtttctgaaaccaaggtcatctcaccatccacaggaatctttaatagtttttctttttttccccaacagttattacatcactgatgcatcttaaaagtcactggtatttgaaagtcaagaaaacaggaaactctcaaaaccaagttctgaaagccacagggtgtttctgctaagctggctgcggcctcctgtgtatttcgaataccagccacagtgtggcggccacatctcacccaggcaggcctccataacagcttcagtaccaactgagtggcgaagttacatataaaaacctgaaagaggccg[138 bp omitted]gtggtggtgggcacctgtagtcccagctactcgcgaggctgaggcaggagaatggcgtgaacccgggaggcggaggttgcactgagccgagattgcgccactgcactccagcctgggtgacagagtgagactctgtctcaaaaaaaattaaaaaacaaacctgaaagagccagtgtccttatacgaaggctggaatgtaacaaagacccaccaagagttttgcccaggcctttcctgggccttgaaaatatgacaacgaaggaattcctaacaggacctgtttgggtttacgtagttttactggggatctgaaaaactccccttatctcgggtaatcaccacagcacctggacccacctacattaagtcaatttactgaggctccagagaaaggtcttcaggactcagacctttgttatagattagaagaagttaatgccttttttcttttttctgaggccgaatctcactctgttgcccaggctggagtacagtggcaccatctcagctcactgcaacctccatctcctgggttcaagcaattctcctgcctcagcctcctgagtagctgggactacaggtgcccacgaccacacctggctaattttttgtatttttagtagtgacagggtttcaccgtgttagccaggatggtctggaactcctgacctcaggtgatccacctgcctcggcctcccaaagtgctgggattatgggtgtgtgccaccacgcccggccccgcttatgtctttagatgaatgcacacttacacataggcatataaaaggtatataagctctggaaaactttgtaattttgagtcggtctggtgataatttccagaccttctccctgcacctggttacagaaataaaacctatcttctctcccagttcatccacatctcattattgggccgtgagaataagcaggctgagattcggtttggtctgggaacaagagaagtgacattatcctaccataatcagttctttttccctcttttcctctgtcaggacatagtatcaataacagagaagacagtaagacactcaccacctcattagcaagaacgttaatccccaccgctcccctccctcacctcccaaaaccactgggagggcactgctggggtacacgtggccacgtcaggaaactggaagaaaggaaggcagggctgggcgcaggggctcacgcctgtaagcccagcactttgggaggacgaagcgggtggatcacctgaggtcgagagtttgagaccagcctgaccaacacggagaaaccctgtctctactaaaaatacaaaattagccaggcacagtggtgcacacctgtaatcccagctactcaggaggctgaggcaggagaatcgcttgaacctggcaggcggaggttgcagtgagccaagatcgtgccactgcagtccagcctgggcaacagagcaaggctctgtctcaaaaaaaaaaagaaaaaattcttacagagaagagggtctcgcgatgttggccaggctggtctcgaacccctgggctgaggcaatcctcctgggttggcatcccacagtgctgggattacaggcctgagccactgcgctcggccatctatggctttttatccccactataagacaaggaagaggcatagctcaggagtgagctgagtcgacaccaggtggcgcccaggtcccgagcctgctctgtccgcaatgcagccttcatcccccgacctgcacgtcccctctcatcccagagcacaccctccggggccatcatccccccacccgcagggctcaccctccaaaggaccccagggcctgcgtggtggtccgtggactcacttaccaaccctccttctgctcggcctcctgaagcccttggatggctcggagggcacggggaccaggtactaaaggataatgatggctacacacatgtccctaagctcactacctggggacgccctcattctgtctctcagtctattaacaggggagatggagcccaggagcccaggagacagctacacacacacacacacaagcacacacacgtccctgagttcaccacctggggatgctctcattccgtctctcagtatattaacggcagacagagcccaggagattgacggctacacacacacacacacgtgtccctgagctcaccacctggggatgcactcattccatctctattaacagggcagacagagcccaggagattggtggccacacacacacacacacacacacacacacacacacacacacgtccctgagttcaccacctggggacgccctcattctgtctctcagtctattaacaggggagatggagcccaggagcccaggagacagctacacacacacacacacaagcacacacacgtccctgagttcaccacctggggatgctctcattccgtctctcagtatattaacggcagacagagcccaggagattgacggctacacacacacacacacgtgtccctgagctcaccacctggggatgcactcattccatctctattaacagggcagacagagcccaggagattggtggccacacacacacacacacacacacacacacacacacgtccctgagctcaccacctggggatgccttcattgtgtctctcagtctattaacagggaagacggagcccgggagactgacggctacacacatgcacacacagacacacacacacacgtctctgagttcaccacctggggacgctctcattccatctctcagtctattaacagggcagacggagcccaggattgatggctacacacacacacacacacacacacacacacacaccttcctgagctcaccacctggggatgctctcattccatctctcagtctgttaacagggcagacagagcccaggattgatggctacactcacacacacacgttcctgagctcaccacctggagacgtccagcactcctcccacagcatcttcgaagctctcattctgtctctcagtctattaacaggggacacagagcccaggagaggtctctgtcccgcgctgtcctggcaaatctgggtcccgattctgagttcaatggtgttaaaaaataataggctatgtccccactaaagtctaaatatagccaaccccatttacccaggctgtgcacatcacaattccacttgtagaggctcctaccaccatcttaggtccatccccagaaggtccatcccacccccaccccgcccccgtcaaggtctcactctgtcacccatgctggagtgcagtggtgcaatctcagctcactgcaacctccacctcccaggttcaagcgattctcctacctcagcctctgcagtagctaggactacaggtgtgtgccaccacacccagctaatttttgcatatttagtagagtcggtgtttctccatgttggccaggctggtttcgaactcctgacctcaggtgatccacccacctcagcctcccaaagtgctggaattacaggcgtgagccaccgtgcctgacctcagacaccttttggtgcttctggtttgagatggggtctcactctgtcacccaggctggaccgcagtgctgcaatctaagcttactgcagcctccacctcctgggctcaggtgatccttccacctcagcctccaaagtagctgggaccacaggcccccaccaccacgcccggctaacttttctttcttctttttttttttttttttttgtagatacaggttcttacaccatgttgcccatgctggtgtcaaactcctgggctccagcaatcctcccacctcagcctcccaagtagctgggaccacaggcacccaccaccacgctggactaatttttctttttttatctttttcttttctttttttgtagatatggggtcttaccatgttgcccatgctagtgtcaaactcctgggctcaagcaatcctcccacctcagcgtcctgagtagctgggaccacaggcacccaccaccatgcccagctaaatttttttttttggggggtagagaagggatcttaccaagttgcccatgctggtgtcaaactcctgggctcaagcgatcctcccacctcagcctcccaacacgtaaacgggtgctacatttctgcacaatccccgcagtctcccttattctgttttacaactactcccacataaagtaacatagaaaggtgagccccattattcctttagaaggtagactggagcttgcaagaagctgtaggataaagattcagaggtcaactgagataaaatgaaacacccaggtgattttaagctaatcaagggcccctttcacgtgggtgattttaaactacccgagtgaccctttcacacaggtgattttaaattaatcaagagcctctttcacacaggtgattttaaactaatcaagtgaccctttcacacaggtgattttaaactaatcaagaccctctttcacgcaggtgattttaaactaatcgagttctcctttcacagaactaaaaggggtggttaatttacacaaatgcgcaggctacagccacctctccttcctagggacttcgggccgaaaatgccacctgtcacacctccaatccaggcactgcagggctgttaggaggggaattagcagctgggataccccaatcctacaatgaggggggttagcaacccctcctgaaataccaaaaaggccacagcttcctgcagacgcttaagaaccatgccaatcacaactgctttcctgaaaaatgcaagaagtcctggtgagggctggggttgcaggacgctttgcacaccacgggtaacagtttgtgggggcgcttctctgggactggctacctcttactgtcccctggaccaggggggccctgctctcatccttctggcatctcccaggcccctgccccactcagagctccaccgcaggggctcctgaggctggactcagaaccgctggatcccatcaaggcccccaaggcagacatctcacagatgtctgtgctggggggtgcgtctgaggctctccttgcttcatgaggctgcttcaccccattcttgtctcccctcacctcctgacaccctgggttccccataggcccccctcccctgcacagattttcacctaggctctgggaggttggtggagtcctgggttctagaagacctcagagacccagggcagagtgaatgtcaggggttatcagaagcaggggctgcccaagaccaattgctgagggaagaaggagtgatgaatgagatggataaacatgtcagctgtttggctttccacaatcattatctattttcagcctccgtgtcctgatgtttaaaatacagcagctaaaatatctggtggtcttttcttcctcttctgagtgcagccacgacatgccacatctctgcccatggccttcttgcctttgtctctagagggtgccatcagggatggatctgtccatgcaggaaggagcctgaaccccagactcttggacctcagactgggagagggtgtgggtgaaggcacgtggaccagtgattgattaattgattgactgatttatagacagagtctcactctgtcaccaggctggagtgtagtggcacgatctcggcttactgcaacctctgcctcccaggttcaagcgattctcctgcctcagcctcccgagtagctgggactacaggtgcccaccaccacacccagctaatttttgtatttttagtagagacggggtcttgccatgttagccaggctagtctcgatctcttgacctcatgatctgcccaccttggactcccaaagtgctgagcttacaggtatgagagtgcagggccagaggatggcaaagacaggggctggccccaggatcctcaactgttggcatcaggaccggactcagggcctcagtctggcagcatgggcgtcacgctgcctgccgggcagagccctttgccccacctgaaagccctgtggtcacagtgtagaggctggagcggcatgctggggtgggaagtgctgtccttgttgctctgtcccctggctcaggagcccctgagagtggcttctgctccccgagcttcctgcgctccctgaaagttgtgcatccagtgctgagtcctgagggcctgggggtgtcaggcctccttcctggctgtgacatgtgggttggagatttgcctttgttttagtgaaatgccagtggtcaaattcaacaggaaagaggaaaaagaaagcataagcctgagtccagggtggaggatggtggcattgaggaaggacctggggccctgcttctcccactgtctccagtccacacccttctggaaaggtcacatgatggctgctgcagctccaggagtcactgtatggacatgaaaacatccaagaagaggaggcatctcctcctttgcatcacttttactggaaaggaatgctttccccagaagtccccacaccccatgtcccatgcagcagacctgcctccaggtcctgctgttgcagctgagtgccaaaggagatggagacagtgaggacgtggagctcacagattctgcagcactggcaggcctgccggccaggaccaagatcacatgtctgctccagcatcctcgggcttaacccctgagctgtcctgccttactctctcctgaactctctggcctgttgccaccaggccagcttaacagaaaatactagaacctgtggttgttggtaaatgtttaacaactggctctccagaggtcaggggttggggtaagccccactttgaaggtttgctgatttccagggtataaacactcccactttggttgatttcaaggtaccaatgcaaagtccctgagtgtggagtagggaagagacgctcaccatcggctctcgtgagccctacgaactggccacagtgtacccctgactagaacccatgggaatccataccttagagctgggagaagggatgccctacccaggctgcagtgcaataattaaggcattgaaggagctggctggacacaaatgagaccatttgttggatccctacgatgtgctgatcacacacaaatgtcatgtcgatgcctcataactatccctttgtctgatgaagaaactgggattcagagaggttgaggcacctggtgacttgtatggaatcagaatccaaacccaggtctgtcttcttccaaaggctgtgtcctttcacccaaaacaaaggcctagattcagaagagacccagctcactctcattccaccctgatgacatgccaggggccaggatgttcaaagtggagcatgactcacagtcaccgaaaagtaggaaaaagcaaatgtccatcgctgaggagtggataaacgaaacgcggtccatccatacaactcataccatcagccatagagaggaacgaggctctgacacaccctacaacgcgatgaaccttgaacatgatgctgagtgacagaagtcggacacaagggaccacgtattacacgattcattccatttacatgagaggcccagtgtggccagtctacagggacagaaagtggatgggtggctgtcaggggccagagggatgagggaatgaggagtgactgacaacagatatggggtatctttgtggggtgatggaaattttctagaactagatggaggtgtgcacaatgtgtcagtgtgcatagtgcccctgaaattataaaacaaaccaggcggtggaggattcctcgaaaagggattttccttgctccagcctcccaggctgaggctcttgtgtcactttctcaagttcactgcaggcagcttcccatgctaccaggtaaaaagtaaaggaggcgaggccaggcataacggctcacacctgtaatcccagcactttgggaggctgaggcggaggatcacctgaggtcaggagtttgagaccagcctggccaacatggagaaaccccatgtctactaaaaatacaaaattagccgggtgtggtggtgcacgcctgtagtcccagctactcaggaggctgaggcaggagaattgcttggacctgggaggtggaggttacagtgagccaagattacaccattgcactcctgcctgggcgacaagggtgaaactcagtctcaaaaaaaaaaaaaaaaaaaagtaaaggaggcattttacatgcatcttttgcactaagtactctcaactcccctggaattggggaatgctattaaccccattttacagtgaagaaaactgaggctcaaagagaaattaaggaacttgcccatgagcccacagccagtctatgggagagccaggacttgggcccaggcctgtctgattccaaagtattgctctaaactcttcactgtagtaaagcaacatccaggttgcatgggattttctctttccaggatgctagttcagtggcatggcagctcagaaggccacataggctggaagcttccatgtctcctagcctctgccctccctcagcaggaacgaaggactggagctggaagggaagagccctgtgctgagggcgtcccaggcccgtccgccacatccctccaggacactcagctctgttatgactcggctgtgtggcattcgttaggcctcattttgctgaccttaaaaagtgaccaacagcagagatcagtcgtcctctacagaggctgtgctacccccgggggccttctggaagttttcaggggtacaacaagtgggacagtcccccagatgaagaactcccccaatccctctgcttttcactgtcccaccaggccctggtaaatgaaaaaccctcttgtaaaacatgggtccagaaccaaactctgggtgtgtctgttttttgcatcattgtcatatacattagatattctgggaatgcaaccactgtgtgatcaggggagaactccctccggagttgtccaggatttgggaaaatcccatcaccagcagcagtaccttcatggtctttgagcctccacatgacacagctgtgtccacgtgcacctgtggctgtcatgtttatgtgactgtctggctaggtacaagcatcaggccacttcatcatgtcacctgatatggccagacccgaacattcaccttgtaaaatctacattattttattataattgactatccttttgcaatttttctctatgttaccgtcagggcattatattgatttctttttctttttgcaattggtttgtaggtgggttagattttctatgaatttcatttcagaataataaagcattacaaaatattcattgctaaaaaaacagtgttggtcatgtttgatggctcacatctgtaatcccaacactttgggaggccaaggcaggtggatcccttgagtccagaagtttgagaccagcctgggcaacaatagcaagaccccatctctaagaaaaaatttttaaaaattagcctggcatagtggtgcacacctatagttccagccactcgagaggctaaggcaggaggattgcttgagcccaggagttcaaggctatagtgagctgtggtcccactattgcactccagcctggataacagtgtgagaccctatctcaaaaaaaaatgtgttaaggctgatacggttctgggaaacactgagatatatgatttcttaagatcccttccagtttttaaataattaaacctgacctcataaaactttttccataattctagtaaaaccaagtgcatggtgccttttaaacaatccccagagcatcgttgcactactgtgacccaagtgtgcccacaggccaatcacaattaacaaaccctgaagactcttaagaggcttccttctggttctggcccttggtagaacaatctcttctgtgacattcaatgacaacatctttgccttgtttatttccttttcaccttaacaaagagaagagctgatgccctaaactcaaactttcttatgctgtctttgtgctttgacaagttcagtgcttaactagaatatttttgtttttgttttcactgaaaagaaaaaaaaaagaataaatagaactccaaggaaatttggtaacatatttttatgtgctggagtgagttcatgccatgtgacattcctttctactaattattactcctgggtttatctttccctcatctcttctctaactgataatattctaacagcagcccacaggacattctggatgggtgccaccttttctgtctgcactgaacagactgttcacaatggctggtgttggagatgccttgcagaaccgacagatgagccagggagtaaaaaaaagcaaaaaagagaaagtggagaacagagtcaaccaaaatcaggcagggagcactgcagtaccaagttgttcggggctgaaagataacccccaaaaatgcatgtccacccaaaacctcagaatgttgcctcatttggaaatagggtctttgcaggtgtagctagttaaaaattatgttccactggaataggatggggcttaaatacaatgacagtgtcttgaaaagaagaggacacagagacacacagaggggaaggcgcatgaagatggaggaagagatgcgtctatgaaacaaggaaagcccaggaatgcccaaagcccacagaagctgggagaggctacaaaggtcctggcacagagccttaggagtgagcatggtccttttaatgccacacttgtgtcccgcagcactgtgggagaataaatgcttattcttttaagtgacttagcagatgagcatttgctatgcagccacaaaaaacaaatcccgggatcacaggaaaagtaatcttaacagtaaccctaatcctaaccctaacactaaccctaattgtaacgctaaagactaaccttaactctaaccctaattcatgaccttaacaccctaaccttaaccctaacactaaactcaaatgctaacccaaaaagctaaagccaacccaaaacataacctaacccttaacctaaacactaatcccaccctaacccagaaacctaaccataacccaaagccataacccataaatctaatcataaccctaaccccaactcagaccctaacacgaaccctaaccctagcccgaaacactaaacctacccctaaaacctaactctaaccctaaccctaaccctaaacactaacccaacccaaaaccctacccctgccactaaaccataaatgtaagccaaaacctaaaccctaaccctaacactaaccctaaatctaactcctaaacctaaaccctaaccggaaccctaaaacctaatcttaacaataaacctaaaccctaacactaaccctaaagcctaaccctaaccctaactctaaaccctaaccctaaccctaagccctaaccctaacctaaccctaacctacaggtgggagagcaatctccacctgccccactctccctccatctagccagcaactgcagagttgatttttagaatctgagtggtgtgtagggtggaggaagaacctgctgggctctttgcctcacctacaggtgggtggtttagagactgaccccgccctgggtattcctttagctccaggtaaatgagccacttcctacatgctgggggcacttggtgatgggaataatggctgacatttactgagttcttaccatagttctggaactattcaaatgaatatatatgaatttcaacactctatattctattatattaagaattgtattaagagtatgcatatgctattaatgatgttatcatcaaaatagcacttgtattttatgaaatcctagtcaccattagttgtaagacacaacactatgttactatggttttaagaattaaaaaaaaaatctgtcaactaaacacatcattacttgtaaatacatcctaattttagagatgttaaaattcaaatcttagaatcaataaaatatgaagccaggtacagtggctcatacctgtaatccaatgctatgggaggctggggtgggaggatagcttaagcccaggagttcaaggccagcctgggcaccagaacaagaccccttctcaacaaaaagattaaaaattagccagacatggtagcatgcctgtagccccagttactcaagaggctgaggcagaaggatcacttgaacccagaagtttgaggctgcaatgagctccgatcacaccactacactccagcctaggcacagaacctctctctaaaaaataaaataaaaataaagaatcaatgaaatgtggtattatcatcactcctattttatggataaggaaattgaggcttaggtcacacagatttcaagggtagggccaagatgaaactccctggccatgtgactctaggacccaggctctttttttttttttgagatggcgtctcattctgtcacccaggctggagtccagtggttcgatctcggctcactgcaagctccgcctcccaggttcacatcattcccctgcctcagccttccgagtagctgggactacagatgcccgccaccacacctggctaattttttgtacttttagtagagacggggtttcaccgtgttaaccagctgaccttgtgatccacctgtctgggcctcccaaagtgctgggattacaggcttgagccaccgcgcccggcctgtagggcccaggctgtaaaccactgtcccataggggctatcattagggcactgccagctcttcagtttcgagtgtcttaggctgagtctaccagttatcatccaatatccatcttctcattcttcctttagcattagagcccttgagtttccatggggcacaggatcaagcgctaaaagctgcattaccagcctctcttgcagctagatgtggctgttagagaaagaagaatataggagagccagggtgacaccacctaaaaactcagctctggcagagtgcagtggctcacacgtgtaatcccagcactttgggaggccacagcaggtggatcacctgaggtcaggagttcaagatcagcctgaccaacacagtgaaaccctgtctctactaaaaatacaaaaaaaaaaaaatttagctggccgtggtggcaggcgtctgtaatgccagctactctggaggctgaggcaggagaatcacttgaacctgggaggcagaggttgcagtgagctgagatcacgccattgcactccagcctgggcaacaagagcgaaactctgtctcaaaaacaaaaacaaacaaacaaacaaaaacctcagcactatcttaaaattagcaagacacattcctggttggtcacactccatggtcgtaagatgtttacagttgaggaaatggcctgatgatacctgcaagaacacactcctctgacaacggaatgtccagatgtcccaacacccataacagtgtatgctttcaggatcatgatagtcgtgctgggatgtatttatgcactaagtgccaagcatagttttctttaaatcagcaaagtaagaaacgtcatgctgtgagcccatccgcatggagtagacacagcttagcttttccatagataaggcgtcttagtaagaggaatttaaaatgatgatgaggcactcctcctcttgctttctgagggtataactttctttctgggctgtaactttctgggctttctgggctgtcactgagtagtgttcaataagccatttcttctcactgcactctaagactcattttgaattctttcctgtgaaagatccaagaaccctctcttgggttctggatcaacacagccacgtgacacagttctggccagtgagatgtaagtggaagacacgaataaagctctgggccttgctctcatttcctcttgcctccttgcctggctggaatgtggacctgctggccggagctgaggcagccccatctcagatgttaagatggaaaccacatattaggcttggcagaccagccagatagacaccaaagggcacccaaatttgctaggctcaatctggggctgtttcatgagaaagaaacaagcttctatcttgtttaagccactgtcattttggcctttttttctagcagccagaacgtgttctgatgaacacagtcaatgctgccctacaggcacggtcctggccctccaagagctgcagactcattaaatgagaatgaacagaaaacacctaatgcggggctgggcacagcacgggccctgggtaaatgttagttcctcacaaaacatggctgactctggcatgagttgctcagctagcttgtcattctcctgctttcttcaaatcctatccatgtatggtaggaaaagcagtattactcttgtttttctttttctgttttcttttatttatcttattttttgaaacagagtctcactctgttgcccaagctggagtgcagtggcatgatcttggctcactgcaacctctgcctcttgggttcaagcaattctcctgtctcagcctcccaagcagctggttttacaggtatgcatcaccacacccagctaagtttttgtattttcagtagaaacggggtttcaccatgttggccagtctggtctccaacttctggcctcaagtgatctgcccactttggcctcccagagtcctgggattatgggcatgagccactgcacttggccatgtttatttttagagagggtcttgctttgttgaccaggcttgagttttagtggtgcaatcaaggctcattgcagccttgatctcctggcctcaagtgatcctcctgtctcagcctcctgagtagctgggacaacaggcacatgccaccacactcagctaatttttgtattcttattttcctaagttccccttccaaaacctccatcaccttccccttaacaaatcaaatgttttctcgagagtcagggcagtaacagtcagctcctgcctttatacgacaatggactttggctgccatctctccctgtccatctgatagtggcttccacctctcctcaactccagccaactccctgtggtcctgacaaggtcagagctccttgtccccacccttcatcaagccagaggatgctcatggtccagcctagccagccagagttccccatccctctggctacagtcactgatttagggatgtgaccggcatgcaggctggattgctctgaatctttactaagaactggccaatggtgttggaaggatgaaggtctatttcctcaattctgacctatggggatcacgaaagctatagcagggcacatcgcaaattaccccaaaacttagtggcgtaaaacaagtattgattaagcttatggactctggaggtcaggaataggcacagtatggtgctggcctccaagggctaagtgtccccaaagagagggatgccggcagaactggattgcctttcaggacccagcctcaaaagtcatagaatgtcacttccaacattttccattggttgagagggttacaaacgacacgtggatgggacgtatgttggtgtggccaaatttagaatacacaacctgccacagagcctggagctactatcatccttgctcaagtggatgaagatatctaaaaagtgacatcaccacacggaggaaagcagagccgagggaaggggagatatcatttgagtccctggatccagttgtgcctgaagctagactcacctgcaggggcttttttccagttaagtgagctattgatattatttttgctcggccgggcacggtgggtcacacctgtaatcccagcactttgggaggccaaggcaggtggatcacctgaggtcaggagttcaagaccagcctggctaacatggtgaaaccctgtctctactacaaatacaaaaaattagccaggtgtggtggtgggcgcctgtaatcccagctgcttgggaggctgaggcaggagaatcgcttgaacctgggaggcataggttgcagtgagctgagattgcgccattgcacgccagcctgggcaacaagagtgaaactccatctcaaaaatatatctatatattgatatatattttataatatataatatacattatttttgttgtaagtgattcaggttgaatttctgtcattggcagccaaaagagtcctgagctcagtaaggggctcaactgagccaggacaggatactctgggacttttagcagcacagagcactagctggtgcttggaaatgatgtttcctctgctcttggctaagtggaatccccaggccagcatccccaagatgaaatgtgcccctccctttagaaggcaagaattgatgacagtgagttttttgtttggtttggtttgaagtagcccaaatgtccccttcctgccacgagggcaatgcagcttctatcttatggcatctgggaggagccattttttatggcctggatcaccgagacgggaagagggagagcaaaccgggggatggcacactcctccaggctgggtccggggaatgtggctattaggaggaggacagccgccacagcaggcccctgtgatgaaccatgcctccgcttttgcacacctgattcctggctgttaaaccctgtaaagaaggtcttatccccatgctacaaaggaggaaactgaggcagagagaagggatgcaactcgcccaagatctacagctgggaagtcgtgacaccaggcattggatttctgactgccatgttcacggagataggaaggacacgggggaagggtgttcaggacgagttggatggaggcttggcgttgtgcagcaatggggcagctggcacatctgctgtggccacagcaaagagaggagggcctgggtgtggagtggacactgaccaggcggccttgcactgctcagataaatgaggtttggcgtcctgtcctgccgggccattctttggtggcctctgtgtaagctgaggcctcgctgtcctgagcctggcttctggctgccggtgagtggctgtggaccgtctcccgcttgccagcatcgcctttggtgcttggctgggtagacagaaatgagtcacactccccagtcctgcccaagctctccctccctctgcccggggcacaggctgcccggtgtaatccaaaataagcaatgtgtggccccaggggttgggatgggcagggaggaagccccattaggcattcctgtgaggacagcgtcactgagctgggaggacccagctttagactggtcagaggaccgcatccgtcagaggtctgagttcggagattgtccatgcctccaattagccacgtggccctgagcaagtcccctctgtagcatggaggaaactgatcccggcagaacctcccagccagaggctgcttgttagtccccatctttcaggctcccaacactgttccactccggccttcctgtgggctggctctcatcttacctctccactctgtagctagctcaggtcctgcccgtaaacccttgcgtccagccccaacatggttagcaagagccaggttccgttgcttgcaaccccaaaaccctagctggaggagcgactgaggtgtgttccatgtcaccccacccgtcccaccgcccacataaccgccagcatcccgaaggggcccagcgtgttcagccttgcattgtacagtgtgttctgcctcagtcccatggtggctcagagcccacccctggccagagccaggctgaaggaatccatgctgggggcatggatccagcaagggaagtgttgcgagaagtgctctgcagagcctgagcagggagctttccagaagtggggtgcggccacatgtgtcagagctgctggggagtgccaggcaggatgtgattaatgtcggccgtgggtgtgacagccagccagccctcagcctcattgtcagagtggctcgaacgcagccccctttcctctccccacccctgctcacagcacccacccctgctatgtgtggcatcccctctcctccctccaagtgtactgatccatggtgccagtcacttaaaaatagcatcctacctgaaacgtaggcatgagacggaactccaggaaaggagacagcacccctcttgtgccttggagcacacagattcttgagcaatctgtccctggtgctgacaaggagggcctctcgccggcgccttctgttccactggggaagggaaagcccgtgttgtaagtccccccatctaaagctggcatctcagctccacagggccatagggctgcccaaccagggtcactctttctctgcccaggggctggcctgagaaccataccctcccccttcctcaccctctctgcttcccactgggggagccctggcatgagatgtgagggagggtggggagggaggctgggatacttatcccccatctttctccctacaaggtcagcacaggctggccatgaccttaacagaaattctcaggtccctccaccttccacctcacctccatccctcagggcccgttggcccattgaattgcgtttcctgcagactctattgtgtggcatggtgggtaatagtgaaaaaaaaccgaaggagccaaaatgtccaaaaatagaggtcaattgagttagtgacaacagtggcactgaggaatcctttgtggaatttaagaaggatcttttagtctgctgtgtttctttgaatctgagaagccatcatttgttatttgtattaccagtgtcatcataacccccattttaggggggaaaaaaaagaaatagctggcacatttcttttgacattgattctaaaacacatccttactttgaaacattacaaagtaaaaaaatatgcaatatggtaaaatgtaatgatttggagaatgtgttctccatatatttttaagttttaaaaaagtgggttaagatatattatgcctggtattaagaaaaaactaacatgtctatacatacataaactatcctcattcaactatgaccagatcctatgaaatatacacatgcatacacacccacaggaaaaagaaacaggaaggacagctaacaaaaggccagtggcgcggatcgccgcgccgtggggctacatgcactttcttctttgtatttttctatttcccattttctgattttataagcagacaactaaaataataatctctaccactgattatctcctttccgcctatcagcacttaacctgtgctgaatgctttgtaatgacgatctcattcaagtctccaacacccatgggagtaagaatgctggttaccagctattccacacactgggaaatggaggctcaggcagctataaagcaatggagccgggacccaaaccctggtcattctgactccagaaccgaggcccttaaccattatattctagacacaaacttcaccctaagggtttgcacctttttgagaatttaacgcaatgttgcaagagggcacccaaggaaaatgtcacccctttgctggccaggcagggacactgagatgctgaccacagagagccagcctcacagcacagcctaaacaaaggcttggggctgcaggggaggacctccaagtctctctggtcctgaaaaagcaacgtgtcttgtgagccagtaaggagccccttggatgccagcctggctgacgtaactcagggcatctctgaggcactgtcagctgaggcaggacaaaggaagtggatgttcccatggcaccacgctacgatgtcttgacaaggccccctgcacctcgttttgtggttcattcttattttgctgaaaggagcttttccgcttcctctgagataaacattcctaacatcatttcttctgagccggccagccaagagaacagctgggagctctccgagcacaggcagagtgcattcattttctggaactccgctgagaatcttttctccaggagaccccaagaagccattgcaaataaacaaaatgaagttgctggggaaactggcggccaggaagctagagctggtgtagccctggggagaagaatggagtcagcccccagtgctggggttgctggtgctgggcgctgcagttggcgggcgctgggctcctctggatcccaggctctgcctgtccagaacagcaatcctgcacgtccgcgaggctgccccattgcacagatgaggaagctgaggctcagagaggtgaagcgaggggtcccacaactggcatccagcctgagcatggcctcacagctctcccactcttaaaagtctcccaggtcacagactccttaagaatctggtgaaagttacagaccctctgctttaaaaaaaaaaaaaaaaagtaatcctgaagtgctgagattgtaggtgtgagctgccatgcctggccccagtgaaaaaacatttaaagcttcattaattaagacctgcctgtcaccttccaccacgactgtgaggcctccctagccacgtggaactctccagctccaagcaaggcctagattaaatgccaccttttctgtgaagccctattggactttctcaggctcgttttccctttggacttctagagcatcttgtagacaatggcaattatcaaggcctggatatatacattatataattgttatgtaattattaatgtggcacagcacaacaaatacggatcttgcagacagaaaaaaaattgtggtcatcctctttatgaactttcttgattgatttcataaaacatctataatcattgtttaatctgagtttttttttattttttgagatggagttttgctcttcttgtgcaggttggagtgcaatggcacaatctcggctcactgcaaccactgcctcccgggttcaagtgattctcctgcctcagtctcccgagtagctgggattacaggcgcataccgcaaacctggctaatttttgtatttttagtagagatgcggttttgccatgttggccaggctggtcctgaactcctgacctcaagtgatctgcctgccttggcctcccaaagtgctgggattacaggcataaatcaccacgcccggcctggtctgggtttttggatagctcatagacatgaattcttcagggcaggagtctccaaagtgtttagatcatagatcctaatgggcaaaacctttcccgcaggtggccaccatatatgtgtatcttaaaacttatgaattatatatatgcattgctgctctcatattttatgtataatcataaaactcctgtcaaaatggattttttttttgagatggagtctttctgtgttgcccaggctggagtacagcggtgtgatctcagctcactgcaacctgcacctcccagattcaggattctcctgccttagcctcccaagtagctgggattataggcacacatcaccatgcctggccaatttttgtatttttagtagagatggggtttaaccatgttg[133 bp omitted]aacaacattctttttaatgtcttgctaattatgatggtttccattacatctcaaggcaaaatatgcatttggggtgaggattattgtcaacagggatggattttctaatctgtacttcgaatagacttctggataactagggtttgtgtgactgtcctctgtgggactgactggctagctgcctttgtttttaccttgggatatgtctgataaagagctcaggccaggaataagatagctgctctgatacgttctcactctttactctgcttggcttattagtgtttccttcattccacagttcctttgtatgaatctttttaaggcatacatcgaatttagttagaaccagacaagataggtaccagaagctacagatccactctactaagccaatacttcaccaacatatgttgccatattttaagatctaacacacaggtgtggtggctcagacctgtaatcccagcaacttaagaggccaaggtgggcggattgcttgagcccaagagttcaagaccagcctgggccacatagtgaggccccatgtttacaacaaatataaaaattagccaggtgtggtggcgcatgccttttttcacagctacttgggaggctgaggcaggaggattgtttgagcccaggatgcagagatcgtggtgagctgagattgcaccaccgcactccagcctggattgacagacccagaccctgtctcattaaaaaaaaaaaaaaaaaaaaagagctaacagactggcgatgggacttcactgtgaaactcccattcatcctgcaagtttcccttgggtgacagctgaggagccaccaccgcagtgccaccaagactgaggggtgtccccgcctgtgacctcaggtcccccttctgcctctttagtcctccattccttgttccaccaatgaccaatattaaattctctctgctaaactaaccagtgcattttctgtttttctgaccagaccatcatgggtacagagagccagcgtcagctcagagtgaatattcataaaacctgatttcttgcttaatcttaagcaataatctcatctcttcttcctggtcctcagtggatcacctcacaccccagggacatgatcactgctctataacatagaactcatgggacatttaatgttaacttaattacccccatcattggcttgctgtgtacccactgtggcactgaatcatggcacccaaaaagatgcccacgtcctaatccccagaacgtgtggatgtgacctcacatggtaaaagggactttgcagatatgattaagttacgtatgttggcagggtatggtggcttatgcctttaatgccaacactttgggaggctaaggtgggaggattacttaaggccaggaattcaagatcaatctgggcaacatagtgagaccttatctctacaaaaaaaaaaaaaaaaaattagggcagggcacagtggctcatgcctgtaatcccagcactttgggagggtgaggtgggcagatcacctgaggtcagaagttcaagaccagcctggccaacatgggggaaatctcgtctctactaaaaatataaaaattagccaggtatggtggcccacacctgcaataccatctactggggaggctgaggcaggacaattgcttcaacacaggagacagaggttgcagtgagcagagatcatgccactgcattccaatccgggtgataaagcaagactctgtctcaaaaaaaaaaaaaaaaaagccaggtgcggtggcttacgcctgtaatcccagcactttgggaggcggaggcaggtggatcacaaggtcaggagatcgagaccatcctggctaacatggtgaaaccccgtctcttctaaaaatacaaaaaaattagccaggtgtggtggcgggcacctttagtcccagctacttggaaggctgaagcagaagaatggagtgaacccgggaggtggagcttgcagtaagcccagactgcgccactgcactccagcctgggagacagagtgagactctctctcaaaaaaaaaaaaaaaaaattagctgggcatggtggctgatatggtttggctttgtatccccacccaaatctcctcttgaattgtaatcccataatccccacccgccatgggagggaattgaatcatgggggcagtttcccccatgctgttcttgtgatagtgagtgaattatctcaaaatctgatggcttgataagcgtctggtgtttcccctgctggcactctttctctcttctgccaccctgtaaagaggtgctttctgccatgattttaagtttcctgaggcctccccagctctgtggaactg[138 bp omitted]ggtgaaaccctgtctctactaaaaatacaaaaaaattagccgggcgtggtggtgggcacctctagtcccagctactcaggaggctgaggcaggagaatggtgtgaacccaggaggcagaggttgcagtgagccgagatcgtgccattgcacttcagcctggcaacagagcaagactccatctcaaaaataaataaaaataaatggccaggtgtggtggctcacacctgtaatcccagcactttgggaggctaaggtgggtggatcacgaggtcaggagatcaagaccatcctggctaacatggtgaaaccctatctctactaaaaatataaaaaattagctgggtgtggtggtgggcgcctctagtcccagctactctggaggctgaggccggagaatggcgtgaccctgggaggtggagcttgtagtgagccgagattgtgccactgcactccagcctgggtgacagagtgagactccatctcaaaaaataaataaaataaataaataaataaataaataaataaataaataaataacccactctcaggtatttcttcacaatggcctgagaacagactaatacagtaaattggtattggtagtagggtgctgctataaggatagttgaaagttcagaagtgactttggaactgaataactggcagaggttggaacagagggctcagaagaagacaggaaaatgtgggaaagcttggaacttcctagagacttggagagctcagaaaacaggaggatgtgggaaagtttggaacttcctaaagacttggtgaatggctttgaccaaaatgctgacagtgatatgaagtccaggctgaagtggtctcagattgagatgaggaacttgttgggaactggagcaaaggtgactcttgctatgctttagcaaagaggctggcagcatcttgcctctgtcctagagatctgtggaactttgaacttgagagagatggtttagggtatctagtggaaaaaatttataagcagcagagcattcaagaggtgacttggatacccttaaaagcattcagttttatgtattcacaaaggcatggtttggaattggaatgtgtgtttaaaagggaagtagagcacaaaagtttggaaaatttgcagcctgacagtgtgatagaaaagaaaaacctattttctggggtttttttgtttgtttgtttgagacagagtcttgctctgttgcccaggctggaatgcagtggcatgatctcggttcactgcaacctccatttcccaggttcaagcgattctcctgcctcagccccctgagtagccaggattacaggtacctgccaccacgcctggccaatttttgtatttttagtagagacagggttt[134 bp omitted]agccagctgcagaaatttgcataagtaacaagaagccaaatgttaattgacaagacaacggggaaagtgtctccagggcatgtcagagaacttcacagcagcccctcccatcacaagcccggaggcctaggaggaaaaagtgatttcgaggggcaggccctgggtcttgctgctctgtgcagtcttggggcatggtgccctgcatctcagctgtggctaaaaggggccaacatacagctcaggccattgcttcagaaggtgcaagccgcaaaccttggcggcttacatgtggt[143 bp omitted]tgaaaccccatctctactaaacatacaaaaattagccaggtgtggtggcacacccctataatcccagctactcgggaggctgaggcaggagaattgcttgaacccgggaggcagaggttgcagtgagctgagaacatgccactgcacttcagcctggccaacagagcaagactctgtctccaaaaaaaaaaaagaaagaattgaggtttgggaacctccaactagatttcagaggatgtatgaaaacacctggatgttcaggcagaaatttgctgcaggggtggagctctctgctatggagaacctctgctagggcagtgcagaagggaaatgtgggattggagcccccacacagagtccccattggggcagtgcctagtggagctgtgagaagacagccaccatcctccaggccccagaatggtagatctaccaacagcttgcattgtgcgcctggaaaagccacagacactcaatgccagcccacgaaagcagctgggaggggtgtgggagcccacctcttgcatcagcgtgacctgcatgtgagacgtggagtaaaaggagatcattttggaactttaaggtttaatgactgccctattgcatttcagacttgcatgaggcctgtagcccatttgttttggccaatttctctcatttggaatgggtgcatttacccaatgcctgtactcccattgtatctaggaagtaactaacttgcttttgatttcacaggctcataagtgaaagggacttgccttgtctcagatgagactttggacttggacttttgggttcatgctggaatagttaagactttggcagactgttggaagtgcatgattctgttttgaagtgtgaggacatgagatttgggagaggccaggggtgaaatgatacggtttggctatgtgtccccactcaaatctcatcttgaattgtaagctcataatgcccacatgttgtgggagggacctggtgggaagtaattgaatcatgggggcagtttcccccatgctgttctcatgatactgagtaagttcaagaccagcctgggcaacatagggagacctcgtctctacaaaaaattaaaaagttagctaggcatggtggtacacatctgtggtcccagctacttggaggctgaggcaggaggattgcttgagccccaagaggtcaaggctgtag[132 bp omitted]gactgtggaagcagaggacagagtgatgcgctttggagatagagaaggagccatgagccaaggactgtaggcagcttctagaaactggaaaagacaaggaaatagattcccctctgagcctccagaaagaaacagccctagccaggcgcagtggctcacacctgtaatcccagcactttgggaggccaaggcgggaggatcgcaaggtcaggagatagagaccatcctggctaacatggtgaaacccagtctctactaaaaatacaaaaaattagccgggtgtggtgttgggtgcctgtagtcccagctactctggaggctgaggcaggagaatcacttgaacccgggaggctgagcttgcagtgagcggaggtcatgccactgcactgcagcctgggcgacagagtgagactcggtcttaagaaaaaaaaaaaaaaagaaccagccctgatgacaccttggttttaaactcatggaactcattttgaacttctggcctccagaactgtaagagaataaatttgtgttgttttaagcaactaattgtgtggtaattattgttacagcagcaacaggaacttacactcctacccagaagacagcataaatcccgtaaatttttctttcccagttccctggagaaagcaaggaagctcgcaagactttgaagcctgtcctcatagaaaaatgtcaatccctacttcagtgtatgctaagatgccagctgactactgggagattcaattctcttcattagagtccaacccaggccacaccccaagggctgtaagaaattggcactgaagtttgtaaaactcaatggtttcggccgggcgcagcggctcacacctataatcccagcactttgggaggccaaggcgggtggatcacttgaggtcaggagtctaaggccagcctgatcaacatggtgaaaccccttctataccaaaaatacaaatattagctggtggtgggcacctgtaatcccagctactggggaggctgaggcagaagaatcacttcaacccgggaggcagaggttgcagtgagctgagatcgcaccactgcactccagcctgggtgacaaagtgagactccatctcaaaaaaaaaaaaggcagaaagaccaccagcaaacagttaataagcaccaactgcatacatggtacccatctggagctggaaatccaaagtgacaaacttaatcagcctcagccctgactcctgctctcaaggagctgagaatttaattaagcctctggtttatgtgtattggcatggccagcttccacaggaacacatgggggggctttactgtgtcttacaccagtggtcgttctgatggttctgtgccagcctcctagtgaagagccatccctgggtaagagaaaagaagcaggcatgccaagactcaaatatgtgcaaggaatcatacgtacgacatgtggaccagcaggttaaaaaagtgttaacccccaaaccactctcaaacaaagtcttaagctgaagccagctttcagatatgtattattatatagtaatacatgttaatatatattaatatgcaatttgtacatattagcatcaataggaacacaggacctacatatgcacacacatgtacttactagagctgctgtggctcaaatgcaagggcaaaatcctctgcttcctcaggaatcccctaacgtgatgaggatcacacagcaaagaagacacaggcttcatcatcaagcagacctggacctgtccttctcgctgtctacactgggcaagtggcttctctaaacctcagtttcttcatctgtaaaaggggaagaatgttctactggcaagattgttgtgcgggccaagggaaatgaggacatgaaaccccagccaccagcaggtctcaacaggcgtcagcatccgggacaccagccacagctgtgaggcttcaggaacctggtccacttgaccctcctcgccagagtcaccatccagacccagccttgacccacagccgctctggaggggacggggcagtgggatttgggatcgggagaacttggttcaagtcctagccctgctggtatctgctggcctcccccagggcctgatttccccgtcggccaggtaaggataatgatctattgattttaaagcatgtcaccagggctaaatgaggcatgaaagtgctttgtcccctggcacttctgcccttcctgtttttggtgccaaaacccttagcctggccaggcttggtgagaggcaccgtgaggctgctagcctgagccctagctctgtccctggctggcgggctgtcctttgcaagtgaccgctctgccccagttgtttcacctgcaaatgataacagccagcaccagcttcgctcatgatggaagccccggtgttaagcccctgcctccgcctccacttggccagctccaggcaaggcggccactgtggcagtgactgtcagaattgctctcttacaaggtgctgcttgcaccaaactcaggtgggggtgtctgtgttgcaaacacaagcacacgcactacacacacatacacagcacatgccacacacatgcacacacctcacacaccacacataccacaggcatacatatacacaccacatagcacatagaacacacacacactccacacacaccacatgccacacaccacacacatacaccacaccctgcacgtatacacagcacatgccacatgtatgcacaccacacaccacacataccacaaacatacataaacacacatcacacacacagcacatgccacacacatcacacatatacatatacacaccacacataacacacataccacacagatacataaacacatacatcacacacatacaaagcacatgccacacacataccacacaaacacatacaccacacatacacagcacatgccacacacatatacaccccacatagcacatgtgtgtggcatgtggcatgtgagaaatgtgtgtgtgttgtgtgtgctatgtggtgtgtatatgtgtgtgtggtgtgtatgtggcacgtggtgtgtgtgaaatgtgtgtgtgttgtatgtgctatgtggtgtgtatatgtgtgtggcacatactgggaattgagatgatttgtggctttttatattgttttttactgaggtataagctgttcataaggaacatgtaatgcatcataatcagacaaaacaacacagtcatttacatgtttttaaaaatcctgtatttgcttgaaaatactccagaaagaacatgtgtgtatgtcaggggtggcgtgacagaaatggatggaataagagtggcaaaatgtcatctttgctgaagctggccaaaggggactatgagaaatcaccatatgattctcttgacttttgagtatgtttgcacatttcacaagaaaaggtgaaaataaacaaacgaataaaaccaaggtcagcagtgagttcatccttggcttttagaggatatcacaattgcagtgcaataaacacagaaagatgagaaacaaatatacaacagaaataaggctgcaaaacttaacgctaagaacccaggagccatcagctgtgcgacctcaggtcaataacagccttatgaagcctcaggtccctcatctgtaaaacgggaggaaacccttgttgcatggcaggcttgtggttcagactgaaaattctaattactactgtggctgctgttgttcaatccataggccctggaagtctggaagcaagaactccacaccccaacagtggtttcaaactttggtgtgcactgagatgaccagggttactagcaaaaatgcagattcctggccaggcacggtggctcgtacctgtaatcccagcacttagggaggccgaggccagtgtatggcttgaggtcaggagttggagaccagcctggccaacatgatgaaaccccatctctactaaaaacatagaaaattagccaggcatggtggtgcgtgcctgtaataccagctactcaggaggccgaggcaggagaatcgcttgaaccaggaggtggaggtttcagagagctgagatcgtgccactgcctgggtgacagagtgagaccctgtctcaaaaaaaatgcggattccaaggtcctacccctagggatcctgactccatacgtggggccaggcctaggaccctccactttaaataagaccccaggccattcccactggggaaatgctgcatctagccccacaccaaagacacccgggtaagcaggtctgccacggacaaaaacgcctcgccgtgcagaaaccggggctggacgttgttcggggctgattgcccatttatgactctaggtggactttgtctgcagtcatggctggaaaagctggcaagcaacagacacctttgcaaaaatagcaaataaacaatatgtcacatttgtggtttcctcctgggaggggcagagtctatatgggcaattgacttagggcagaatccaattccaacatgaactaactgtgtggcacgggccgaagcccttgaccattcagtatctgcatgatgggaattttgatagcagtatcagaaacagccccatggggttttgtcaattacacgaggctgtcaggaaccgaggcctggagccaggaccccgtcaggaagtttagggatccactggatttatggcctccatgctcagggtgtcaggtcccaaaccttctcaatcacaggaaagcaggactcaggccaagggaaggaagcacatgtcgcagctggagaccacacataccttggcagcaccccagggagagaaaattccctgctgcaccaggcttctctgtgcacttccagcccccgtcacttaaggaacccctgtcccactctgagtcttcttctgaggcctctgtttgtgttgtcctgctcctgtcctggcctccagatccctcctctcgtagggtcctaggtctgaaggaaaagcaagatggcggcagtctgggggaagagcatgtgcttggggtccccgtggcccatttctgggcttggcctggtcacctgctgcagtcagtatcactcattcagacctaagcagtaatgccaggcgggtcatgtcctccttgtaaaattgtttgtttggagaatttgtggtgaactccaaatctctctctctctctcaaaattaataccattagagtcatttgtgcttgactgcagccctatggaagggacagccccacttctccccttgcctctttgtggttatttgtagggcagtcacaggaaaccagtacaatggcatttccccctaaacatgagtgtggctctcagcgcaatccagttcacaacaaatagcccatccttgacctataggaccaggcctcaggaagggctcgggggcctcagaggcaaatgacacccagcccttcaaccctgcacaaccacagacctcacacccagtggtaaccaatttggctgaacagcaccctacactgtgggctccccgtggtgctgggccccctcacaaggaggcagggcacaccctcctgatctagcctgagcccctgagtcctctcccaacctcctcccagcgatctcagctgctccagcaaggcgtggggctggtgtccttcagctgcctccctctccagaggaggagaggcggcagatgttgaggcagaggtggagaaaagctcctggcacgcttgcagccggggtcaccttgtgcacgggcagagtcagggaagggtgagacagtaggtgccctgtgtggaaaaccagaatctcggggccaggacccagagaatgctggagggcccgggaggtcagcgcctgccctctccccatgagggaggccccctccctcaggcagtctgcctacttcagagtggggagtccaggttgtcagttctgtatggttgatggacctggtctcatttgcctctgaggcccccaagcccttcctgaggcctggtcctgtagggcagggatttcatatttgttgtgaactggactgagctgagccacgccgacttctggggggaaatgacattgtttcggtttccctggctgccctacaaataaccacaacacgtgtgagtgcgggaggggagggtgaggtgtgggggggtgaaaacaatagcaacttaccctctcacagttctggaggccaggagtccaaagtcaaggtgtgggcagggctgttccccctggaggctctaggggagggtcctccctgtctcttgcagcctctggtaggcccaggcacccctcggctccaatctctgccatccttgcacatagtctcctttcccccgaagtctctatgtgttcttttctgtatcttgtaaggactgtctcattgcatgtagggctcaccataattcagtgtgattttatcttgactcttaccttaattatctgcaaagactctttttccaaataaggtcacattctgagatttggggtagagataaactttggggggacatgattcaacctactaagccattaaatcacaaagagcacgcaagaaggaccaaaaaggcagcgggaagtggggaggaccttgatccaaggacttccacagctcaggcctcccttgttccagccagcaaggacattctttccatgagcacctttgacttccactgctagccaggatgacgggttcctggctctcttctacagatgaggaaactgaggctcagaggcccttgaatgcatagccaagttcacacagtcagccacagctgggactggagctcacttggtaccaaaccctgggggtttcacagccagctcggctggattgaagaagccccacctccactcccaatgaggttccaagatctttctccaaggagcttgctttatcaataagaaatgaatcttttgtttttgagacagagtcttacgctgtcacccaggctggagtgcagtggtgggatccccattcaccgcaacctccctttcctgggctcaggcaatccttccaccgcagtctcccaagtaactgggactacaggcacatgccaccacatctggctaatttttgtattttttgtagagatgggatttcgccatgttgcccaggctggtctcgaactcctgggctcaagggatctaccctcggcctcccaaagtactgggattacagatgtgagcctctgagcccagccaaactgtcttgatgctcacgttatttcactaccttagattatgaattttggaatgtggccagtttcctggaatcacattaagaagtgaggtccaggagaacaacgattaatttaattattaatagaaatcagcctagacctgggaaataagatgaggagacccaactgtccccagccttgtccttgtgcccatgtgggaggccatcctgactccatttagatttttgcttcttcctacactgacaaagaacactcgggcggctccagggaaatgtgcccaaggtgtggagggggctgggggagtggagatcatttttttctgttcccaaccgtgcctttctgcaatgtctgttcatccttgaagacctaagactggagaatgtggggtttgtttgttttggagagactgggggggaggggggggtctcaccatgttgcccaggttggccttgaactcttggcctcaagcgatcctcctgcctcagtctacccagtagctggaaccataggcgtgccagattcggctgaagagttttgttaggaagttttcagcaccttggatcatatcctgaaaaagttcattcactgattcaaccaatctctactgtgcactgcccagaaccagagtgtgagctccacggggtagggagggcgccagctttgctctcagctgcccccgggcgcttgggacctggaacccatgaatgaacagaccccgttctagatcaacagacattcaaagcagcgctctaggggaagggcaggggaggaatgagcgtccagccgccacggctctgcttctttgcctgtgtgtaagtggtgggatttaaaggtggttgggtgcagaggcccttcccccacctgcaatcctccggtgccaatgcaagtgccaggggaggggtggcgtttctgtttacttccagccaggtcagctcccttgcccccgcccctgtgtttgcattttctcggtttggcgagctggtggagtagccgcggaaagaaggcggatttaaaggctccatttggaggaggcttttggagaaagcttgcacctcccatcacacccccagggcaagtcagccgcctcaaaagtgccggtgccggccctctgtgagctgaacaccttcgcacaaacccccgggagcggttactattaccctcattttcccggggaggcgcctggggctcagagaggccaagtgactcacccaaggtcacacagcttagcagtggccgacccgggattggaacccggggctccggaccccgcggcggccgtttctcgaagatacccactacctccctcttacaccgctcaggaataaagcaggaaggccgaaggccccgttttcgcccaaaaacaatgctccacgtaaatttgcgggaacaaaagccaccagaaatccagcccgggttttccgcctctctgctctccgcggaccaatcgcgtcctgacggccgccgagagactagaggcggtggctccaatatgatccatagccccccagggcggcgtggccgcggcatgggcgaatgggattggggacccggcacaatcacgggcggagaacgggccgcctgagccaatcagctagggaggggggagggtgggcccggccggcccgggctgcccggagaggcggccaccccgcccacttctgctggtcccggccgcccgtcagccgcgagcgcgacgatccctctgctcctcggccggtgcctgctctgccgtcgtcgccgtcgccgccgccgcccgtccgccgcccgtccgccgcgcgggagcagcaaggccggcaagtcccggcaggatccctccgcgactgccgccttgcgtccctccccctccagcgcccgttccgcggccgcggcccccatcgctccctaggctgcgacgccgcgcccgcggccctgggtaacggccggcctggggcccgcagtgacagaccctgcggcgcggggggagatgggggcggccgccttccgggcgacgacgacgacaacgacgaggagcagccgccgccgctgccgctcaccggccgctgctgggcacgggcatgggctcgggaaggcgcctccccgtgagcggcgggcccaaggcagctcgtcgcccccggccgccgcgggtccccctacggcgccccgcgcgcgcccgcccgccggcccctgacgggagccttgcccggctccggtccccgccccggcgcccgcccggcccgcggcgcccgcgcgccttcgcccggacccgaccccggcccgcgcgcccccggtcccggcgcgccccggccgcggcccccggcgccccccggcctcccccgcgcgggccccggggcgcggcgcggcgcgggcggcagcgtggtggagaagcgctgcccgctgcagagggacggcgtgtaccgctggttctcggagctgccgtcgcctcagcgcgtggagttcctatgcggcctgctggacctgtgcatgccgctcgaggtccgcttcttcggctcgtgcctggaggacctggcccgcaaggactaccactcgctgcgcgactcggagatcaaggccaacaacccggccgacctgggcagcctcaccaacctgacggacgaggtggtgcgcagcaagctgctggtgtcgctggcgctgctgggctcggagcagagcgaggcggcgggcgtgctctaccgcaagctcacgcacgtgactccatcatccacaactacgggctgcagctcaacgagggccgcacgggcgatgagttcctgctgccgttcaccatgtcctccaaccaccgcgccttcagcttccaccagaagcaggtgctgtgccaggagctcacgcagatccagagcagcctgaacggcggcgggggccacctgcctggcctgccacaaggtgcgtgcccgccccgagttctgctctgtaccccaaccctgcatccccaactctgtatgcgaagcctccagcctgcaccgcgagcccccacccaggcctccaagcctgcgccgcgacccccccacccacgcctccagcctgcaccacgagcccccagcccgtgtcccaagccccatcctaagcctctgtgtcgcatcccaaatgtgtgccccacctctccaagcctccaccgtacatccgaagtccccaccccgtgtcccaagcccccatcctaagcccgcactcctcaccctaagtctgcacttcaagccccaagaccgcaccgcggccctgagcccacaccctcagtctcctctgcgtgccccaaagcctccagatctccgcctcgcgccccttgggcaggagcggctgcaggggccctgggtccgaggatccgcgggagcggtgcgggagacgtccgcggtcagagctcacagtcccaagtgccctcctttcacttagccggctgcaaacgcgataaggcctttgtccccttaatgggacccttgggtgacagataacacacattgcggcgccttggtttccccaaatctggtatttattactagaaaaggaaggagccgtggccatgccagaagccgcgggtgaggtgaacattgcaaggcaccggccttcgccttctgagctgctcactccatacaggtggaggccctgcttggggcctgtgttgctgggggcctgcgcgcgggacgtggctgtccgtgtgagctcatttatggacacgtgcatgctgtatgatgtacgcgtgtgtcgcatgtgggtatgtatgtgtgcacacgtgtgtatttatgaatgtgcacatgcctgtgagcgttgtgtgtgatcgtttttaagagccgggctacctgtaacagacagaaaaagactcctagagccttaaatgcccatgaaacctatttattggcgacccttagaaacaaaacccaggctgacgtttgagtaggagggcactggtgccttaaagaatgttaggttaggttaaagatctcccgtctccaaattgaaccggaagggcatcctggccatccacttagcgatgtgaacttttgtctaagtgtttcagaactgaaaacgcaaagtgtttggggctccagctattttgaacaggcccctgcaatccagtgccaaaattttgctaccggaagagattactttgacctggtgtgatgtgtatttagattacaaactgattatttttttggaagggaataggttgcagtcgggaccagtcttgctgagtgcctctttgcagtgtctttaagctctttgaagttaaaactttgataagactttgcttttatgagtggctgagaacaccgtctggtttgctaggttttttgtgtgtgtttttaaagctgtctttcaatcctaggttgtggcttttcttttttaatgtcttcctctaagaagtggttgtggtacatacattggtttttttgtgtgtgacatttatctccaagactatagttttctttttaagttcagctcccaccctacatttcaggctgtgtgctgcgcagagggtcctaggaaatgtagttgtttctagtaatccatgtaagccttgacatgccagcaaattgtcgcctattcatggaatctcagtcatttatggtcagtttcatgtgctgtttgttactcctttgtgtagattccacccactaataatttctatggctgttgctacagtaaagtcatctctttaaggggattcttaatgtgtgagcacgggtgcatcactttatgcagacagtggtgattattattttggttgggcagtgagctaaacctggaacaaaaatgtcttttataggagagcctttctgtcaagcagaaatccctttgacgagatgaaggagctaatctattcgtctcagctcacccctgcaccgccccccctcccccccagccccaaggccatgggcactgaatttaccagccgtgcaaccttggccaggatccttctacctctcagtgttgtccctattgcagtggaggggatgtaacctacctcacaggcttgtgttgaggattacataggtaacatacgtgagcttccagcagaggtgcagtaaatgctgctttctcccttatggcctctccggcttttaacatttatttttatagaggtatgctaacttaaagcaagacatgttttatagattgaattatttacatcttggctatgagcttttatgtgttctaaattggtttttgaatagttacttggagctgacaatttttttgtttcatctttggaaaactggaagattctgtgacccttaatgagaggattattataaggagtaaccttgggctgtcatttccgtatttcaaaacaaccgtggattctagttttccctacatccctagtgtcactgctaagctaatttcagccccattcatttaactttcgtttctgtgctgcttcaaagctaaggctgacgttgatgaaccctttattgcttggagcaggcaactcagatgaaatctagcatttaagtattttgctttcttagtttctaaatattcctgaaaaagcagccccattaaagctgtctgcattcttttgtaagcctgttgtattttgttttgaactctttgagcttagagattttgtgtttttcttttagagatacaaatgttaattgctttttaaattctttatccaatttgaatttttatttcttggcctggcaaggtggcttacgcctgtagtcccagaagtttgggaggccaagatgggcagatcgcttgagcccaggagttcaacaccagcctgggcaacacagcaaaaccctgtctctacaaaaaatacaaaaattagccaggagtggtggcacacatttgtagtccctgctactggggaggctgaggtgggatgattacctgatcccaggaggtagaagctgtaggtgaggtatgatcatgccactgtactccagcctgggtaacagaatgagaccctgtctcaaaaaattttttttaaatttattttaactgtattttccgaaatagtcattatttgcaattccttatccaaaccctgtgtttttatttaaaaattcttattattctgaggacttctagaggtgtaaaagtagggggagtataaagtagacatacctgtgttttactttcagaaagaaaaatacttccagtagccacactgatgataggctgaattagttgtactctgcctagtggcgggtaatgctgctgcttgctgctcctgcagtcgcctgttccagggtgccaactgtgggggatagttggcttagactttccaatgcctattttacgtaaataaaagaccatagttttggaaatagttaaatcctttgcagttttttctttttgtcagtgataataaatatgctatggtatgtgcacatgcttattcttattttaaaaataacagctttattgaaagagaattcatatactatatatacttcacccttttaaagtgaagtcagtggtttttagtatagtcacatagctgtgcaagcacgaccactgccactgaatgtttccatcacccgaaaaagaaacccagtgcctattagcagtcgctccccattccccctccccccaacgcttgaccacccctttttgtctctatgggtgtcttttttggacgtagcatgtaaggggaccacacaccgtgtggccctttgtgactggcttccttcactctggtgatgtcagggcccctccatgctgtgggtgtgtcagcacttcctcctctttcgcaaccgagtggcgttcccgtgtgaagaggccaagctgtgctcacgcgttcttcagcgggtggaccttggggttgcttcacatgcttgcttgtagacttttgtcttcatggttaataggctctttatcttcatccccgtgcactgtgcctaacacttagagcatcctctgtggaccgctggcgtacgtgtcggtgcagggctgtcctgagggctcctgttccacctggtagattgctaggtgcggtgtgcagagctgtgtaggtgtggcctcagccagcctggggagctgcaggtggaggtggcagggaactctgtgctgtcagtacagagcctctgggctggtgcatttggtcagcgacaggtatgggggagcagggcctggtgggcaggggcctgagcttcagctgtgagggccctgctgtttgtgtttcagcatcctcagggtatggataatgaactgcttcatggggctgatttttttaagggggtactaaaaaaatgatgtttttaaagtttttggtgcaggggtgtggtgggggtggtggtcttcctttagggatatgttctgtggaacagttctggaactctctgtggcttgcattgtgagtacctgagggtaagcactgtagaaacttcagatagacacaaatgctgtgaataaacctgctgaaaatgtctgtctaaagatcagcaacagcttttgctttgttgctttttgtaagctgttgaaaatcattgcagttcagaggtgaaacatgggatagttcatcgtctggttatcaggcaaagtggtttctcccttagccctaaactctgggccgattgcagccaagagtcatctagcattccataagaacagactctctctggagcagctgttgtcactgatggttaaaggaatagctgtgacctaaaagcactgttttgtctccatctttaacactcgttctcctgggcagctgggaaccgcctggtctatgaacttgtctgtgaactaagtcttctggctgtctttgtatacgttgcttttttttttattgcattacaggagatacaggaaataatattctaactcatagtggatctttatttttatttttattttttggccagctgttacaggtctaaaacactgtgctgtttcatagtacagtacagtacatgatacgggaattgagtcatgtgctgcttaaggacacagatacgttctgagaaaagcgtcctcagctgatcttgttgtgtcagcaccacagtgtgtacttgcacaaacatgggtggcagaacccgctacacccctgggccacattgtagagcctgttgctcctcggctataaacctgtgcagtgtgttactgtactgaatactgtaggcagttgtaacccagtggtatttgtgtatctgaacacagaataggtacagtaaaaatgcattattagaatcttagaggatccctggtccgtgtggtctgtcagtggtggaagcatccttatgcagtgcgtgaccgtgctgggatgcagttctgattgctttcttggtggtagtatttttgttgatgccatgatggagctgcagtagcactgccatctactgtgtaatggcttggattatgtggtactttaattactgtcctttgccctcacattaaatgaaggccatttactttgatatgagctagttcacacttgcctcatttagttgaacacacatttgagttttgctgttttctactgtgttctggagcacagttgtagaaactggaaattctgtgtcatatttgggtatgatgagtaatatgatggtatcatttgttcaagtgcgaagataattgcagataagcatctgcgttagtcttgtcactgcaggtgaagcttaccgtttacttaggctttagtttacccattttctctttagtcctgtaaacttcatctaccttttggtttaacatgcttttccaacaaatctacatgagtcttaaaacttcagagtccaactagtagaatagaatagtaagaggtacttgcactggggcatctttttttgttgaattgatgacgaagaaatttttgttatgctaggaaaaatttctactttagtgttctcccccgccccccaccttagagggattagattttagaaaaagatccttcttttttttttttttttttttttttttgaaaaactgccagttggaacagtagttatcttgttagtttaagtaagaagtgtagctgcaagttacttaattagggtacattattgaagggcttttggttttggacttcagtcttaacatactcagtttagaaattagttttagcaaggtaatttttttctccagtctctgtagatgtttttattgtagagagacctgacacattgtagaaacatttcctgtcaaaggtaaaaagagatcatccagaatgaacaaaatacgttaattcttagcagtttctgttttgttctgggttaaaagacctgaagctacttaaagtgagaagacagaagcaagacagaattgctcttctagcagccgtgtgtcatgtctgatcagagcatgattaagcaggacaggatttcacatgtgggccacaaagccctggacctggccgctcaccctgagaggggcactgtggaccccacccgccattcactacccagcttgccagtggggtgggtgctttgcaggctcacagaaaaatcactcgcccttgaaatgtcttatctgggcctggacacctccttagtttctcttgtgtttcctttctgtgtaaggctggtccctcaccgctggtttgatcacagccctctgtttcctcagggtcactggtaggtcagcgtttgaactttgtgatttctgtctccctccttcagtccagtctttgacctctagcctcacctgacccataaaccataatggttctctgatttgtattttcaacaaaaccccgcctttaacaccactcacctctaccagccaacaaaaccccggctttaacaccactcatctctaccagcccctcttctcttggtcgcttcaccaccgaggcctccctgagcagctagcagaaaaggccttccatcccgctgggtggtgctggtccctgcgaataggttgctgtgtgtctttccagacgtgtttgtgcacatatatgttcatacgttctttcaagaaaccatacacatgcttagatacacgtaagatcttacatacacgctgttcttcatgctgtaacatggccacgcttcgtgaagtcactcctgctgtctctagttcctcactttcagttattcctcagcctcctgtgacctgccttttgccttgaacctctttgacaaaaacaatttttacagaaaagtattcagcaggtctcttcagtgaagaaagattttaaatcggtaatgtaaccagaggtaggaaatggaaaagtgccagaggctgctgcatggaaagtcccttctcccacagatggcagggaagggcacccaggacgttttaagggtcaggcaaggttctcctttccctgggtattgataacttttatttcacatgtaaaaaacatgtttcttaccctcttcccagccatccagttcccctctttgcagacagcacacttcctcttagaaccttccagataaaccatatgtatttacaagtaggtacctgatgtcccactgcacacacaggtgcctcctggtcttctcttggcagtctttccagatgaggcttctctgtcagtccataaagagcttgttcagtggcacaaatgtgttatttaatcaggccctgttgataacattttgttccatcgtattattacaaaccagtgcagtgtcatttacatattatatacatatcacctacatgttacagacaacagatgggacctttcacattcaggtaagtctacctgtgaagtagaaatctggaagtggagttgggtcaaacggtctgtgcttttgtaattattttacctgttgccgagatctgcttttagaattcccacagccatgtacaaggcctgtttccctaacctttaacgagcccagtgagttagccacttgctggttgcagccattcagttaggtggagacttaccctggtgtggtgtagttttatcttaggaatgaggttgaatattgtttcaagtaaactatttcattgatatttggtgagctgtttgtctcctttgctcatctctgttgagttgttggtcttttctttttttaatttttactttatttgagacggagtctcactctgtcacccaggctggagtgcactggtgtgatctcggttcactgcaacctttgcctcccgggttcaagcaattctcctgcctcagccacccaagtagctgggattacaggcacgtgccaccaagcctggctaatttttttttttttttttttgtatttttagtagagatggggttttgccatgttgaccaggctggtctcaagctcctgacttcaagggatccacccacctcggcctcccaaagtgctgggattccaggcgtgagccactgcgcctggctgggttcttagtttttagaaactccataagtttcaaggaatcatctttagtaggaattgcatgtatttgttttctgggtttttaatcttgtcttttgactttgccatgcaattattttcttttctttttttttttaatgctatatttatcagtcctttttggtgtggcttctgggtttcgtgtcataattcataatgtataatgcgtttctcatcatacgtattgtacatatgcatgtattgtgcatacataatacacatgatgccccgtacattctaaagacagccccctgcagtgtcgcctggtatggaacttgtgtcattctctttttatatcagacggatccatctggaattgatttggtataaggtacaaagttagttttatattttccagatgacagcccatttgtcccagtgccatctgttaaatagcctctgctctccctcccagatctgagctgtctctcgtttactcccacatctatttgggttcacttctggaccctgcgttctgcttcatggatgtctccatccagatgacctcatgttggccaggttcgttggatactcttggttttgtttcttacctctcatttgttcttgtgggtttcctacacagaggaatccccaggaagggtttttttggggggggtttgtttggaataaatatggctgcgaggcgcctgctccggatggtggcttctgcagcctgggtgtgccgggccggctgggatctcgctgcctccgccagttctggcactgctggttttcctcttctctggacatttgttttcagtttctcctctgctttcctgcacttttgatgatattattcctcagacttctctcctttttcttctttctttttgctttataattcgtgacctttttagctgtggttttgccagtctcactgatgagtccaaaaaacctaaaggctcaaccagacctccagctgcccctgaaggttcccagtagctcagtgtggcaaaggcgggtttctgtcttccaacgtgccatggttcccatgtttcccccaaagtttgcatcttagaaacttaatccccagtgcagcagtgttgggatgtgggtaggtcacgagggctctgccactgccattacaatgaggtaatatccttgtcacctgagagtggtttttgtgaaggccggtgtggggctcctcttgctggcttgctctctggctctctcgccctttccccttctgccttccaccatgggatgtcccagcaggaaggccctcagcagatgcaggctcttactgttggactttgcagcctccagaactgtaagaaatacatttcttttctttataaattacctgctctgtggtattctgttacaggaacacaaaacagaccaagacactaaccctgacctgctctgtccttcccttctaatcccctccagccagaggccgaggcctgtcatagagatgcccttttttatcccctccagctggtttatgaccaagtcctaaatatctttagatttgtctccagtgacaccgttacagccccggttcagtgttccctcagggtttccctttctttccccctgtactttcctttcttcctctccttcctttcccctcccacttcccctttctcccccgtttctctccctaccacacttgccatggtggtcacatacatggcacacttctctggacgtaggcttagatttgaggcagtatgccagggaagcaggacatagattagaatagtcttcaggaaaccagcatggccccagcctagcctaactccactttgcttctgatcagaaatccgtgttagaatgcaagtcagttgatgtcattgtgtaaagtctacaagaaacaacttcgtagctgctccattttattttctgattaaatagtttagaagcattggtaccttaactctttttagaaataacactaatgtgcccaactctgatcatgacctaggtctagcctcattaacattctagtctcctggcctgggtctgcccactgtaaccctttttggtctccctggcctgggtctgcttccataaccccctctggtctcactggccccctcttagtctctaacatcagttcccttgtgtcactggaatggtcctggtcaaatgcatgcaggagcctcatttctggcttacgggtcttagcatgatgtgccatggcctttgtgatctgccccctgcctgtccgtacacacctctgtctgtgggcgcagttcctcctactcactgtgttttctctctcctgtgtccttggagaggctgttttctcagactggacactggttacctgtgatacccccatccccattattggttcgtagataccagtcattttgttgttgcatccttatcctagaccttatgtgctgtgttctatttctgcccaagactttgactttggcagagactgactttttaaatcactagagcctagcagttcctaccacctactaggggctcacctgtagagcatctgttaaacctaggggcaggaggtgttgggtggatgaaaagccgccataatacaagtgcttttttcccttttggtttttcttttcaatggccacagtagtaactcctgttaccaactcatactttttatctttttaatttttgcttttatccaatgactacctctcatatattatgtagctgtagattctggtgaagtttaacttgaattttaa[142 bp omitted]gcctcccgagtagctgggactacatgtgcctgccaccacggcaggctaattttttgtatttttagtagagacaaggtttcactgtattagccaggatggtctcgatctcctgaccttgtgatccgcctgcctcagcctcccaaagcgctgggattacaggcgtgagccaccgtgcctggccctactttcttatttttaactttatatttttcaaaagctggcatgcaaggcaaggtgtgcactggctcacacctgtaaccccagcactttgggaggccaaggcaggtggatcacttgaggccaggagttcaagaccagcctggcaacagggcaaaaccccatctctatttttaaaaaaaagaaaaagaagaagaaaaaactggcctacaaaagctttcattgggaaaaactctctgacatgagagttgggctttaggttacctgggttgcatgcatacaaggttgtgaatgcgttagctgagagctaggaagaagctgcgtggcatcatgatgctttggtggcctcgtctcctgtggaggcatgtgtgtggatgagttgatttccatggagtaacatttttagttctgcatgtaagtttgtctggattatatttatttaatgcttttaaaactttaaatcatggtaagcctcgatgttttagtttgctacgtaatgtctgttttagtttgctacatagtgtcaataaattgaaaaagtgttactcattctaattaaggtttcatttgtatttcttttatactttcaacagtgacattagattaactcttaagaagggagcattatggaatcatttgtttaattatttgggacatttgcataaaagcatcaatagaattaccagaaagaaattatatccttaggtttttttttttttttttgagacggagtctcgcattgtcacccaggctagagtgcaatggtgcaatctcagctcactgcaacctctgtctcccgggttcaagcgactctcctgcctcagcctcctgagtagctgggattacaggcacctgccaccacacccggctaatttttgtatttttagtagagacagggtttcaccatgttggtcagggtggtcttgaactcctgacctcaggtgatctgctcgcctcggcctcccacagtgctgggattccaggtgtgaggcaccacgcccagcctatccttaggtttcttactgactctgattaaaacatgtatatataggaactagtgctagaaggattatagtctagacttgaaaaaagattaaactgtttgaaataggaagagatttagtgtatggggaagaggaacaaccctcacccctactctgttttgggcattttaataaaatttagaagcctgagaataatactaaca[132 bp omitted]aaccccatctctactaaaaatacaaaaattagccgcgcgtggtggcgggcgcctgtaatcccagctactcaggaggctgaggcaggagaatcgtttgaacccgggaggcagaggttgcagtgagccaagatggcgccactgcactccaacctgggcaacagcaagactccgtctcaaaaaaaaaaaaaaaattagtaaaattaatgagatactttgaaagcacggagtatttaggttgtatgggaaggactgtgtggtgtgtaaactccacccggacacaaatagatactcacagaacttgcacgccacctctgggagattctcctgactccaggttcctggtagagtatctttcatatgtgagaactcaggctattttccagtcggttcctgccttcactgcaccccgactcccgggccttttttctattcttttcctcgattctgtttcttttccaccactgatcagtttcgcctattctaaaacttcatttaagcagaatcatggaattcctgttggctgcgtgattttagtggctggtctagggatgacagtgtagattctgaactttccacattgcattgtgccacacgtcgtgcagtgtgtcatttctcaaagcacttatatgtgtgggttgttttttaaataggtggaaggcttttaaaccagcataccattaatattgtattgaggaagttaatttatcaatgttatttttccttttacaattgctaataaagatatgaggtgaggagcagcaggctacagagaggagtgatgcctgggggcgtgtcagtgttttaggcacctgcagtgatcggcagcagacttgggagcaatgcggtggaggcgtgtcattgttccccaggtgtgatgcgatgaggggcagcaggctcggggatgcggtggaggcatgtcggtgttacccaggtgtgatgtggtgaggggcagcagtctcagggggatgcggtgggggcgtgtcggtgttacctaggtgtgatggggtgaggggcagcaggctcagggggatgcgatggaggcgtgtcattgttccccaggtgtgatgcggtgaggggcagcaggctcagggggatgcggtgggggcatgtcggtgttacccaggtgtgatgcggtgaggggcagcaggctcagggggatgcggtgggggcgtgtcagtgttctgcaggtgtgtgcggtgaggggcagcaggctcagggggatgcggtgggggcatgtcggtgttccccaggtgtgatgcggtgaggggcagcaggctcagggggatgcggtgggggcgtgtcagtgttcttcaggtgtgtgcggtgaggggcagcagactcaggggagccatgtggtggaggcatgtgagtgttccccaggtgtgtgtggtgaggggcagcaggctgcagggggatgcggtgggggtgtgtcggtgttccccaggtgcaggaggctgctctgagggtgtcgcatgtatttcatttaatcctcataacagctccatgagttaggttctatttttgtccccattttagcaataagaaaacagacacagagaggttaagtataaataatttgacaaagatgacatcagtgagtggctatttttattatgtgaagttaaaattgtttatgtgttgacttcatcatttaaagtgagaggaagaacctgaggaatatgaaatgagacgaggaagagagccccagactctgcggctggtagaagtagggagtgtgacctcatccccggcttcttccagctctgctgatgcccggggctgccccaagtgcgcggccggccctgggcgggatccatgttcttggtgacaaagctcctctccctgccttcgccccagcggctcgtttttattcattcagcacagagtgtgtaactgatagtcctcagtaccgcagtctaatattttgttggggttcctttttttcttttcatttaagggtaaaacctacatttagtgaaatgcacatattttaagtgtgtcatctgagtgttttcaccagttcagttttttttggtttagtttttttttttttttgagatggagtctcgctctgtcaggctagagtgcaatgcagcgatcttggctcactgcaacctctgcctcccaggttcaagcaattctcctgcgtcagcctcctgagtagctgggattagaggcacgcaccaccatgccctgctaatctttgtatttttattagagacaaggtttcaccgtgttggtcaggctggtctcaaactcctgaccttgtgatctgccctcctcagcctcgcaaagtgctgggattacaggcgtgagccactatgcccggccaccacttcagttttgacagaagcaataagccttgaaggggttttgtgcggtatgaccattgcccagagaattccctcccaccattttccagtcagttcccaccttctcccacccccaacccccaggccttaaaaactctttctccctctgttctgtttcttttccaccattgattagttttgccatttctaaaacttcatttaagcagattcatggaattccattttttatctgttggcttcctttgttgcatgattttagtggctggtctggagatgacactgtagatactgaactttccacagtctgcttagagttaatactgtaccccgccttgtgcagtgtaagaagctggtcactgtcttgcaaccaggtgccttcccggtccttgctgtggcaagtgtacatattacatctatgctatagacatcacaatatatatagtattgttgtttgcttcagtatgaatgtacctttaaaaaaattacgaggaaaatattgtcttttatatatactcacatatttaccttttttcccccaacccctaagagtggggggactcttgcctcacctccctcttctctcactccttgtgcccactgcccccttggtgtcctctctggttgactccagctgcccctccctccacagggcctgcagcgtctccaggtccctgacccttgggtggcatcccctgcctcttcctcagggccctgcaaacctctcctctcatttcaccaggagctccttttcttcccatatttgtgtaaatgaattcacatattttgacttaattgtctcagaatggcccaatttggagttggacttttctgatgctcataaaattcaggaggtggtttttaatcagttagttctgctacggctgcctcctcagagaagggaacagtttcttgttcttctattttttgttttttaatgttgttgctgaggacaatttaatttgatctctgaatcatccatgtatccatccatgcaccacccccacacccatcctatccacacacccccatacccatcctatccacccacccaccatcccccatcctatccacccacccatcatccactatcctatccacccacctgtctatccaccatccaccactcccacacccatcctatccacccacctacccatccacccacccacctatcctattcatccacccacccaccctgtctatccacccacccacccactcacctatcctattcatccatccacccacccacccacccaatctatccacccacctgcccaccctatctatccacccacccaccctatctatccacccacccaccctatctatccacccatccacacacccacccacactatccatccacccacccacccacccaccctattcacccaccccccacccacactattcatccccccacccacactatccacccacccaccaattctatccatctacccatccattctacctatccacccactccacccgtccatccatttatccatccttccattcatgcacccactcatccgtcatccatccctgcttccatcgtttcatccacacatccatccatccatccatccatccattcttgtgttgggtgctccatcttaaagttatcagaagtgtttctgtccgaaactgcagttgcagtggagaggttttcagcccaagctttttattctttttggactcccagtagacactgatgagttttcagggtcaaagaggaacattttaacaatggtgttagctgatcattttttgtttgttttttattttgagacagagtctcgctctgtctcccaggctggagtgcaatggcacaatctcggctcattgcaacctccgcttcctgggttcagacgattctcctgcctcagcctcccgagtagctgggattacaggcgcccaccaccgcacccagctaatttttgtatttttagtagagacaggatttcaccatggtggccaggatggcttcgaactcctgaccttaggtgatccgcccgcttcagcctcccaaagtgctgggatgacaggcatgagccaccgcccctggcctgataattttctttctttcatgattggctcgttcatgctctaaacttaagactggtcgaggaagtagtacgtctctgtattttcagttgctagcactagtagcctaccaggactttggagtttatgaatatctgtttagcagacggttgatctgggcaaaacttttgtaggcagtgataatttttccttttcttgaaatatgtttagaaaatggaaatcctatttgaaagcatgtttcttacatagaaggaagtaatctagttttgtgctacatgcgttcctttttctaatgtagcttatgatgcatgattgctccttcatcacctatctcccaaagactaaatactttctattttgctgaatgtctaaggatatttgagatgcttatgaggaggtcttttctggcatgaggtttgacctaacagcgctgcagagaatatatggtaattgttacggttttagcatgaccaaagagaattttcttttttctttctttttttttttgagatggagtctcgttgcccaggctggagtgcagtggcgtgatctcagctcactgcaacctctgccgcctgggttcaagtggttctcctaactcagcctcccgagtagctgggactacaggcgcccaccac[174 bp omitted]gcatataactgcaaaccgatttgtttgtggttgttaaataaagaggaccaatcttttgtttgtttatatgcactgtttcctttctcgccctagttgcatgagaaacagaagcttcttagattgatcagttgcctccttttgttgcatttgagcgttgagaacaaggaccatgagttttctcctccattgtggttttagttctaacatctggcacatagtatttagtaaagatttgtggaataagtgagatagggtattggggaagatcataagaaaaacaaaagatgaattatttatttataaatttattgttaggtctattccaaaactgacttagaaagacaaaattctttcctgctataaaatatttgtaagaactgtgttgggttggagtttgggattcacttttcccattgcagatgcttaaaaacctcagacttttcttgttgggtttctttttggggaggactttattagggataccatttatagtagaaatttggaagactgtaaaaaccacttaatattcccgaaagatggaaggttgtttctggaagctgttaggttttgttaaggcagagataatacattttcttttcttttttgagacggagtctttcgcccagactggagtgcagtggtgtgatctcggctcactgcaacctctgcctcctaggttcaagcgattctcctgcctcagcctccccaagtagccaggactataggcgtgtgccaccgtgcccagctactttttgtgtttagtggagacagggtttcaccacgttggccaggctggtctcgaacttctgacctcacgtgatccccccgccttggcctcccaaagtgctgtgattacaggtgtgagccaccatgcctggccagtaatacatctttagagagatcattttccttggaacataactgaaaatggtaggatgaaaagatgtgtaaaatgtaactgaaggtggaaaaatcttgctctgaatctctcactttcgtttgagttaaatattatttttattcttgaaggaagttctgggagtttgtagaagtagccagaaaatatctttagaatatagtgctctatgcaatatcctgagccttttttttctttttttctttttttttttttgagacaagagtctctcgctctgtcgcccaggctgaagtgcaatggtgcgatctcagctcactacaagctccatctcctgggttcacgccattctcctgcctcagcctcctgagtagctgggactacaggcgcacaccaccacacccagctaatttttgttgtattttttagtagagacaggatttctccatgttagccaggatgatctcgatctcctgacctcatgatccacctgcctcggcctcccaaagcgctgggattacaggcgtgagccaccgtgcctggcctatcctgagacatttttgacagtgctgcaaactattactattttttcaggtagaaatattttattttatgttggagatgggatctcgctttgttgccaaggttggtcttgaactcctggcttcaagtggtccttctggcttggcctctcaaaatgctgggattacaaggcatgaaccacagtgcctggcctggaaataatttttactatagattctttcctctttaaattaatattatgggttatgaagctccttttgtataataatatccaatatatgttgtcaaccagggtattgctttgctttttctttaaaaaggagaaaacatgtaaggtagaggaagtgtagtttactcttaggcattcagacagtttttattattggtgtcgtagaaaaccccagaccatttgctgagaccaaaaactgtatatttaaaattttaacacttaatttttctcctgtggcttgtgtgaagtttttaggtgtaaagcgtgaacaagtaagagattcatttaacaaaacattattttaggaaacaaatatgaaaaagcattaaaaccattcttttttctctcctagcatttttgaaacattggggttgttggagtggttggattttccctggaattgagtgagaaattcagaagactgaagcccaggcttactgtctacctttcacggaggcctagccgtgagaggacagaagaaggcatgtggcgaatcatgacagcagacaaagacaaagagaaggaccgggactgagactgggactgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccacagaggagtccacgaagaagaacaagaagaaaccaccgaagaaaacgtctcgttatgaaaggacagataccggcgagataacatcctacatcactgaagatgatgttgtctacagaccaggaggtaaggagccttacatttgggtcttgccagtgtttacaatgggggaatgatcttagcattaaggtgaaataaatacactttgtacactttaaggaaggcttggaatctagaagagtaggaaacttaatttggtaaacatgtgacccacttttggtcagttaggtttacccacttcttgcttgtgtctgccttaatttggtcttgtgtcctggtttatgcattcatgagttcttttcttattttcctatgctgcttgttctctaacttgaccatctgcttagtatttttttgtcttttgaattcatgcttggtttttaatcttcaatcataaatgagactgtggtgaccctgcagaattgactgcttggtggagacaagtaaaccttaagattcttggaaacaggaaattttaccttgggacaggatcgaccagactctagagaggtactttttaaaaatggcctttaggccaggcatggtagctcacacctgcaattctagcactttgggaggctgaggtgggtggatgacctgaggtcaggagttcgagaccagcctgaccaacatgatgaaaccctgtctctactaaaaatacaaaaattagctgggctcggtggtgtgcacctctaatcccagctacttgggaggctgagacaggagaattgcttgaacccaggagttggaggttgcagtgagccgaaatcgcgccactgcgctccagcctgggcgacagagcgagtctctgtctcaaaaaagaaaaaaaaaaaggcctgaagatcagagatttattgctcctgctaacttccttttccaaaaatttgagcttcaggctctctaatcaacgataatagaagaagtcatctaacctgcttggttttccggaaaatgtattatggtcatgccagtatattgtggcttacagcattgctcaaaaaaagacagactcaacttttagatgagatcagggaaacaagtgagtcaaaacctgttgaacactagcaaagcctttccttttcatttgatgtattgtgtgtattaagacaccttttttaggctgggcacagtgtaatcccagcactttgggaggcggagacagaaggattgcttgagcccaggagttcaagaccagcctgggtaacatggtgagacctcatctctacaaaaaatttttacaaattagctgggcctggtggcatacacctgtagtcctagctactcaggaggctgaggcaggagcatcacttgagtctgggaggtcgaggctgtagtgagccatgattgcaccactgcattctagcctgggcgacagagcaagaccctgtctcaaaagaaaaaaaaaaaaaaaaaacaagatattttcttacagaagccagtaaaacctaggtgaaatcattttgtttgagttacttttactgttgaagagtgacatgaatttcatatgagatgtaattagcagattaaagctgcccatttttatgtttttctgagaaagagattaaaatgctttactgtgttatgtccataatctggaacaatcattttactgaggaatgctgttactgttctgaacttcacatcaagttccagattttcattctcccacacaggagttttttaaatttcaaaagatgtcagtggggctgagcgcagtggctcatgactgtaatcccagcactttgagaggctgaggtggcgggaggattgcttgagcaatgtggagacctgcctgggcaacatagtgagaccgtatctctacaaaacagtaaaaaattagctgggagtgtgatgagactgtagtcccggctactcaggaggctgaggtagaagaatctcttgagctcaggagggcaaggctgcagtaagccccattcacattatagcactccagcctgtgcagcagagcaaaaccctatctccacccctctcccccccacacacaaaaaagtcagtgctagaacttaatacagacaaatttgcattcacaactacaatttcttggttgaagattaactgagaaggtattcgtgtgatataaattgatcagagtggaggttttagagcagttaaaaatctgctgtgaggattaaatgatgtgtgtaggttacagtactgtctgtatttatctttgatttagactcagctattgggcagtaagaatttcttagtgactgaagaatcagagttaccacagattgcttgtttagggcgtatgcacatctaaatcatgggaaaggaacaaaatatgttaactctttttttttattattatactttaagttttagggtacatgtgcacaatgtgcaggtttgttacatatgtatccatgtgccatgttggtatgctgcacccattaactcgtcatttagcattaggtagatcagcactttgggaggccgaggcagggggatagcttcagcccaagagtttgagactagcctgggcaacatagtgaggccctgtctatgcaaaatgaatgaatgaatgaggcattatggtcactcttactagatttgattgactgtgcctttacttttcaataaataatacatagactttcctgacctaagctttatgatgatctcaggttgtgatatgggggtaggaggaggttaactctctctatagccactgctttccttaaaatcattgctttttatttaagtgtcttaacatggcattttaaaaagcaaccttggccaagcatggtggctcatgcctgtaatcctgacactttgggtggctgaggtgggaggattgcttgagcccaggagttggagaccagccaaaaaaaaaaaaaaaaagcaatgctttacactccagtcattgagagaatcaaaaattattttccaaccactgccatgtcaaatgtaatttaagaaagcacccttcttccctgaagaaaatgcagtttggtttactttattccatctctgattagtggcattggttttgtttacaattagaaaataaaatgtgtttagagtacaatttaatggcaaattgtctataagagattagttttctttctctttttgattagctgaaaaggtcattgtagtagcatgttcaagctagtcatctttgcgtatttaatttatttcctcacaaaatatttattacaaatatagtagcacgtttctcttttttgaagacatgtgagcatctatctgaataagatactcaagatttcatcttgatgtgtgatcttgagcaagcggtttcttttatctaaatgtcttcatctgaatatagataatcccttggaatcctccccttcttcagggactctgaagaaaataatttaggcttcatcagattctttaaattattagaaaaataatcagaaagaaccaaagggctgttttcctttagcctaaagatgtttgcaatttaatatcatcttttggaaaaaaatttacaataaaagatatatgctttgtcatttatgcagtggctttatgggccctgtctttgttccttaaaggtaaattccattgtgttaaaatttctttttcttttaaagactgtgtgtatatcgagagttggaggccaaacacactgtatttcatctgtagcattcaagacttcaaactggtaagcatttttaatgtgctgttcgctctgctctgtattctctctttttccagttccattggctatctcttattgttactccatcgctgttgacgtggttaccagttcaccttttgagtgctaactgcctcgtggcagtagcactgaaatgagggttactagttccatcttttcagctttgtaacacttactctcataatgcttatattgtaaacaatatttctgaagtttttatccctttagtaactgttttgacaatttcgggtagtcccttgaatttctgaagtaggttgtttcttctcagccattgttaagagcctaaagtaaagtaaattcagtaaattgatgagtaggggaaataatataaacgggtcagagaatagtttccagtggaaatctgtcacttccttcaatatttcggcaggtgtagagcatatgttgaaattgttgtgggggtttcccggggtagcggttgaaagaagtctggcttgggcgtggtaaagctgttatactttctttccagttttagtgcatgtgttgcagaagcgaggacatagctgctgtactttctcattaaaaattcttcctgaatatataagtgttgatgttcctcattatgaaatcgcttttttagggccagtggttctcacactttaggctttggatcgctggatgtctgcagagatttggcagaggtctgcaaataaacatgctaagctttatataaatgaattgatctcacacgtctggacaacgatttttcagcctgttttcagtatgcttttatgatttttaaaaatttcacttatttaaaagcaatacacagttaagaaccactatttgttgttgttgttgtttgagacagagtcttgctctgtcacccaggctggagtgcagtggtgcagtcttggctcaccgcagcctctgcctcccggaaacaaatgattctcctgcctcagcctcccgagtagctgggattacaggtgcgtgccagtacaaccggctgttatttttatatttgtattttttagcagagaacagggtttgtatttctagcagagaacagggtttcaccatgttggccaggctcgtctccaacttctgacctcaagtgatttgcctgctttggcctcccaaagcgctgggattacaaatgtgagctgccatgcctggcaggaaccaccgtttgtttgttattttcctcaaacaattggtatttgaaatactactgaagtagtatcatttgggaatcttttgaaacattttgatcttacaagggaccctagtactttgaagattgtgaaccactgtctgtactcttaagggtagagaattcctaattccttagctttgtagagatgtgtatcactatctgtgaatgctgttatttccaacacgctttgtaattcgacaatgtttgttttctgacatatgttgtatgtgatatttcagtctaaagaaatgtagtttgaaaagatctttctctgcatctcctttgttttttatcatttttaatggcccaagtaccaaattagtatattcagtaaaaaaaaaaaaagtcacattatttttctttgttaaaaagttattgcttaagttattgcatgcttactgttttaagatgaagtcaaatgtgctatttacttctaagatgggtctattcttgataggcggcttttaccttttctggttgcattgcaaggtggcctcgcagtttaatcttgtaaatcaaatgctttctatccaatttttatgtctatatgaatttttaaaaaccatttttagaggtctttgctacttattgtatctttccttccaaagtgtgtgtttttttttttaacagatacagcactgacacctgaaatacgggtacagccttattcctgaagagttttgttttggtagtggctgctgctactgcccttttcctgcccattgtctttgtgtgtgatttttactaaaccaaacatcagtgcaccatgaaaaatatatagctgtgaaataaaattgtaaatatttttattttacctattagatcttgagcccccgtttgtacagtttttgcacattagcaggtgccttcatgtttgaacaggcatctcttatgaaatgctgattacaatgtgatagttgctgttctgggcagaagttcctgctgagttacggtaattgctcagggtgttaacagcaataaaagctgaagcttctgttgtcagtattggtctaatacaacacattaaagctatctacaaaaatatgtgggaagtagggtgcagtatgtttagatgcctttttctaaatcacacactgctgtttctcatgtttttgtttgaggttctgtattcggcacatcctcatagttgtgtaagaacaacagatgatgaaatatttgctctgggaataaatatagttatttccactgtcttattttcttacttctctgtacttattaaaagataatcaaatagatgagaatgatcaagatttttttctccttcagtttactgaagctataagggaaaaacatgagcaggaggaaataagctttgtttctctgtgagattttaaaaagaagaagaaattgaatttgattttgctcacagcaaataacatgactagtggagcaatgaaagaaacaaaaacccaatagctttgaaatgttgagtaattaggtattttatctttttaataatcacaaaataaaaagttggtttggggttataactgagagacgtgtttcattgtttatactataaatgagaatccctttgccacggtgaaattttgtgtataaagtatgtttgggcactgtaaaaataactgggtgaatgccctttatgatacacattagtaggtatgattacgatgttaaagacaacaaaagctaatgaggtgaggcgtggggaggaggagacatgtaccgccagtcactgagactagaataatggcagtttattgaaccgagggccttaggtcacatttcatgaaatagctctatgtgagataaggagaagggtctttgtattttatgtggggacctgggtcgtcttctcaattctgctgctgcattcccttagaatcgagtctgtggtatagaacacagctgcctctatgtcctgatccctgtctgttgtcctgccagactattaaacagcctcccctttcactctcaaaaatgtctgagtgtggatgataggttgtgtggttatcttgcctatggggataggatccatggcttctgctttattaatattcaaccatcaaaacacataaggacaccaccatcctacactagtaggtgtatttcgagcccatgcttccacagggtaggtggaggctatgatagtatcaagcagttaagttcctaactgagctgaggttttaaaagtaggaattatgtattctgttaggaagctttcattctcttaggaagtattcatttgattgggcttatttacaaacggagatgtctgattttgtttgaatgcgctgaccaaagtatttatggaacaagtagtcaaaagcaggagctcaggcgagcagaagaggcagggtagaattatggacagtgcatacttagaagcaggagaaagaagtattgttgattaaaaaggtcgcttcgcaccgtagatttctgaactaattagtaaaatagctggcaaagtctttatttagctttttgaaggtctagtaattcggaatgacagtctgtgatccttgtggcctggcatgaaaagattaattgagccaaatttcatttttagaatttagagttgagaaactgagagactgaggcagttagtagaggggaaaggtgaatggataattcaagaattatccctaatatgtctgtagaaattaaaaataaaaaaagaattacctgaatgacaagagcaaggttagggctgacataggcaagctcacttgctagggaaggaaactcggaaaagcagaggacagggaagctgtgggaagggcagcagactgccaagggaagtgagtgcacagccgtctcttccttgactctcctgggtcccactgcactgatgttcttcccacaggattcttagattatcctgttcactctgagtagagagctctcatctgggctagcttgagtggatcttcatgaattgcaatggaaagagcctaggttaacatctccaacccttctgctgccctcccatagcttttagaggtcaccatgtgacttagttactttgagggttttgttctgaatgagtcaatatcattgaggagcattatatcacagagtgcaaataggaatgttttgggctataatcagggccttccacaggcatttactgaataccttctttgtgttctttatggaactcagcacttaaagagagactgaagaagtataaaatattgttcattccctcagtgatcttagttagattctaagtgacagacaacttgtggcattattggatgtcagtcttctttggagaacattctgaataggattgacaagaagggcattcgcttttagatctaaaagaaatgatttcttttgtgtgtttatgaaaaacaaatcatatttttatggaaacccaggcattaagaagtataatacaaataatttgccatctggaaataatcatggagtctgagaatgctaacaaggtcatggagacagtaattttcattcagtataacactgaggagttccttgtatagtaagtagttccttgtagcagttactacctttctttattcacagataagtaagcaaactcactcctgtaatattctccatggaaattcagtgtggattcttgcattgccgtcattcatacagtagaggaaaacatgcttttggtttcctaaagttacataggtgtttcagctgttacttataccaaatgagtttctaggtagtatatgtagctataagtactattttgggttaataacattgattcattttggttccttaactgtttattaaaacttggaaaattgtccttaaagttaagccagatacagagattccttagagttgggggtgatagttagggatgttaaagtgtttcaggtgatggttagctgggctcgacatattgttacggctctgcatagatgataatgctgctgtatcatttgtgtccccaacagcctactttctaagtactagttctgaatgtggaatagctaaggatgcatactactagttaccttggagaatgcacatttccattattgctgtgaatgtgggggccaagttatttatcgtttaataccatatccctcttgttgttttattgtcaaatgtgagcagctggaggaaaaacacttggaatttctctctgatccctggtctgtactcataagttgtttgccacgcactaccctttactcatgccttccccgacagtacagcagcagaagggctgcagagaaattaacttcatcttaggttccacttgccattgagattgcccgccctccaccaaatttattttcttaaaaatggattaaaagtaacaagaagctatttctcctcctttgtaataaaaacttactgaggatgagtaattatgtcttcttttcttattagaaccatagatgatgctgggagatatcagatagcgacttaattacccataccttttgtgcacacattcaagtgtacacacagtgacttaattatcagacttacgcattatctaccgcatttctttaatcccagcttggctgttaccacttagcacagaaggtgtagtgtatggacattcatggaatgggcattcgtttaaaaggaggtaaatcttgcattggagcccttttttggttgcggggggtgggcaggaaggtccacataatttgaacatggctaattcagaatttaggatctgttattctgggattgagatgagggatggtagattgcccaggttcagagctcggacttcgacatcaggttgtctgagttcacgtactccgtccatcagttgccatctttcctgaccttgggaaatacacttaaccctcttaactttctttagttacctgtgaagttgggatataaagtaccaaccttgccaagtagattgtttttagattaaaaggtcaaacttacaaagtgtccagtgccccatagagtgacactgattgtgatgttgatgtttagttggtaccttaggtttatgctttttattcactgatgtatatattgtgtgcttatcacattggctggctgtattgtccacagtaagtatttattgaatactgaatgaagtaacatttaagtggaatcaattcactggataagtatttttaaaaaactttagtagtagttgtttgatacagtgcatacatcaacacaaattaacattctcttaaacaagccaaagaagtctactcacttacttttggttagcctgcagtgcgtaatgtatagaaataataaaactttatttattttaaaatacttgaagaaaattcagtttcttcttttcttcacgaatttgaatgaatgtagcctaagtcataacattttttaggcatcattatattgttttgggttttccatatgactgactttcagcaaagataaatgagggcctagtatacgtgtgaacctcccagaaaaggccaactgttatgaaaaatgccttacgctatgatgatttgtttctgtgtgacacatcagttgtttctgtttttgtttttgacagtccttcaaggtaggcttgcaaaattgagtatttctttctatagctccttcttctctttactttcttggcttgtaccatacaaaaaggtcagtatcacccagttacgcctttgtgacttgttgtgtagtgttggataatgaagtaaaaactttacattaaagttcattatcaagtattttcagctattatatccaaggaccaagtggccttttcatatataaatttgtgatttctaattttgtttaattctttaacgaggcaagaggcaggatggaattcttttttggagacagagtttccctcttgtcacccaggctggagttcaatggcgtgatctcagctctttccaacctccgcctctgggttcaagtgattctcctgcctcagcctcccaagtagctggaattacgggcacctgccaccacccccagctatgtttttgtattcttagtagagacggggtttcactatgttggccaggctggtcttgaactcctgacctcgtgatccacctgccttgacctcccaaagtgtcaggattacaggcatgagccactgcatcaagcaagatggaattctttagccctgagtttggtggactcagtcagaggaggttgtatatctatactcccctcccaccacaattatagagtaatggtgttgaaagttttttgaacgaccacatcctttttgcatgatattgatgtcaacctctaaatggacagggtggtattaacataagtggaaatcaaaatgaggccttgggaataaataatcccagcattttattggccccattttctgagcttcccagcaatttgtcttcactcgtggctgccagtcagggtagggcacttgggattttaagttttagtgtttaactactattgtgaggttgggtaattcattttcttctaatttacttgggtcaagggactctaagaaactattgaaaaagttttgtttaattatatgtatttccataaactatatttctgaaaatgttatttactaaaattgttaactatatgtgaaattgttttcaatgcagaaaactcatcttgtggccaatataatggccaaatataaaggccaatttatatggctgttggcaactgaaatggggaaaaaagggggtaagtttgagttcaagtgtggaatgtgagtttccccaggctcattgggactcatgacccaccaatctaaactattttgggtgttgtcctcttgggtgacattttgtagggtattgctcagaaatagcgaggcttttctccagtgctagatgcagaataagcccttcacgaggcttgggtcgggctgtagctatacttcttaacggctatcccttggttactcctctgttactagtggtggtcctgagggatgtgtaagaggcagcaggatgaagtatctgtagtgctttatcccttaaagcacagggacccgtgtgggtgatcataggggttattatcgtgtagtgcatctccctttttaggaaagttcacacttgtcttccttttttttcctgtaatggtaggacttaatggaggatttaatggtaatggtttctgaaagtcgagtatttattcttctgagtgactactgggttaatatgaaagaagtgtggtttcagttaagcattgacgtcagtgtgaagaagtgactgtggcaccccagttcatactgaattagcaaataatacaagaggatagcaagctctctcacacttagacacacacaatgcgggatactgtcaatatacggtgagttgttcagttgcagtgtagaatattaatatcttggggtgaagaaaagaaagtgctccagatgccatgtggcacttggggaagttctgtgaaggtgggtaggttttgaggagctgggtatgtttttcacacatcaataagaagtggataggcagagtataggagccttgcaggtgtacatggcagcctgtccttataagcaacacaggcagtgaggctgacgagtctgggagtcgtgagaagaagacccgcaggacgtcactgaagagcacaggttagtggattttgggaggcagatgtggagatataaaatgggtctagattatagagaatcttcaaagttagcaaagttaagattttgtgtaataggcagtagagagcttttgtaagcttttttattcgagacgagccaccttgcagaccactgcttaagaagattgactgtagcagtttgcagtgtggaacgggaaagatggtgaaagttccaagtaggaggctagggccgccattcatgggtaagatgaagaggaccaagacagtagagatgatatattgataattgtaaccaaatcaggagtaattgttggaacagcataacacgtttacatatttgctgatgtaattactcaagggtcataccataaaaaggggtggggatttcacattatggaaaccttggaattctctgtcttacggtggaagacagaacccagtgtagtatagataaaagtctaattttaattcccagagaaagactgatgtcttatgggacaaattagtagattcccaatgtgactacctacttttaaagcttcagcctttaccaatgaccaatatgtcttatttaccgatatgtcttatttccacatatatctaaaaagtgggttttactttcaggctgatattttcttaatcaatgtggatgctattattaatacttttatttactgtaatactcaacaggatttgctgaatggattttaagtcttccccataataacattaattttttttgtaaactttttatattacaattaatgatgactagtatttattttttagcaataaaaatatttgtgtctactgatgatttaaataagttcatgactggtggagcacttggtacattatatgtagatgtgagagattctgtagtgagaggataaatcttctttcagtcaagatgatggtacataaagctaactgtattgattgttctttaatgatgctttgtgctgccaaagtcatttgagctggatctgaatcagatccagttggcgaagcttccccatatgtggagctcttataaatcctgcaggcacacagatctaatacagagtaatgagatagctgctgggagaaaaaattgattacagggttgcagacaatatcattaacatttcttaccatgatacaccagatgtcttccctaatagactatttttgttaatttggtttttataggatagcattgattgcatcataatttaactttctttgcatattcaggtatatgtgatctgtgtttctacactaatgatggaataaactcatcagatttaattttgtaagttttaacttatctgttcatttttctatctgctggagaggcaacatttttacttgtactgagaatctgttagcttggatgttttctagtaaaaattactgtgttcagtggtggggagggagtagtgagggaggtaggaaggcaaagataacattgcccagaacctccctaaactggtcagaaatgattctacccgtcagctgatttacatagaaaccaggtggcaccatggcagaggctctagccaaagcaggaaaggtgcaacctttcaaggggacatacgtgcacatttatctccattgtcaagggtgtggctctgcaggagaggactcacgttggcacctatcctcttcttcactagaagatcaaggactaaagaggatattagttagttagcattttaattcttttagccatatctttttgtgtgtttgacttcttttgagtggttaacacacataataggacagtattataggggtggtttgaactgttttgagtagtgtttttttttgttgttgtttttgttttgagacagagtctcactgtgttgtgcaggctggagtgcagtggcatgatcttggctcactgcaacctccatctcttgggtttaagcgattctcctgcctcagcctcctgagtagctgggattacaggtgtgggctaccacacctggctagtttttgtatttttagtagagagagtgttttgccttattggccaggctggtcttgaactcctgacctcaagtgatcctctcaacttggcttcccaaagtgttgggattacaggcgtgagccactgtacctggctgtgtatgttttgttgttgttgttttttgagacagagtcttgctctgtcacccaggctggagtgcagtggcatgatctcagctcactgcaacctctgcctcccgggttcaagcaattctcctgcctcagcttcccaagtagctgggactacaggtgcattccaccacacccggctaattttttttgtatttttagtagagatggggtttcactgtgttagccagtatgatcttgacctcctgacctcatgatccacccacctaggcctctcaaagttttgggattacaggtgtgagccaccacacccggtgtatttttttttaatcattatttttgttgtgcattttcctttagggaactttttttcttttgacatgtttcttggtaacataggatatgttaattaacctttctaactcttagttttctcacttgtagtatgggtataataatactactatctatgacaaagacttgttgcaaaaattaaataaaataattcattaaatttcttagcaccatacttagcatatagcaagcatacattaagcattgtctattatcctgtaagactcgaattatacaaattctggtcattctttattcatttatttatttatttatttatttatttatttatttatttatttatttgagatggagtcttgctctgtcgcccagactggagtgaagtggcacagtctcggctcattgcacctctgcctcctgggttcaagcgattctcctgcctcagcctctggagtagctgggattacaggcgtccaccaccatgcctggctaatttttgtatttttagtagagacagggtttcaccatgttggccaggctagtccttgttaaaaatcagttaatcatatttgttttgttctatgtctgtgttctctttccttgatttatgtgtatcttttaactgtatcatataatcttgattattatagctatactgtaagttctgaagttgggtagtttgtgtctccacattgtactttttttttggctatcttttgcctttctatttaaactttagaataagtttgtctatatctacaaagtagtttgatggaattttaattgagattgaatgaaatctgtagatcaatttgggagaaaagagtgtcaataatgttgggattttcagtcaatggcatagaatgttttccatataattagatctttaacatgttccatctgtgtcttaactttgcttacagatctgcacatattttgttaaatttatacatatatgttttattttctgctactattgaaaataatattgctttctaaatttcaaataccaaaatttcattgttggtatgtagaaaaagaattgagttttgtacatgaactttgtgccctgaagatttgctgtgctgcttatacactccagaagatttttccttgtaggtttttgaggattttacatatagactatcatataattggcaaataaagacaggtatttttctttccaataagagtaccttttttgtcttattgaattaggtagaatttccagtgagatgttcaaaagtgtggcaacagaagttataattgcctttccctattttaaagatataacattcagcctctgaccattatgtatgatgttagctttaggttttatgagtgtactttatcaagttgagaaagctcccatttattcctagtttatgagatatttttgtttgtttggtcaatgaattgatgaatttttgccaaaaggttttgctgcatctattgatataatcacataatttttcttttttttttagcctgttgaaatggtaaattacattgattggtttgtgtgttcagtcatttttgaatatttgaataaattctgttttgttatggttataattctctttatatactattgaattctgtttgctaacattttgttgaggaattttgcatttgtgttcttcagatatattagtttttcctttttagtttatttttaatcgacaaataataattgtatacatatgtgggtacaaagtgatgttttccgatatgtatacattgtgaaattattaaatcaatatctgtcacctcgcatacttatttttttgtggtgagaacatttaaaatctgctctcttagcagttttcaaacataccatacgttattgttaactacagtcactatgctgtacaatatgtctccagaatttattcttcctatctgaaactttataccctttaaccaatatcttcccatctcccccaatcccttttaactaccattctgcttttttttctgtaagtttgactattttagattccacatatatgtgggaacatgctgtatttatccttctgtgcctggcttattttatttgtcataatgtcctccagattcatctatagatttacttatttttcaaggctgaatagtatttcattgtgtatatataccacattatttttactcattcttctgttgatggacacttaggttgattccatatcttggccattgtgaacaacactgcagtgaacatgggaatgcagatacctcttcaacatgctgatttcattttatttgatatatacccagaaattgaattactgaattatatgggagttctatatttttagattttagagaaaactccataatattttccaaaatgcctgtactaatttaccttcctaccaacaatgtacagtggttcccttttatccacaccctcaccaacacttgttagcttttgcctttttgataaaagctgcttgagcagctgcgaggtgatatctcattgtggttataatttgcatttccctgatgattgggcatttttaaacattcctattgcctatttgtatgccttctgttttgagaagtgtctacaggaggtcctagtgacaggcattaggcataagcaagaaattacatgcatccaaatcagaaaggaagaagttaaattgtctctgcatatgatatgatcttatatataaaaactctaaagactccaccaaaaaaactgttaaaattaataaatgaatttaataaggttgcaggatacaaaataagcattcaataatcagtagtgtttctatttactaacagtgaaatatctgaaaaagaaagaagaaaaaaacatgattgcatcaaaaatatgaaaaacaaggagtggcaagatctgtacattgaaaaactattgaaaatattaatgacacaaattaaagaagatacaaataaatggaaagatatcatgtgtttatgggttggaagaattagtattattaaaatgcccataatacctaaagatatctgcagattcagtgcaatctctattaaaattctcaagacatttctcacaaaaatggaaagaaaaaaaagtaattctaggatttgcatggagccacaaaagactcaaatatccaaagcaattccaagcaaaaggagcaaagttggagacatcacacaacctgatctcaaaatttgctacgaatatttccaattcagaagagtatggaattggcacaaaacaggcatatggatcaatggcacaaaacagagatccaagaaataaggtaacgtgtcttcagccaattgatctttgacaaaggtgccaataacctgcaatggggaaacggcagtctcttcaataaatgatgttagaaaaactggctatccacatgaatccttaatttcaccccatatacaaaaatcaacttaaaatgggtaaaataaacattaataaaaagataaaattactagaagagaacatacgaaaagcttcttgacattattcttgaaaaagtatttggatacaatccccaaagcacaggcaaaaaaggtttgtacattttatgtattgcaagggctttatatgagttttagtattggataatgattgactcagagaattaggaaaaatcttccctgtttccatatgctggaataaattgtggaaaattgatattatttctttcttaaatattaggtagaattcaccagtgaaattatgtgggtctcaggctttctttttggaatattcttaattattcaattatatatatgtatatccaaatagataatatatccaaattatctattttttgtgtgtgagttttggtagcttggatctttgaaagaattgacctatttcatttatattacaaaatatatgggcacatgatttatttattttctcagttttaaatttatatgtggcattttttgaatcaatttttaaattttcaataacctttttgctttctcatatatttatattttatttctttaaatattttaataatgattttaatcagtttctaattcaaaactggtggcttttggttatctaaaactattggtcattttaatttattttgtttgcttttatcttattttttgaaaatagtttgcctactttaaataatatttaatataaatttaaatataaggtctccctttcttgatgtgtcaaaatccttgaagcctaaattggctataactcataagaagaagtcccaaattttactcttttttagtgtacctagattaattgaacctggattttcagtaaattagctaccctagcttatggacatctaaaggctgaattcccagatcattatgctgatataggcagttgttttcagtctaattccctaatttcgtatatccttacttctcactctagtttctgcttataattatcttcagctgtctggagaatccatttatttcttgcaagctaaaaatatgcatcataaatatttgtttagggtgtctcaaaatagattttcttaaataatttgataagcaaaatcttaccttcgttaaaatgtaaactacagaaaataaaactaaataatacgtagtaggaggtagggactaaacaaatacatttagaaaacagatagaactgagagaaaaatttataaagatggcatgtttactacagtcatgttatatatattttgttgtccatacagagaaaatagctaaaaaacgaattatagatcttcttataattgtatgtcacaagctagatattacttacacactgaaatatatgaactttattgctactaaaatatctttcaaaaaatggaatttctgaatatttctttgttagttttgttcttgcagctagtttatttttatttttttgagaagttcagtatgaccatgcaaagtaaaagctgattttacgatcaatcacctatattttatcatgaaataattagtcaatattacacacacgaattatttagagtgatgaatctctacatatgtcaagcagtgatagcatgtgaccttctcagcttgaaagacatttgtgttaagtatcaagcaaatgttattaaaaataaaagtggagattttatgctaggtaaaatttctatagcaaaggagattacataaatcaaattatttcaaaggctgtgatagagtcctaaataataaataaccttacatcaattaggaaactggtaaattttgtattttttgtgttaccaaaattccctagaaaagaaaacaagactttcagtaaaattaattttcccaatttcagtgtaaattataaagtttatgatctaaatgaatatattaagttgcatgtttgaaaaactttaaaaatatgtttgtaataaaactatacctaaaagaaattgtttatttacataaaatacactatattaaagatattattttatcataatcgggtggctactgcaagccaacttggaaattgtgtcccaattgttttcaagtaaatggc[367 bp omitted]atgcttttgtaattggagaattattatcttcagtaggaacaattttgtgtaaaggatttatcactttgtaaagagaattacacctcagtgctttataaaatacttgcttagttaggaaaatgaagaggacaacagagctttatcttccatattttctagggtagaaaacatgataaaagtatgtttaactctccaattaataaaatgtgatcaatcataaatatatatatatgaacatgttctttgtaaaatttcatgtatttcttgccaatatttatttttcaatttgacttctaagtaaaatttatatttttatttttaagaagaaacattgcaacaatatttggaaagtttggtatggttagatagacattaaattctacagttttacttgccatccggccggatattaaaataacatttaactatgcatgtagagatgcctgggttcgtctaggatgttcattacttcatctgtcattttattccattagtaaacaacctgataacgctttttttcaaaaccagagcaagaatgtactacatagacggccttctaggttatgtttcaatgtttgtattggaaataactttttccaaccaataatttaagtagaattatacaaagaataaatattagtacagattgtagctctgtttcaatgtactatatccatgctaattaatattatgggtagacggcttacaaacgatacactaatataaaagcaattcacattaactttaaatttatgacatttctcataaatgttctgactaagagatttctataaatttttatagtattatgtaatgactagtcacccatttaatgcttgttgttttggttcagatatgtcatattagagaagtctccttgttgattgtcaaatattttctctctgaaagaaactgagatacaattttctggaaggataatcagaatgatacatttttaattcatttattttaattttgttattaaatatagaatggtcaagaattttgaaaggtattataaatttcaaattaaatatacataaaatttacataaaaagcacgtaataggatccattatacaccagaaactgtccctaaattccaagaaaataaaaatgaacagatatgaactctattctacagaaacacaatgtactgaagtgaggaggcatatacacaatgcactgtaacaaaaggcaaattcctcgggacacagagaaaaatgagcatttacaagaggaaaatattattctcatttgggtggtgtatatgtctataagtatcatggtggggtggaggaggtgactactgaactgtgtcttgaaagattcataatacatatgaatatgataaaagtgcattcagaaaaaagctaagacataccacaagaactttgtgagagaatagtgacaaaaactgaataatagtgaaaggctttaaagattaaaaatgcaaattgtgtcatagtattaagaaaaaatacaaatttattaaaaataggtacatgaaaaacatatacagaatcatagacttttagcacataccaaaatatacacaatagcttgcacatagtcggtaccaaataattgctcaataaaacagatgaatttatttattttattagattatatggctctatgatcttgaaacttattaaagattatgtactttttaggcacgaactgagattgatttgctttgtatacctagtaaccattactatccctgaaacattagagtccttaaataaatgtttgctaaagattgttaaatggattaaaatttgtgcttgacttattgtggaagctactgtagttcagctaatgtaagatagaatatacactgatttgattttatgtaaataaaccaataaatcatttgtaagattgctgaagaacatcctcaatctctgtcccagaaaattttactaccttttaaaagaacacattatttttgtgtaaaatattattaacctttaatcatgacgagttgaaagaagacatttacatggtggtctcttgggaagctgggtagacaatgtgtatctgtagaggaggataaaacccagaactcctagcagtctcttgttctgacactgtctatatactgtattccccttgcccctgtggttttccacgtatgaattgagtttacattgcttggactataattgctcatccctaccacagttactttattagtttagctatactattgggaagatgatttttcatcatggttatacaaatttgtttataagcctatttaactcaaatttaaattatgctgctgtgggtaaaaatagtaacaagtactttttcatggatttcttcagagactaactaaaatgatcaatcagcgtgtccaagaaaatatgagaaaatttatctttcagaaatgttttgtatgaaattctcaaatgcttcaaaggcttacaactttacatgaaatgattaaagacagatttaaaaacaagaacaaaatccacaattattatccacattacttttgagtactgttaatacagccattacagagacctccagatagaaggaatgatagtatctaaataatagaaataggatgattaagttgcatttatttaaaaacaagtctttttggttggaaataggatgtataaaaaagctcaataccaaaatttagatgagatgtacatttattggagagaataaaattgttgagatagtttttaacaacaaaaaaaaacccggaaagcatacaaaacaaacaaataaaaacctgaattagagctttggacttcctcaaatcacattatttgtagtggattggttgactccattttaagatagaggagacgaacaagatggccgactagacacagccaggaagtgccactcctctcaagagaggccaaattattaggtaaaccaccataatttgaacaggtattcaaggagaaaatgctgaaagtggatggagaggcaaggtcgaagccaagactgaagaggcaggaaggtggaaaccctgacttagctacccaaatgccagggctaattcctggccccaaacaattccagtaaaggactgaatgaaggaactgagggatggttcactcttgccatgagcatttgattttctagctacaagggaccttacgcgaccatggatgtgtgagctggcagggggatctccctggggagcaggcagagacagactttggacagcacagagcccaggagcttttgtgtgctggactgctgcaggcaagagcagccatagatgcccattccccagggatttccattctcctctgggaggcatggacccctactgacctccaagccaggagagagttgggccagctttcctgcacgactggggtgcatctactctgcaagcccttctgcctaccagcccttcccagggtccatgcctagctgccctgtaggagcaggtgcatagtgcagccctggaaggtcagcctgagtgtgtagttgcacccacatattttcttcatgaccctggagcacactgtatcccccagtggagcaagaacccaaacccaagccatgggatatcccagtgtccccagggctgtagtgtgcagcttgggagtatggaaccaagatttgtggctggcactcaaacagagaaagagcccccaatctcagagccatgagaggggtgagatgcacggattcctgagctggggtaagagtggaacatgcctcccttctcaggtccagtccaaaaagcatgtggcatatctccctgccacagcttctgcccaagaagaccatgtggctcagaaaaactaacaaaagaaatgtgggcacagcaccagctatcagagggagctctctcaagttttacaagcagatctgttgagggaaccgtatcactccatatcactgcagagcatatctgtgaactcaagaagtacaaaaaagccctgtgaccaggtattaacctagctaccagtcattactgttaaacctcattcactggattgccacccaaactacaacacctaaattttattctgctaatatatacagctgtgaaaccaagtcaaaaatttacccacacataaagattctgtaagagccctgggcctctaaaagcattcagaaattaagccaactgactattctcaacttacaccacagttaaagaaatgccaaccctcccagatgagaaagaattagcacaagaactctggcaatccaaaaagtcagagtgtaccctcacttccaaatgatccactagctccccagcaatggtttctaaccagtctgaaatgactgacataacagacacagaatgcagaatctgtggccaggaaacccattgagattcaggagaaagtgaaattcagtgcaaggaattcaaataatttagtaaagcaatccaagagctgaatgataaagtagccattttcagaaataaccaaacttaaattctagagctgaaaaactcactatcagaattttatcaaataatcagtagtattagcagcagaatagaccaagctgaggaaataatctcaaaacttgaagacttgttctttaagtcaactcagacaaaaataaggaaaaaaatgggaaaaaaaagtgacacctccaagaatatgggattttgtaaagcgaaaaaatctatgactcattgtcattcctgagagaggagagagaatacgcaacttggaaaatatatttgaagatacagttcatgaaaattcctcttatctctttagggagatttacatacaaatccaagaaacacgcagaaccccagatagatatgacatgaaatgactacctccaaggcacatagtacaatattcatcaaggtcaacactaaagaaaaaagtcttaaaggcagggtaaagtcacatacaaggaacttcatcaggctagcagcagacctctcagcaggtagcttacaagtcagaagagattggtagcttattttcagcatccttaaagaaaataaattttaaccaataatttcatatcccaccaaactaagcttaaaagtgaagtgaagcaaatgctaagggaatatgtttcaactagactagccatacaagaggtccttaagggagtgctaaacatggaaaagaaagaatgacagtcataccacaaaagctcatttaaccacatagcacacaggcgccataaagcaaccacataatcaagtctacataacaatcagctagcaacatgatgacagaattaaaatcacagataccaatactaaccttgaatgtaaatgggctaaatgctccacttaagagacacagagtggcaggctggataaatgacccaaccatctgttatcttcaagagacctatttcacattaagaacaaccacaggctcacagcaaaagaatggagaaagagctaccatgtgaacagaaagcaaaaaagagcagaagttgctattcttatataaaatagactttaaaccaataaaaattaagaacaatgaagggcattacataatgataaagggtacaatcaaacaagaaaccttaactgtactaaatatatatacactcaatattggagcacccagattcataaaacaagttcttcattgcccatgaaaacacttagacaaccaaacaataacagcaggagacttcaccaccccactgacagcactaaacagatcattaaggaagaaaactaacaaactctggacataaactcaacactttaacaattggacctaatagacatctacaaaataccccaggtaatatccacagaatatatattcttcccatctgcacatggaacatattctaagatcaaccacgtgcttaatcataaagcaagtctcaataaattcaaaaaattgaaattataccaagcaaactcttggaccacagtgaaataaaaatagaaatcaaaatcaagaagacctctcaaaactacacaaatatagggaaattaaacaacttactcctgaataactcttaggtgaacatcaaaataaaggtagatttaagaaaaattctttgaaatattgaaaacaggaatatgacttaccaaaatctttgagatgcagccaaagcagtgttaagaggaaagtttatttccctaaatgcagtaatcgagaagttagaaagatctcaatttagcaatctaactttgcacctaaaggaactagaaaagaaaaagctagcagaagaaaaaaataactaaaattagagaacttactgaaattgagatagaaaaatccatagaaaaaataataaaaaagcaagagtttgttctttgaaaagatgaacaagatggatagactgctatttaacagctagatttacaatgaaaaaaagagaagataagtatagtcagaaataacaaagataatataactgatcccacagaattacaaaagtttcccatagaataccatgaacaactctatgcatacaaattagaaaatctgtagatgaaattgataaattcttagaaacagacagtctctaattgaatcaggaaaagattgaagcattgaatagtgaaatatctcactctgaaattgaatcatatgtaataaaaaaaaactaccaccaaccaaaaaagtcctagaccagatggattcacagtcaaattctaccagatatacaaagaaaaactggtacgaattctactgaagctattacaaaaaaaggagggaatcctttcaaactcaatctctggcagaaacacaatgaagaaagaaaacttgaggccaatgtccatgatgaacacagacaaaaaattctcaacaaaatattgataaactgaatccagcagcatataaaacagttaattcaccacgataaagtaggctttattcctgggatgcaaggttggatcaacatatgcaaatcaataaatatgattcgccacataagcagatttaaacacaaaaactatctgatcatctcaaaaaatgcagaaaaacttcaataaaattcaacatcacttcatgataaaaaccctcaacaaactagacatcaaaataatatgactcaaaataataagagtcgtctatagcaaacccagagccaacattatactgaatgggcaaaagctggaaacattcccctggagaactgaaaaaaaggcaagcactctgaccatttcatattcaacgtagtagtggaagtcagagccagagcaatcaagcaggagaaaggctactggaactaataaatgattttagcaaagttccatgatacaaaatcaatgtagaaaacatcagtaccatttatatgtgccaataacatccaggctgagagtcatattaagaacacaatcacatttacaataaccacaaagaaaatgaaacagctgagagtacaggtaaccaagaaggtgaaaaatctctacaaggagaactagaaaacaatgctgaaagaaatcaggtgacataaataagtgggaaaacattccatactcatggaatgttttaatgtttcatagaaatgaaaaatcaatatcactgaaatggccatactgcccaaagcaatttacagatgcaatgctattcctatcaacctatcatagaattagaaaaactattctaaaatttatgtggaaccaaaaaagagcccaaatagccaatgcaaacctaagcaaaaagaacaaagctggaggccttacactatcaacttcaaacaataaggctacagtgaaaaaacagcatagtactgatacaaaaacagacacatagactaatggaacagaatagaaagctaaaatataaagctgctcacttacaaccatctgattttcgacaaggtcaatgaaaacaagcaatagggaaaggatttgccatttgataaatgtttcaggttaactggcttgccataagcagaaaaatgaaaccaaattcttatctttcactaatacaaatatttactcaagatggattaaatatttaaatgtaagatctcaaactataaaagcactagagtaaaacctaggaaatactcatgtcagcactggccttggcaaataatttttggctaagtccccaagcaattgcaacaaaaacaaaaattgacaagtgatacctaattaaactaaacagcttctgcacagcaacagaataagcagacaacctatggaatgggagaaaatattcattaactatgtatctgtattagtctgtttttacactgcttataaagcattacttgagactgagtaatttatttaaaaaaaaaaaagatgaggtttaattgactcccagttccccatggctggataggactcaggaaacttacagttatggcaaaaggtcaaggggaagaaggcacttcttacctggtggtaggagacagagagcaagaaaacaaggaagtgccacactttaaaaccatcagctgttgtgagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcctcatggccaagggggtgggcaagggctgcagggaggaagagtgtaccctgttccggccagtgcaccaggaacggctttctaacctgggcaggaaggcgtgaagcattcaggatgtgggggggcacacagttcccagtgtgcgcccagggatgaccaagagaaggagaggcgccagggcttcccctaccctagcccgagggggactccctagccaggatccagcagatcctggctaggaaacgccagtgaaccatagcgccagggaacaggaccaggccgccggctccgcccaccgctgcggtcttgggggactgggggtggcccttgggactgctgtggagcctgggcctgacccactgactaggctgagccgggagactggagagtcgcatctggagctgggcccggggacgcccgctggcgggaggggtgcgcgcgagtcggaggccgcggctgaccctgctccggtgccgccaggtaccgcatcagcccggacagcatcatcctgtaccggcagagcatcggcacagtgcccaccgtggacctggcctcgcgctacgagtccgccgcggtggtgctgcactcgccgctcaccttggacctgagcgtcgccttcccgacaccaagaagacctactgcttcgacgccttccccaagtgagcaggctggggcagggacaggggcggggacggggactgggtcggggacgggggcggggcggggcggggcccgggcccggagagttctcacccgccccacgcccctcccgcagaatccagaaggtgtccaagatcacgtcgcccgtgctcatcatccacggcacgaaagacgaggtgatcgacttctcgcaggggctggcgctctaggagcgctgccccaaggctgtggagccgctgtgggtggagggcgccgggcacaaagacatccagctctacagccagtacctggagcgcctgcgccgcttcatctcccaggagctgcgcagccagagcgcctagcggccgccggggccccaaccggccggacctcagcaataaggcggcccccggacctcaccccgcaccggcctcctgggggctgcatgtggacccccaggtggcccgggggaccccgcccggatccaggggccgtggacggtgtacaacagagctacccactcctttccttttggaagcaagaagaaatatgtgaaaacggaaattaaagattaaaaattttttttaaaaaaaacacaatgtttattaatatac[136 bp omitted]gcctcccgagtagctgggactacaggcgcgtgccaccatgcccagctaattttttgtatttttagtagttacggggtttcaccgtgttagccaggatggtctccatctcccgacctcgtgatctgccctcctcggcctcccaaagtgctaggattacaggcgtgagccaccgtgcccggccgttttgcacagattttttaatgcagaatcatgttggcaatgggtaatggctaccaaggtgccatcgttccacattcctgttattcagtcatcacatctactatgtgtgagccataatatcttctaaaatgaattataactatgttcgaattgttatttcactaagtaatctctgctaatttagtctctatttcatctcaacggaatgccttctgagttcctataattgtgactaattctctgagacaacatcagcagtatcactataaactatgaaacctacaaagggaatttcctctttttcctttttattatagagatgcttttttgtttgttttctgcaagcaagcacagtcttaatcaattttgtatgcccatacctaggagagcccctgattcataataagacctcaataagatttgttgaataaagtgaaaataggattttcagctttccctcaccactttcttcaaaacagactagttcataactgaaataggcattgtttctagaaaacggtcactccagctgatcccttcgtttaatcatttttgtactccctgaatctatgatgatacctggcacatagtgggtaagtaatcaatatttgttcactgaactaatggaaggatgagtgaatgaaacaatacaggcattttaaaattataattcaaaattaacatattacttgttattagagtgattttaaacagttaagtatatgataattaggaagatttactttcctgcttcatttaaattttaaatatagtgatcaaggtaatcatgattttcattcatttatgcaataaatgcatatttaatattttttatctcacatgatagattgctgctggtcaaagacattacgatggtattatacataaagatttgttttaaatttacagtatcttgaaatttttctcttgttaatccacaaagtatatttatacattgggaaatatactttttaaaatgtcagttaatgatatttttattttctattttatcttattattattgatacaagatctcactatgtcacccactgctggaatgcagtggcataatcatggctcaccacaacctcaacctcccaggcccaggtgatcctcctacctcagcctcctcagttgctaggactacaggtgcccgccaccttgcccggctaactttttcctttttttttttttttttttggtagagatgagttttcaccatgttgcccaggctggtcttgaactcctgggctcaagcaatctgccagcctcagcctcccaaagtgttaggattacaggcatgagccaccactatggggcagataatgatattttttcaggaatcggtaaaacattgtccttcaatgaattagtgcagaagcatgaaaaaatctattctgagcaaatctgtgaaacagacattgaaattagtattctaataaggcttttgtgctttttgatgatataaaataattttgctatgacaatacagttacttaaatgagaagtatgaataacttgctttgatatgtttgtggtatgtttcacttattttttaagaagggaaattattaaatttaaactctctatatatgtaaagagtgcacatcaaatattttaaagccctgaagaattaggtcttcatttcaagaattattaagtgtcttaagaacatatttattttctagaaatgttgagcctcttcttgggtaatgtgattcttttaaaaattttgaaaggattttcttattacattaaaaatgaatgtatgcaataggaagttactaggatagagtgaatttagcagctatcttgctttgttacatatgtcttataaattaaaattatattttcataattaaaagccaacaagctcatttgcttttataagactaagagaaaaggagtattaaatgaagttaaattagattttaccatctttttaataagtttcaggcctggtt[224 bp omitted]ggggcaggaggatggcgtgaacccgggaggcggagcttgcggtgagccgagatccggccactgcactccagcctgggtgacagagaaagactccgtctcaaaataaataaataaataagaatttagtgagagctggttatagtttggaacctcatttgtgaaataaaccatgtttcaaaatattttaagcagaaatacatttaagttgtagcctacaaattaccagaatttgtcctagtcacctaaataaaaaatgtaaaagttctacattttaacgtcctttcaacattttatgaacagaaaacccggcaggtaaacagctcaagtctgaatgggaaatgataacatataagatcagcagcatccgcgcaaataaaaagtcaaatttttatccaacacaaaacaattacatacgcgttaatcaaaaagaaattagcaacggccaaccccaatcccattactttcaaaaaaagtcctctaactttcctttccagttgaatgtacactgattgaaatggttgttttatgcggacaattgatttttttaaatgaaatgtctaatagggaagtcagtacattacactacccattccagaaagcagccttccattgaatttactcaaactaattgctgaattagatgaccatggaaagttactgagggcatatccagcactttcttctgaaccaaaactaaatctgttttggtcactactgcattgctattcaaaatcaaggactgttcgtctctctggaatattagtatcgtaagcctggggaggtgacaatatcatgtaagggagttgtggggaaaggagtcagagtgttgtggcaattcccggaccaagggaaagagtctgtagaagttcatagaatcagctgacatgctacggtcaaagaatttgcaattagcaattgaccaatcaattttgattaactcattctgtatgactatcataggctattaaaaataggaaagcgtgtttctaaaatgggtttcataacaagtgatttaatgataaaagcttggacagttttcagaattcaaaaattccgagatactaatatctttaaaaactcctgtcattgtgtgtgtgtgtgtgtgtgtgtgtaaacactacctgtgtaatcatctattgagatttaaattagaacattttctcagtgtatccccgttctaaagttactatttattatattgctatcctaggaacagagtgagaaaaggcaaagaggtaatttaacacagtctttttctgctaaaatcagagtgtctctcatctctgcctgaatccaatacattgtgattactgaaatacatattatagaatatctacttattttgtggatttaggcaacgattatgattgttgcttttctcacatctaaaaatcaaatttatattatacatgaagacattttctaaagaacttttggtctgtataaaaatgaatacttaatagaaacgtaatattattttatgttatttgaattgttaagtttaagaaaataaaatgtttttaaatctattacttttaacaacactgtaacatttattggttttggaataaaatagatccagaaaattgctgtgatattactttttatgtttcttattgaaagtaggtcaattaatttctaagcaatggggcattataattgtcaactaacagtgctcaagcagttaggattttaactgctgacattattttctttgaaaaatgatagatgtcatttagtgtttaaagataaattgctgcataacagtgacttttttgctgataactttgccataagcaaacataacatgaccaagaagtttcaaagtgagttttctaggcgagcaaatctaaattaaaaaggctctcatatttcctcaatcagatatactaacatcaaccaagtgttgttttcaatctataatatgaaagggcaattgagtctgactcaaacatctgaaaaagttaatgttaacacttaggaatatgtctccgtgtaggaaaattttcactggccatgggctataccacatttatcacaggtgattttcaaggggacaaatattgcccatttcagaaacaggtttggaatgcaggaaactgccagaaagtaactgtgagagtttgcaccatggctgacctggaggaagatgtcagagtcacagatggaaaagggaggtgcatgactcccctctgttgccaaggttcccattctcaattcagaagggtttgcggagggggtgaaggaacattgaagtttctgagatattccttaaggaccaagctataattcacagctatctatttacatcagatctcagcttttttttttttttttttttttttttttttttttttgaggagggtgcaggaggagatgtgcgcagaacatatgtatatggcttgccctaaaggatgaaataaaattgtgtatgctatgacctctctaggaagcctctaaacttttcttataaattgtcttctaactaaaatatttcttttggccgtccttggagtactcccaggtgacacatagctcgggctaacatttctacaggactgctaccttgatctctagagagtccaatgatgttccataccaatatgtctcagcgtcactgccgagcttccacccacacccttaacacacagagaaagctgacactttctgttagctataattttccttgagaaaaacgtggcaatatgtagcaaaatacaattattagtttcaatatgtagaacgtattacaagaaaaaaaagatgccaaaaacatcttgtgtctactgctgttcctattagtctttattatcatgaaaaactggtcgcatcctaaatatccaactttcggtgactgggtggaggaaaactgtaatttttccatatgatagaatagtatgccagcactaacaaccagagagcagactatttaatgtcatggtaaagtatttgttttgtgtggtcaggtgagcagttcagatcataaaatcaaatgtaccctatgatcttattttttgaagtaaagtactgatgtatttatatgtataattaagtatagagaaaagcctagatggcttctcttataagtcttttcattgttttataaatggtatcaatatttatttttcactttttccatcagatttcctagaataataaaattcaattccctctgatgagcattcattattctttttttttttttttttttgagacggagtctcactctgtctgctagagctagtgtgcagtggcctgatctcagctcactgcagcctccgcctcctgggtcattattcttacagtaagaaaaaatgaatgttactatcttctctgtcctagatcaactaagtatatacaaggtgccaaatacatttaatgaaatgttttattcattcatagctttttgcagtacaattttttttgtatgattcccttgtcctatcatctccaccaatagttttggtgtgaatttatactctaaaggaaaggtgacaaccttatacaatctcagggcttaaatactatccacgtgctgatgcttacaaacatacacctccagttgtgtggtctccctgagttctgcacatccctcttgggcatctaacaagcatctcacagttaacaaaaccactgatttctaatcaatcccagggaccctccgccaggcctgctcctctctcagaattccttttctcacttagtgacactatcatcccaccaaacctcgctatcatctttcttccgtctcccaaatttccaatccattaacaaatcctaaaaaccccgcttccaatatttgtctaaatctatgcacttctcagcttatccactcttattattctagctccaattatgtggccttctgtctgtgttactttcttttttccattcttgtacgcagggtccagttttcatagtgaagtcctcataaaacatgtattaaattgtatcagcttctgcttacagttatttatttatttattaaatttgtgatgtatttttatttatttatttattttgagaaggagtcttgctctgtcatccaggctggagtgcagtggcgcgatcttggctcactgcaggctccgactcctgggttcaagcgattctccttcctcagcctcctcagtagctggcattacaggcacgctccaccgtgctcagctaatttttgtatttttagaagagatggggtttcaccatgttggccaggctggtctcaaactcctgacttaaggtgatccacccacctcagcctcccaaagtgctgagattacaggtatgagccactgcgcgcagctagtttctgcttacagttttaaaatgacttcttagtctatttaggagaaaatataaactctttaccagagcctactggactccccaaaacatgatgtatgtttatctcctccctttaactcactctgttttagccacctggccttctgttctctgaataaaataaacttattcctgccacagggcctttacacctactttgccttctgccccagacacagttctcacaggttttcccatgactcctttcttctccttattcagcatcaacccaaacatctgcccctgagtggccttcaccagcacactcttcttaaatatctttccttacctcaccttgtttggttttgtgcataacatgtgtcagctacaatactggtttcattggtttgtttatttacttttttcttacaatggaaagcccatgagagcagggttgtgtctgctttattcacaactttaacctcagtgcctgtacagaaccaggaccgtactagaaactcagtgagcatttgttgagtatcttgaacgaattaattattaaaacattaaaaagtgacattttccaagtaaaaatctttatctacttccttagtgactctaattgcagacaatgcaaggtagaaatgaggttcagatcaatggcaggccaagaaaggcatttttgggtgagtccatgcaggcaatgtttgctattgtggctgatttacttccatatactttaacacaggtatgtccctattgtgagacacggcatttttcatagtataaaggtggaaagcgaacttcatgttataataaaaaataaagtaaattttatacaaacactaagaagtgatcatctaaatctacagtttagaatctgaaacctattcctatgttgacatcttccatggccctactccttaattaataaattctgacttacagaaggctattttctgaatcctttcatagctgacattgtggtgggtgctgttagccatcccttgatactgacagcacaatggccatccctgccagggcacgcgtacaccatcagtagtcaaaagtttggcaaagtaggccgggcgccgtggctcacgcctgtaatcggcactttgggaggccgaggcaggtggatcacctgaggtcgggagttcgagaccagcctgagcaacatggagaaaccctgtctctactaaaaatacaaaaaaaattagccgggctgtggtggcacgtgcctgtaatcccagctgctctggaggctgaggcaggagaatctcttgaatccaggaggcggaggttgc[135 bp omitted]catgaaagagcatattcttagatattaaaggtaaattttcagtgacacctgtgcaagatatgactttccgctgtcctctataaaaatctacatttctatcatataaatctagcagatcttaaaatgatagacctcaaaggtagcactgcattttatattctcttgcaaccccagaatgaaacttaagcatgaataattggagatctgcacactcctataaagaataaagaatgggactcaagttcacacagaagctaaaaaagaaaggcaggatgacttccctctgccaccttgaaaaggctttgaaacctacgaaacaagaaatggggaggggggttgctgaatgggtaataaatatatgagccctcctcctaagggtttttataatcctttctatcttgggtatctatgtgttcctctgtgaatgtgttttcttataacggcacttctcatggaacagctctatccttattatctgtaacagggtctctgttctgctttcatcatgtatatatcttagaaaaacaatctgaacaaatgtccagttaatatgtatatttatgtatttataaattatatgtatatgctattgcactaatatattacatattttatataccttactacaaccaaagaaatataaaagaatgagatggaataaatatatatttaagttctagtttttcttcctccatcctctgtggaatgcttaccccacttaagaaacccctaagatttcactgtgtcctcacagtgagattgtactcactcctcaatgagagaacattaatattaaagctcttttggttttattatcaattatgcggtcgaattttcaaataatctagctgtacatattatactacagtggacgatactgtgaggtaccaactggaccagctcagcagaggctggaaggtttaactcatcagtagtcatgataccacttttctcttagacttttccaatagaatttatttttggttttgccagccagggtgagagctgttttctataggtatcaatggtagaataagcattgttgcctcacagaagggagaagtctacggtattggacaccaacccccaagtccttcttacatatcctctccttgagagatagggactcgtgaaaaatggaaacccaggaattggctctgcataaacttaagctttgtctttgcagaacaattatgagaagcctactactggctctggaatatgttgtatgcaataaaaactctgtactatttaggtattgtttctgatgcacgatactagaaataagcatcagctagccatgcaaagttctgcttaggaaaaatgaaagtatattcaaatataaatttttataaaatgactattaactaaaaaaaaaaaatagcctttctttccccaaacatcaatagatgcagaatgcagagtaatatttacaacatgcaacatcatgtttggttctaattaatagactatttcaatgaaatattattttgataaatatgttcatgcttcatttgtcatgtattaaaaacagcaatacacactcacttgatgaaaaatattattgaagataaaagagaagtatttcataaacaaccattaggtagattataagataacatataaaaggtgatataggaaataaatattagaagtacatattattcatctatgacctaatttgtattgaaatgctgcaaaaaccttcatagcaacattcagagaattacctgaaagaaaactctggcatcttctatggtcttctatgtgttttctttaatggtcacagtgattcccacgttcaaacttattcactgaagacaatgcatgtcctgagattctcattattgaaatgctgaggctgaggcttgcttttcacatatacagattgtccaacattaaaataccactgcatattgactgcatacaaaaatcattaaactaaatattcccaaaagtcctgatacaaataatgtgttacaatattttaggcaggattatctgatagggttaacaaatttatcaagtataacagaaagtgaccacttattatttattattggctataccaaaaaatataggatcaggacttacctgaataacatgcttcagtttatcaataatctgatttatcacaggatcagttcctttgactttgacttcaggatttccagactgggctttgattccatttccaaccacatgctgagtataactagcaaagggaaatgtgaaagatatatgacttagtacctgatcagagtattatctgccacagctatctgaacatagttgaggtcagaatttcctcctttagagaatacaccaatgtgtttttttcttggaacagaaactggcacagctataatgcttttgcaggtaaaatgctaaaatgcttattgtgccattagatcattctaaaaataatgttattctctcaatggacccaaccaaaaattacttgttttttaatactacttaacaatatgctacaaagagttgacatatctcactttgttaccagttcttgctgaattatacatatgtctgtacccctattgtctgggtgagcttattttatgcagtcccaatcttattttttaaatatcaggctactatatatgtgtgtgtgtgtgtgtgtgtctatatatatatagaatatgtatagagaatatatataggataaacatatagaatatatatagactatatagaatatatatagactatataggatatatatagaatatacatagactatataggatatatatagaatatacatagactatataggatatatatagaatatacatagactatataggatatatatagaatatacatagactatataggatatatatagaatatacatagactatataggatatatatagaatatacatagactatataggatatatagagtatatagactatatataggatatagatagaaaatatgtagactatatacaggatatcgatagaatatatatagactatatataggatatagatagaatatagatagactatatataggatatagatagaatatagatagactatatataggatatagatagaatatgtataggatatagatagaatatagatagactatatatagaatatatgtagaatacagatatagaatatagatatagaatatatatggaatatagatataggatatatatagatagaatatagatatacacacacatatatatttcctaattaggtccttcaagaaataagtgattaaactttttaataatgatagtatcaattggacatgataacaataatgttattaataaactctttgatttttaaaataaacttgaacccatttcttttcatagtcatagaggggcttagagataagaatttcagtatccattagggatttgcagtatacaccagtaacaaatagtagaaagaaaacagttatatctattttgttaatgtgtaatgatattctttactttagaaaataaaattatatatagtatatctatatataatatataatatctattatatgtaaaatatatataactgtacaagtcaatatcataaattataactgtacaaattaaaatcatcaaatttataagcaacgaaaatgtgcgaagtatttcctaagtagaggaaacaatctgctttcgcctaggttcacctaaacaaagatctggtaaatcatgtggtaggtaaaaagggtcatttcacaggtggtgaaagccatttgaaatttcactaccttccccaaattacaatcatacgtcaacttagaattaataaaaatatttaaattcattagtcgcaaagatgtcttaagtgaatgctatattccaagtcctgtactaggtctttaggattataagaaggtgtaagactcaatttttgtcctcataatgctcattacttaaccaagaatataacagattaattaactcattcatttgtatgcttattcattacattttactacatttaaaaaataccgtagatttcagccatataaatacccttgtttgcctgacagaagagtgtaatataaacacaactgaaccgttaaaatacaacattatgaaagtagatggaaggaactgcacgtgccacgtgtgaggaaagataagacaggtggtagatattctggatatagagaagcccatttgaactcagacactagggaaaaactaaaggagaagttataacttgaggtagccttggatgtattgaggtaagaagaggacatctatggtatggttaatgagaacttcagggcaaaggatgtcatcccagcaaggaaaacggcaaaggtacttgaacaaggcagacagggagaacaggcctctattcacaaagcagagagtacaaacgttggaaagcaatggatagagggccacaccctgaagattccaccctgaatgttgaagactctccactgagtgatataatgggctctggagattcataagggggaagttggcaggtgggtgtggaataaaaaagctacatgtttggtacaatgtacactactcaggtgacaggtgcaataaaatctcagacttcaccactatacaaattatccatgttacctaaaccacttgtgctccaaaagctattgaagtaagaca[132 bp omitted]cctt[167 bp omitted]caccgcgcccggccaagacatttaaaaaatgaaaacaaaacactatcacctgagtcatttgtttgcttacattaaatatcataatacttttcagcaaaaaatattatcattttaatgtaactttcgttccctgtatttgagcggagtactgcactatccataaacaccctctgaattttctacagtaatggaaaaaaatctttgaaaaaaataaaagaaggttctatgtttgagaatatggctatatgaaaggggtttcaagaaatatccagttcttcccaagacgatgtacttccagtgaccagttttaagaagtggaacaggccaggcgcggtggctcacgcccgtaatcccagcactttgggagtcc[232 bp omitted]caaaaaaaaaaaaaaaaaccaaaaaaaggggatcgaatatttcctaacgaggtccttcaagtaataataagtgattaaactttttgataatgataatatcaattggacatgataaaaatactattaataaatcttttgatttaaaaaataaccttgtacccacttcttttgtaggcgtggggggagcttagagttaagtattccagtatccgttagggatttggcagtatacatcaataacaaatagtagaaggaaaataattatacctgtgtctcatatatatatatatatatatatatatatatatatatatatatatatatatatacacacagagagagagagagagagagagagagaaaccatctcttaaattacctgtagcaccactatgttattctttactctcccaataccccaagtagattgcacatgtgactcttttattaatgtgttgaatattcataacgataatgaataatatgaataaataaattgataagtgcgtaactatgaattaggcattgctttactcttatctggagatttcaattcatgataaacatcttttagtgaccatgaataagaaactcatagacctgcattagagaaatgcaaatctaaaccacaatgagataccatctcactccagttagaatggcagtccttaaaaagtcaggaaacaacagatgctggagaggttgtggaaaaataggaatgcttttacactattggtgggagtgtaatttacttcaaccattgtggaagacagtgtgtgaattcctcaaggatctagaactagaaataccatttgacccagcaatcccattactgggcatatactcaaaagattataagtcattctacgataaagacacatgcacacgtatgtttattgtggcactattcacaatagcaaagacttggaaccaacccaaatgtccatcaatgatagactggattaagaaaatgtggcacatatataccatggaatactatgcagccataaaaaaggacatgagttcatgtcctttgcagggacatgcatgaagctggaaaccatcattctcagcaaactatcacaagatcagagaaccaaacgccgcatgttctcactcataaagcaggagttgaacaatgagaacacatggacacagggaggggatcatcacacactggggcctgtggggtgtgggggtgtaggggagggataacattaggagaaatacctaatgtaggtgacgggttgatgggtgcagcaaaccaccatggcatgtgtatacctatgaaacaaaactgcaagttctgcacatgtaacccagagcttaaagtataatttaaataaataaataataaataaataaataaactcatagacctcaaagtatgggaagcctaactgcctacggccacttgctgcttcactctaaaatctgtttctgcatctgcccctcagtcaatgactgagggccacagggtggctaatgcagatccctctttaggagacacagggcttctctgaggaccagtcttggctcaggattccctgaagccttttctcacccttccttagactgtacattacgctccaatgcttccactcaaccttcctttcctctttccttcattctaggtcagacttgcctcatagctgagacctcttccaggcttactcagcttcctctccattttctctcacagggatttcccttaataaaatcctcttgtgtttaactcgttttcaacatctacctcttggaggacctggactaacccaccacataatgtttgtattataattacttccattctacaggttgagaatctgggatctggagaagttaagcaacttaagttactcaagtaaggccacacaatgtatataaagtgtgctgcaaggagttaaacccagggaacgcacactccaaaacagaaccatcaacaagtaccaatcctgaaaccaactaataaaaggtaaagatacaattagcttggtgcaaaatgttatttttctctctaattacattttctaaggtttcactgtttgtgattaagaagggaagaatgattttcatcaaaactctgctcaacaagccgggtgtcgtggcatgcacctgtagtcccagctactgaggaagcagaggcagggggatcacgtgagcccaggagattaaggctgcagtgagctgtgattacatctcgttgaccatgtgaccctgagtgtaactcatagacctcaagcctgggcaacagagcaagactctgccttaaaaagtaaaactaagcaaaacaaaacaatcctgaacaaatggttgcacataaccagctaaacagtaatataacagttgttggcagggtgagaagaaactagcagactgtaggtttgtcatactgtttttttgtttctccagaaacacagatataatataggcaatgaaagctgagactcatctcttaatttcagttaagctattaattgatttacatcatttactcacaggtcagaaaagtttctttcaaaaggcaggaatgttgtttcatgttaatctaaggacttgcttaccttttgtttctgttcttaatgatcacagttactaatacagttaaataatatttagataaaatacattacaattatagctgatcaaaaatctcattccaagctgttatattgttgactatctcatgatcactcttcttatgaatcatgtaaatagggaaaaatactgcaaagtagacccacgttacttcaaatgaaatatgatttaataaaatcagttattctttgccaattttgtaatcttcaaaataaccacaattgaaatagtgatacatacacatcagaacagttcaaatgaaagagagaaatgataccaagtgttggcaaagatgcggagcaactagaactctctcccattgtggatggaaatgtaaactgatggacaccaccattttccatgtatgctaaatctgaccatattctatgaccctgagcatatacccagcaatatttaccaaaagacaaatacatgaatgctcagagaggcaccattcaaaataaccacaaattgaacttatatttgtataatgatatagtatatagcaatgagaacctaacaaattacaactatatgcaaaaagattaacaaatcttataaactaaatattgaatgaaagaagcaagatacagaacatatactacgatctaattcactaaaaattgtaaaactcatcagttatgttccaaatcaccataagagctatcctatgaaatagtgtctagaagaagtaataatataaaatttcctgatttgagtactggatacacagaagggctaagtttgtttaaaaacaaaagaagtattgagctgtacagttaagatttgggtattttactgtttgtatgtattttcagcgttagaaaattatgttaaaaagtctttatgctctttttcttaatatatttacaatagacaaattttcattaagccacagtataaataaaaaagacccacacaggtatttttaacatggatgaagtggttctgtcatcattaaatgagtactttaggatgcaagtctgatataaaaacttacttccctgaagactttaattttgcatgcaaaatacacggtttctaaattaaatttttttgtaacaaagcgtttttgagttcccctcatgaaattttaataaatcattaatttcttctttttctctttcatgcacaagcagtggataaacatttcaaagatccctacagaagtttcttcccttgaaatactgttcacatgacaatgagaaggatggaat[137 bp omitted]gccttcgaagtagctgggactacaggcgtccgccaccgtgcccagctaattttttgtatttttagtggagacggggtttcaccgtgttagccaggatggtctccatctcctgaccttgtgatctgcccgcctcggtctcccaaagtgctgggattacaggcttgagccactgcgcccggccaacaggcaaatttttcgttggggaagtagtagaccaaccatctgtgcttatttcttctaaacagagctgggaatgagtgacagcagttgaacaggaacacttgctccccaagcactacttgtttttcatgaagaaggaaaaaaggcaaaagccctgctacatttacattcgcaaaattgttttcaaatgaggattaacaagatgttagttccctctctgttgaacacataaaatattaaaaggcagtgctaatacatctatatacagcacatcaggaggaaggaggaagtcatttctcctgactttaccaacttgtcttatttgaaactgataccgtgccctattggctgataggagtttcactttatttagaatacaatagaatttggctcagattcacaccaaaagtatagtattttgaggtgcacttacacgacttcaggggaaaacaatatctggaatgtgaccctggaattcattacaagtcagttaaagggatctctcttagaattttttgataattggactgggacaggatgtaagaataaatcattaacagtagatgaggaaaacacttgacgagagctttctcgtcttaccattactgctctttctatcagaggttaaagacagaatggggaccatgttgtggttgttattcttgttgtttgattggtttgtttattatgttcttgcatgacttggttatgtggctggatatgaaaattctttccatttccagagtcataaatctcctaatttctaggagattaaatactggttttatctttggctccagtaaaaatgttgctatcttggattaaaagaaggttgggaaatacgttgtgtctattcaccagtgaatgggaaccccttctacaacaacaaattttccattcaaaccatttctaggcctcccttcctggttctgatagcaaatgtgaaagcaagtactagagatttgggttttgtaagtttcctcaaatacttgggaaatactggattccgttgccaagtgttgccttttgtacattcagcttctacacagcacgttttctctatgttgaaagtcctaatccttgaaatctcagaatggaaaagagttatatgactaattttatgtgccaggattatgggaataaactttcatggaagataggaagcttacagggcatttagagaaaggagacatctgtagaatcaattcagaatgattaagccccttgtgatctcactatctcacttcaattgttaagccacaaaactctttttaagttaatctctaacatttatttggctttataattacatataaataatgtctaaatttgacacctatgtttccaaacttaataatgaagtcaaaataaacagaattaaggagagcttattacgatctttattgttatttatatataacaaatttcctattaagaatataatattttatgatatcttatggatgtcattaacattgctttaataaaggtattatcatgctttgtacagcaaccaacacgaaaatgttagtataccactgcaataaatagaataaaaacatgttcagaaagacttagaaactcattaaagaacggacgttaatcacttttcaccctaactcctcatttggcaaggcatgaatctatgcattccagtttagacaggtggcaagtaagtagtcccattgcatttcataaaataagcagctgcgtgaatttgaaagatactatttccacatgaaaagctaatgactgcacatgtaaaatcagtagtgtttaggaagctgtcatttaaaaaacaacaaactacctaattaaaaagtagcacaaatgaacttttgcctatgtaaaaaatagaacattgcttagccttttcttaaacccctccccaattcttaccaagaaaggataaatacctttattatagtcaaagctctgtttttatggtttttgaattttttaatctaaaattcaaagcaaataatcaatctttaatttatatttatcccagtttgattcaaagtgacggtccaaaagtaaaatgatcaattataactataatcaatcacaaataatgctatgtgagtttgaaatgttaatctaagttgccttttccaggtatgcgttttaaaattaaactcttctcagtaagatcaaggctatccttcatggatttatgatgtttgataatcaccacgttgtactgatttgctgtctcacttcactgtttgatatcaacatatgaaagtaaaaatgctatttaggggataactattatctgagcactaataaattaaatgctattttaagccaacaacaaaattgtttagggtacaatttttatttaaccaactgtccattataaacattataaaattctgaaagatcctagaatcttatatagcttttttgtattttttcaaatgtagttgacaccagcatgaattaaatttcatatttaaaaagcttctgactacattacaacatactttaaaattacttgcaagatatgataattctaagattacccacatatcatgcaaatgaaacagccaggtacttcctaccaacacatgatacaataaaatccagaagaacttctgaattagagtgtagtagttgcctagggccatcatacctaattatcacacacttggtgggttaagaggacagaaatatattctctcatagttcggaagcctggacctctgaaatcaagatgttggcggggccacactccccctgaagaccctagggaagaattctccctcgcttcttcctggcttccagtggctcctggcaatccttgaccttctttgatttatgactgcataactccaatttctgtctccatcttcacatgaccttgtgtgtgtcttttcctgtatgttataaggacatttacactggatttagggcccaccttcacccaggatgacctcatctcaatcactgggttaattatatctgcaaagaccctacttccaaataaaatcacattctaaagttcctaatggacataaattttggaggtacggtatttaaatcactacacagaacatgtaaagacaaaaatctggaagctacctgaatgaaaatggatattcccttgaacttcgacaaaatcatattctatttttccatgagaaacattttattactctaaaacaatattcatatttcacaagtacgcctcttaaattatagcttggacttaagaaaaataattagctttggaaattatcagtacatgatatctagtatttcctatatttttaagaacttctacctcctagcaaaaataaacaatgcaatggataatttctgtgttctaaattcacacacacaaacaggaaagggacgttaaaaatgatttgttctcttttaaagcagaagcccaaccacctgctctgaatcaaaaagtttcctgaaagcaatgaagggctagtttattatgaaggtgttgatagctgattctgtggagactcacacagaaacaaagaataaattttaatcacacttaatgctaatgtggtagtaaggttgtgacaatattcaaatatgactaatttcattgaattaactacactcgggcttagcttagttgtccaaatttattacaaatagctcaaactaaataattcaactcttctgttttctatttattttttgttgatgcttaagagtaaaaagatatttcaactgaatttttttttttttttttagcaatcagttctcttgttttatcaccataagactgtaaacggccgtaacaggtcactgaatctagcactgccttcaacaagaaatgcacctagagcaggaatatagtacttggcactcatctctagacctataacctaacagattttttttttgtctgtctttggtgaaagtaacgtaaatttagagctggaaaggaccttagaggtcatcta[225 bp omitted]gaggccggagaatggagtgaacccaggaggcagagcttgcagtgagccgagatcgtgccactgcactccagtctgggcaatagagtgagactccgtcttaaaaaaaaaaaaaaaaaaaaagaagcatgtttatttcatcattttgtacttatacactgtgtatttccagaaaagcccctgagacagcttagaatgaaaggcacagacactataaaacaagcgcaaaatgacagaataatgaagagaaagaggtgacaattacatgggacaacctagggaaggaaacactacccttcagcctaaaatttagtcctaagccccttgttcttaaaggccaaaaggaaaaccagaattcaaataggtattgttagttaataaaatagtatctggatatatcagcaactattttttggtaactctaaactcaagcaaaatatatgtctttaagcaacagacaatggacaatataataaaaataatcttccatagcaatttccaaacttttaaagatgtaagaacaaatgatcttttcttacaggatgcttagttgaaagctgcccgcatgatggtattttaaactacatgatgttaaattccctgcatgatggtattttattgggacctggttatatgatttggtgaagaatgtaacctttgagaacttagaagagtgaatggttaatatttctctgaatttttttgtttttaattgatattttattttatccctcatagacaatatatgtctgggaaatacactgaagtatagtaaaaaagaatctaagggttaaagtgttgaggtaaatgagaaagcagaggttgtgtctgaagaaccgtgtggtcgcactgcacc[212 bp omitted]gaggcaggagaatggcgtgaacccgggaggcggagcttgcagtgagccgagatcgggccacaccactccagcctgggggacagtgagactccgtctaaaaaaaaaaaaaaaagaagttcaccctatgcaggcactataactacgagtccctcccatctgagccttgccttccagacaaccccaccaatacataagacagaaaaaaagcaccttgcaccttccagactgacttgtttgccagccgcatagcactgagtcaccctagttaatgatatgagagaggaagaatcactcagacgaatcctgctggaatttctcacctataggatccatgagatacaatgaagtggtcgttgttttaccttattaaatttggggtagtttcttttttcttttttttttcttttttcttttttttttttgagacggagtctcactctgtggcccaagctggagtgcagtggcgcaatctcggctcaccgcaagctccgcctcccgggttcacaccattctcctgcctca[219 bp omitted]cactgactcacttctactgccaccaatcactatcctcctttcctgattta[178 bp omitted]ggcgtggtgaccggggcctgcagtcccagctactcgggaggc[136 bp omitted]aataacttttgcaccggcctaatagttgtaaagaaactataagcaagttcacaaaagttaaaacaaaaaatcagctatgagaagcaaatatgaattataccactaactgctgaaaagaaagactctaagactgaaattaccaaaaaaaaaaaccctcagctgaaaacaaaacaaataatcaaactctattactctactctatttccatgaagcgtacaaactgttcctgtaagtttaacgatattaaaatgtacaaagattaataaagtaaaaatcaaagactatttataacatcatcgatttcacataaagtagaattttaaaggaaaaggtatcccatggaaaacaataaaatatttaatattacaaagcaaaacactaaatgaacgtcacatttaattgtgaaatcattagcatgtttctccgttatgacttattaaaggataaaatttgagcaatataatgtataagactttttggccgggcgcggtggctcacgcctgtagtcccagcactttgagaggctgaggcgggcggatcacgaggtcagcaaatccagacc[135 bp omitted]agtgagcccagattgcggcactgcactccagcctgggcaagagagtgagactcccaatccaaaaaaaaaagaaaagaaaagaaaagaaaaaccgactttcattaaagcctcctgcagaaatttgcataagtaacaaggagccaaatgtaatcaccaagacaatggggaaaatgtctccagaacattaaagaccttaacaccttcacggcagctctttccatcacaggctcaaaagcctagtatggaaaaatgatttcctggagcaggtccaggtccccctgctgtgtgcagccttgagacttggtgcccggcattccagccactccagccatggctggggtgggagacaccaggctacagctcaggccatgtcttcggaggttgcagccccaagccttggcagcttccacaagatgttgagcctgcaggcgcacagaagtcaagaattgaggtttgggaccctccacctagatttcagagaatgtatggaaacacttggatgttcaggcagaagtttgctctggtggggtgcgggggcaggagcaggggctcatgaagaacctcttccagggtagtagagaattgaaatgtgggctctgtctcccatacagagtccctactggggcaatgcctagtggagctatgagaagagggccgctgccctccaaacccccaattggtagatccacaaacagtttacactgtgtacctggaaaagccacagacaatgccagccagtgaaagcagccaggagggaggctgtaccctgcaaagccacagaggcagagctgcccaaggccatgggagaccaccacttgcgtcagtgtgacctgcatgtgagacacggagtcaaaggagatcattttggaactttaacgtttaatgactgccctattggatttcagacttgcatggagcctgtagcccctttgttttgaccaatgtctcccatctggaacaggtgtagatacactgggggtacccaatgcctgtacccccattgtatgtaggaagtaactaacttgcttttagttttacaggctcataggtggaagggacttgtctcagatgagaccttggactgtggacttttcagttaatgttgaaacgagttaaaactttgggggactgttgggaaggcatgattgattttgaaatgtgagaacatgagattcaggaggcgccaggggaagaatgatatggtttggctatgtccctacccaaatctcatcttgaattgtagctcccataatccccatatgtcatgaaagggacccagtgggaggtaactgaatcatggggatgggtttctccctgtgttgttcttgtgaaaccgaataagtctcacaagatctgatggttttataaaggggagttcccctgcacatgctctctctcttgcctgccaccatgtaagacatgtctttgctcctcctttgccttctgccatgattgtgaggcttccccagccacgtggaactgagtccattaaacctttttttctttataaattacccagtctcaggtatttcttcatagcagtatgaaagtggactaacacagtatcaaaccctggtttggggtaataatcactaccttctaggtaaccagaatggaaaaaatataacagaaaaaaaatcctaaaaatcatcctgcgtacaagaaaaatgaaactgtatgctgaattctcagggggagaaaacgtatttaaaaatatatgactttcaaaccacaagaaactatagaccattgctttaaactatttgtctatgaacagtatgtagaaacacatggaatttaggaaataggagatgaaggctacaataacaaaagaggctcatatcacaaaatgggagatagctgagatgaggcttctatgaaaactaaagtgcaagggcagattttccatccacagggaaatccgtggagaaagaaactgacacactgaaaagttcaagcagcaattgaatcagagctctggagggcaaaggaagagatgaactaatgacagagaagaaggcggatgggtatgccagagaccacaggttccacctcgagaatagtttgtgtactggggaaagacacaagggcaaggagatctgaaacaataatcaaagctatcactgaagtacgaataataaaagcaccaaccagcttctaggcagggagggggaagaaacaaggaagagttctccatatttaaataacaactagccaaactcctgaattttacaaataaataaaaaaacttccttaaaaataaaaagtcaggcttagataagactttttttcttctctgttaacattattagaagacataaagattttaagagaataaaaatatgatcaagaggatcataaatatcaggttgtctttacctgagtacgaagcaatggcatctgtatatccagcactgatttgtccttccaataaaaatttactcaaagacatatgggtacatattagaaaaataatcaaaattaatatttcaaggattaggaagttgtgaagccaaaatcctgcaaggggacaattgattcagttaatggaaagatttatttttcatattttatgattatttaccaaaataatatttttaaagtataattataaaataaaaataaaatatttaacaatactataattataatcatgttccaagttataaaacaagatagtgagaattgtcagtaagatagtaagaattctaatactatctcaaaataaaggatacagaaggtttcagggcaagagaaagggaaaaccttctatatcctttagtttgagatagtattaaagctttctgtaggctcactcaaaatgtccggattctgaccacatttgaatgagcactcccaacctgacgattcctagtctaagccacacatatttcctcttatggttattgcaaaagctccctaactggtctcccagcttctgccgttgattcctttcagctattttttacacaagtgccagagaaatctcagaaatgcaattcagatgatatcacttctttgcttatatctttcaatgttgttcccctctacgtgttcatgtattctcccctttgactctcgcttctaagtgggaacatttggttttctgttcctgcattagttggctaaggataatggcttccagctccatccatgttcctacaaagggcgtgatctcatcttttatggtggcataatatgccatggtgtatatataccacattttctttatccagtctaccattgatgggcatttatgttgattccatgcctttgctactgtgaatagcgctgcaataaacatatgcatgcatgtgtctttatgacagaacaatttatattcctttgggtgtatacccagtaataggattgccgggtcgaatggtagttcttttaggtctttgaggaatcaccacactgtcttccacaatggctgaactaatttacactcccaccaacagtgtagaaatgttgccttttctccacaatattgccagcatgttattttttggctttttaataataaccattctgaatggtgtgagatagtatctcattgtacttctgatgtgcatttctttaatgatcagtgatgctgagctttttttctatgtttgttggctgcatgtatgtcttattttgaaaaggagggtgaaagctgggaggagggagaggatcaggaaagacaactagtgggtagcaggtttaccatgtgggtaacagaataatccgtacaacaaacccccatgacacaagtttacctacataacaaacctgcacgtgtaccactgaacttaaaagttaaatttaaaaaataaaaaataaaaaaatctttcaatggtcccatgtcagtttgaggaacagccaaagtccttaaaatgacgtacaaggtgctcgttccatcatccgtcttctcatgtttatttctctgccaccatctactaatactcttcccccttctcattctactccagctataatggcttcctcgatgctgttctaagaataagtccacatgattccgactcagggcttttgcccaagctgtggtctctctttggaatgctcttttttcagcagagcacgattcctcctcatttccttcaagaagtctgtcgccaaatgccttctacctggtgtgtaattgtcatgtgtggcagttttaaacatagtccaaaaacaggttgatattcttctcatcaaaaaataggtctatgtctcccttccctaaatctggacgtgcttgtgactgctacaatcaatagagtatgacaaataattctacctgacctttaaggtgagataaaaagagaccaggccttttccacctggttcccttggagtgtttgatctgcggaaagccagcagccatataagaagtttaccctgtgc[184 bp omitted]aggcaggagaatggcgtgaacccgggaggcggagcttgcagttagccgagatcgggccacaccactccagcctgggggacagtgagactccgtctcaaaaaaaaaagaaaaaaaaaaagtttaccctgtgcaggcactataactaagagtccttcccatctgagccttgccttccagacaactccaccaatttataagacagaaaaaaagcaccttgcaccttccagactgacttgtttgccagccgactagcactgagtcaccctagttaatgatgtgagagaggaagaatcactcagatgaatcctgctggaatttctcacctataggatccatgagatataatgaagtggtcgttgttttaccttattaaatttagggtagtttcttttttctttttcttttttttaatttttttttttttgagacggagtctccctctgtcgcccaggctggactgcagtggcgcgatctcggctcacagcaagctccgcctcccgggttcacgccattctcctgcctcagcctcccgagtagctgggacttaaggcgcccaccaccaccaggccaggctaacttttgtatttttagtagagacagagtttcaccgtattaggcaggatggtctcgatctcctgaactcatgatccgcccgtctcagcctcccaaactgctgggattacaggcgtgagccacggcacccaggccatttgggttagtttcttaagcagcaatagtaactgtaacactgactcacttctactgccaccaatcactatccacttttcctgattta[136 bp omitted]cggtgaaactctgtctccactaaaaatacaaaaaattagctgggcgtggtggtgggtgcctgcagtcccagctactcgggaggctgagg[139 bp omitted]tatatatatacaagaatatgtgaaacagtatgttttcaagtttccattgaatattttaaaaatagattatataaaacctcaatatattttttaaaataaaaaccacacaggtcacattacctactcaaaatttaattacattagaaattaagacaaagttaaaacaggacaaccagcacccctagtatcaccctcctcagagtatttaaaaatagattcctttaaattatctctttttttacaagaataaaatctaatcaattattagaaagataatctcaaactgaactcaaaagaagaagcaaagcatcttcaaagtcaataagggtgctataaatgcttcttggactctgaaactctctgacttcccattctactctcagttgtagaaaactccctgattgttaggttttggtgtgattaggttaggtttacccaggtactccccccgtcttaaggctgacggattattagccttagtgacatgtgcaagactcctttgccgtgtgaggtatcaacagggtaacatgaggaaatgaaggtcataggggctatcttagacttcttcctgctacaacctctattcacttattttgaatcctcagagtttaatgagctcctactatgttctaggtccttgcaataggagtacagcagtgaacaagacaaacatggttctggtccttggagtacaaagtaaatgctgaaaatttaataaatgggtcagtagatagatagatgtataaaggtctaaatgcacattcagaaaatagcaggagaagactgagactcagtattattgaatatgctttaaaggcccatgtgtcgtcttgaatgaaaatgttgctcaatttctgatgaggagactaattcatcaatatctgttatcattgactgatgacctcacataataaaagatcttgacttgagtgtacgttaataatcaacataatgggtaatgtatcaaaagagtatatggaagataataaaaagatataaattgaaatcttaaacagttttgtgctaaaatatgtttagaattgcttgaacccaggaggcggaggttgcagtgagctgagattatgccactacactccagcctgggcaacaagatccaacctccgtctcaaacaaacaaacaaacaaacaaacagaaacaacccaaacaaacacaaaaaattactataattgtatctcttttgactatagcctggaagaaatcactctctccccaacttaaggaaggggagacttatctctagccaagctttgagtataaacatataaaaagtaattttcattttcttgaaactgactgcatgaaaaggcatatggtgttcccaaaaaatgtctgatgagtgagaatattaaaatgactaaactgatgggacatatttaatttaatatttaaacttgataaaaaatagttaagcatttaactcaagaatttcaaaatggtacagcaaagcatacaagcaaaattaaaaggaatgctaattacatattaagttagaaggcaataaattataaacaaaaacagtaacaatttataaacatacacaagttcattctttaacaaataacccatgatacagaaaaatacagcaaatgtgataaaacaaaaactgagaaaacataaaatttaaagtgaaaaaaaaaacaaaacatgcagaaattgttttaaagacaaaaaatactatcttagaaaattaaatacgtgtttcactaaaataaacatgtactgcttaaatgaatcttaatttaattttaaaaatagtaaataggttgcaggcatcaatgtttgcaagaaatgtaaaacattattttaaaaatttttattaaagtccctataaccagtgtttttaataagcatctgtttaaaacatcttgtaaaatggaccccagactaggaaatatggataaagttataaaaagtggcttcctttcagttcattttacaaagcaaatataactattactaactcttgatgaagtgaatacaaaaagaataaaattactaaacagtatcccttataaacatagttaaaatattcttaactgaaagaaaaaggaactgaattctacacttactaagaaatcacccaccccagtgatttggcatacaaagatttaatactagaaaatatgtattaatataatgcaacacaacaataaagctatttaccttatattgtacatttactgctacagactaaatgtttacatccctctcaaattcatatgttgaaatgctaaccgccagtgtgagggtttttgaaggtggggcttttgggaactaattaagtcatgagagagcagccctcattaatgggtttagcacccttctaaagcagccccctgaactcccttgctccttccccaactgaggttatagagaaagggcagccttctttgaactagaacaaaagtttttcccagacaccagattggctagtaccttggtcttagatttcccagaccccagaactgtgagaaattcctttctgttgtttataagccaccaagtctatggtattctggtacagcagcccatttttgatatttatttaatgatatttaacatgcatgactgatgaaatttaacaaagtagttatagatatgtccttaccatgattaaaaataactcttaaattgatgcatacttttattatctagttctagccaaagccataagatgaaaacacaaataagaaaccacctatatggcacatgtatacctatataacaaacctgcatgttccgtgcatgtatcccagaactgaaaatcatattttaaaaaaatttatttatatagaaaaaaagagagcaaatgatatttttcaaaaactgataatttaattatggtaagttctgtgtgatatgtgcctgatatgtgtgatatgtgtctgatgtgatatgtgtgagatgaaaaacactaagggggtatgtgattttgggcattcatgtgcccataaatccttgttagaattaaaatatcacattaaacctctctctttcttttaatgtccatggtttcttttatatgttttagtaagtgacacagaggaaaataccgagcggacaccgtttctaaattggtaaactgccctgaactgccactttactcttttctacagcaagtgtggaagattagagttcaggcaaacatgtcatgtaagtggtgaagattccctttttccactgggacagcagtagaactgaagggaaatcagacaacagctacctcagcaggagagcctcaatgatgacacttttgcctcaacagtggaagctggtagtttccaaaaatagagctaaaaagtgaatcaagttttaaagcacattgaaagtcacacgtaaaattcattattacagaaaagctataaaccaatcacagtaaatgagtgaatttagaaattaaattttaatatgaaaggttcatgttgtcaaaactgactatgttagtccatctcaatgctataaaggaatacctgagactgggtaatttataaagaaaagaggagtatttggctgatggtttgcaggctgtacaaacaggccaccagtatctgctcagcttctgctgaggcccgggaagctgacaatcatggcttaaggcaaagggggagctggcatattacatggggagagagggagcaagggagatgccaggctcttttaaacaacaagatctctcgtgaattcatagagcaagaactcactcattaccgggaggacagcacaaaaccattcatggggatccacccttgggaaacaaacacctattactaggcccacctccaacactggaggtcgcatttcaacatgagatttggaggggacaaaccatccaaaccatatcactaacggaaagtgattgtttaaattgctgtattcagtcccttggcctttttgagaaatgccattcatttcagccatcaagcaaattattatttgagacatttatacctcttcatcctttaaaagtttcagaagcatgaatttaaaaagtattcattgtaaatttgaggctagtcaaattgatgtggcatctaagtagcacggtgacgggatgaggagacaaagtcacgaggggaggtaggaagaagcagagagaaaaagagaaataggaagagagaaaaagaaatgagagagtataagaaaaatgaagaaagaggaaaagaaaaatggtttaaatgagaggcaaatgtcatctgatgttttaccatggggccatagggtatttgaagtttcagaaaattcataagttattaaaaaatgtgactctagggtagtgaggttataacttgt[180 bp omitted]cgccgtagcgggcacttgtagtcccggctgcacgggaggctgaggcaggagaatggcgtgaacccgggaggcggagtttgcactgagcagaaatcgcgccgctgcactccagcctggggaacaatggggaacaaagcaagactccgtctcaaaaaaaaaaaagaaaaaaaagaaaaaagaaaaagaggaacttcttaaagatgcggttgtctttcttatgcttcctttagctcttttttacctctccacggatacagatttttataccaaatagctggcattagctaaaccaatgtctaggagaactgatcctcacgaaggaaaatcataatttattatttttttaattcatggcatttatttgtacaagaaatatatttctatttaagagaaagtagaaa[274 bp omitted]cagcctcccaaagtgctgggattgcaggcgtgagccacagcgcccggccgaaaaaactttttaaaatttgtttggggatctcccatatttgccaaagtaatcccacaaaaacaattaacatttgactttgaaaattaagacaaaaaatacaatgatgaatattttcttgtaaaagcaaagacagtaaaaatattcagatttaaaataagcctgagaaaaagcatgatttccttgagcttacctaagtaaacttatttacaagtgactgtatcaataattagcaaaagtaaaagtcattatgaaatcctccaaatctttcaaagtaaagtactatcttacattcaagcattgagtttgcccataaaattatttaagctcaaccttttcctcaatctccaaaactctggcgtgtaactacacaaacacttcaataggggacagaatctccttttatcattcattctaccaaacatcaacttcataagaattagaatcaagtgtaataagaatgaactatatagaatcattgatataaatttataggtgttcagacataacctttagacatatttgtcagtgtacatgtaaacaatactcaataacttctttaatagagttctccagagaaacagaaccaattggatgtgggtatataactcagttatatatttcatcagcttcctttttatgtaatagaaactaactacagctaatgatgaatttttttcattcattcatcattaaaaggggagagagaaatccaggctgggtttgtgccatttttcttccctcacagttctcttcttgctgcatgattcttcctttcagatattaaccagaaggaatggttagcctgactatagctctagaggagcaacacaggctctggataatgaggatgcacaggctttaatcagtcctagcaggaggtcttggcttagacaactatgtagttgatggtatccctataggaaaaaaaaaaatatatatatatatgtttttgtggtagcaggacagagtcagtttcagacatttgttcaacaactgttggtgttcaacatatattagtattttgcactaggtactatgtgctaaaagtatagtaaggaataaaaatagggaaataaacaaaaacaaaataaagaaacagagaaaattcctattaccctttaggaaaaacaacataaaataaagtaacagaatctagaaatagagaataacaagatagaagcctactatataccaccattatcaacctgtcaaaataaacattgtcagtaatgagacaaaatggaatcatgtaccacctgataggatgcaatgaaaaaaacgcagcatcaattctgtgatattcttgccaaaatgcattgcctgactctagtcacaaggaaacctcagaaaacctaaagggagccattcaaaaaagaaggaagggaaaaggaaaaagtaagggaaagaggagaggagaaggaaggggagggggaagggaaggggagagggaagagaaaaaggaaggggaaagcgaaggagaaaggaaaggagaaaaggaaggagaagcaaagcaaaggaaaaaaagaagaaaatatgggccagaaatcttggttaagttaggtctaaagatctattcttgatacaaggacattaaaaagacatgacaatgaaaggcaatgcatgattctgaacttgatccttttgctatgaaacattattgggactattggtgaatttttttttttttttgagacggggtctccgtctgtcgcccagcctggagtgcagtggcgcggtctgggctcactgcaagcctggcctcctgggttcacgccattctcctgcctcagcctcccgagt[225 bp omitted]tagcaatatattaatattaattttctggttttgttcgttgtactgtgcacgtattgcatttgggggggcacatatattactgtaatagatttgtaatatatagaattatatatatgtatatacatatatagacacaattgtgtttgtagaaaatatatatgaaagcaaggtttttcaactttggcactatcgcttctgacatttgggccacataattctttgttgggggcatttcctgtgaattgcaggatgtttagcgacttggtttgcctttaataactaaatgacagtagcatcctcctcacacctttccccaggctaacaactaaaaatatcttgagatattatcagatgtttcctggagggcaaaactccccctggttgagaatcagtctactaaagtatttggagatgacagagcatcaggttcgtttctatatattattaaagtatctttcaaagttgaaggtaaaattaagacattttcggaaaaattaaatgggccaatttgtcaccagcaaatctgtactacaaaacatgctagcagaagttttttggcctgaagggaaataacatcgaatctaaactccagattagaggaaatgaaaagcatagaaatggtaagtatatgagtaacaggaaatacttttttttaatctgtcgattttgttgaagggaaactgactatttaaatttaaaaagatatcattttattgtggggtttatgatgtggatagaaaaacttatactaaaaaaaatcacaaaagacagagggggaataaaggaaatgttaccgtcatcagtttttgttgttgttgttttgggtttttttaatagactttatttttagggcagttgtaagttcacagcaaaattgaaagaaagatacaaagatttctcatacatcattgtgtccacacaggcacagcctgaccccttgctgtcattctcctctggagtggcacattacttaccgctgatgaacctgcactggcacatccttatcaccaaggtccatagttatattagggtccacgcttgctgtcatacattctatgagtttaggcaaattcatataccagtatagtatcatgcagaatagttttctgccctgaaagtcttctgtgcatatgaataggataggtggagcacagatcactttttaggaaaatgttgccttgttttgatttgacaaagtaggcaacactatcaatcactggagagaatgtaaaaatagaacagatgtcatcagttttttacattatatatgaagttgtcaaaaattacctcgaagtaaaatttagattagttaagtataaattgatgattattgtaatacaaataactcaatacaaaaaagcgttgcaactaactcatctatgcaatttaaaatgaatacttaaaatacaattaaacaaaaatacgagaagagaaacaagagattgtacagtttttaaaagtggcaacacatttcatttaacatatttatgaactaaattattcaattacaaggtagagactgtcatattagacaaaagaatgagacccaactaatgttgtctaccagaaacatatattaaacataaagacacagatagatgaaaagtaaacctacaagaaaagataaaccatatacacagcaagcattaggaagcttgtgtggctatattagcaaaatgcaatgtagactggaaaagagggtgcattataagagaaaatgggggcatttcataattatgaaataaccaattcatcggaggacaataatataagcaatattattgtcctccgatgaattggttattatattattgtcctaatatgacatatatgtccataattatgaaatgcccccatttcataattatgaaagggacaccaacttaataataaagcctcataattcatgaaggaaaaagcagaattgaagggagaaatggataaatgacaataataattaaagattttaacatccctctgttcatcactgattgaacagtaagacaaaccattcgtatggctatagaacatttcaacttcattataaatcaccttgatcttattgacatttataaaaactacatttcaaatgctgaatatacgttgttttcttgtgtattgaaagcaccaccaacataggccaaatgctgaatcaaagagtaagtttaaatgaatttaagctttagattttatagaatatattctctgatcacaataaaatttaatttgaaatcgatgacataagagattcctaggaaacccccaaatagttgtaaataacatgaaacactatttaactcatagttcataaaagaaatcaaaagataatttagaaaaaatatgaaataaggaaaacagtatattaaataaacatctgcacctagatgtttattgcagcactattcacaataggcaagatatggaatcaacctaagggtccagcaacagatgatggttaaagaaaatgtggtatataggccgggcacggtggctcacgcctgcaatcccagcactttggaaggccaagatgggtggatcactggaggtcaggagttcgagactagcctggccaccatggtgaaaccccatctctactacaaatataaaaattagctgggcatggtggcacgtccccagctactcgggaggctgaggtggaagatcacttgaatccgagaggcagaggttacagtgagccaagatcacaccattgcactccagagcaagactccatctcaagaagggaaaggaaggagaggggaggggagaggaggggaagggaggggacaggaggggaaaaggaatagatacacaatgaagtactattcggccataaaagcaacgtgcatagaaatggagtgtattatgtgagtgaaatgagccaagaagagaaagttaaacattacagcttctcactcatatgtggaagctaaaatattttgatcttatagaagttaaaacagaggatgctagaggctggaaagtataagagggagggagggatagggagagatttgttaaaagattcaaaattaaagctagataggaggaataagttctaatgctctataccattatggtatgacaatagttaacaataatatatagcttcaaatagttaggaaaggatattgaatgttcccaaaacaaagaaatgataaatgtttgcaatgatggatatgctaattaccatcacctcatcagggtaattaaatatatacactatgagtactgaaacatcactatgtacccataaatatgcacaattattatgtgccaattaaaaaaataaaataaaacaaaattatgataataaaagcttcatatttgtggtgtagagttaaattgagagggtaatttattatttgaaattcttctattagaaaaatacataggtttaaaagtcaatgaaaaaataaacaaataaaacgtaatttgaaaaaataaaataacaggtaatgaaagaaataaatgaaattgaaagtaaataaattcacaaagtgaaaagttcctttgaaaaaatcagtaaagttgttacatactagtaagactaagaaaaaaggactgataaaagaagaaatatcattacagaacctctatatttaaatgataataactattatgaacaattccatactcaagaatttggcagcttaaagttctttaaagagacaaattaccaaagcttatttaagaacaaattcataatgtgaatttttctgtatctatatgtatccatatagtctaggttttctaatttctggcctatggttgctcatagtagcctctaatgatccttacaatttcaacaaagaaattcagaagaaattgaaaaatttattgaagcagataaaaacggcaacacaacataccaaaacctatgggatacagcaaacagcagtagtaagagggaaatttatacctataatttccaagatcaaaaaagtgaaaaacctcaaataaataacctgatgatacatctttttttaaggtcactataaattttaatctatgatataaaatattacctacagatataattgaacatcaggtatcagaaaataaaacataacaatgaaatgcaattttgtaaatacttctatggtacaagcattattttcctcagattcaaccttttaattgtgttttgtttgctttctgaaaatcacactttataaagaacacaagtagagcttgttaaaatgattgtcacagatgtactgtttactaattcaaaaaatactacattcattcgctcatatcaattttattcattaattatgaagaagaaaatataatattccatgcttgtcatgaaatagcggtttcttcttccagtctaatcagggaactaataaatgcttagttcatggcaaaacttccatttgatttacattgacttaattacctcttagggtctagcctcatcaatggagaaaaagcactttttcttgaggcaacagcacattaacagcactgaatacaaaatatggcaaattcaatggctgtcagcattgctttaggaattttgagactataaaaaaactataaccatgaataaaagaaaagggcttattaatatcttctttttgggagagtgatacattctgaaggtttcttgttattctgttgaatagcaaggacttccaaacttaagtgtcttaaggctgaaaattagttacattcctcagattttagccttattaatgaaattccaaaagtattataagatttagtatgtcttgaaattataaatttgtaacagatatttttcaaaatacatgccttcaaacaacttaaatgcaaaaatcattcattcttaataatacctagcagttcatcccttgcttcccagaagtactcatacaaacatgtgaatttaaaaaatagatttttctgttcaaaaaataaagcttctgcccttttaaaaacttgtcaggctttcatttgccaaaatgttgaaaactgcacatattcaaacatagttcccgtaggaacacatattcctcaactctcacacctttgaagacacaggagacgggcaatataaatgttcccttctttccagctgatgttaaatagttaggtttgcttcatgagattatcggaataaagggttaaattttcattttccattactctatctagtaaaattagacttaaagtaggtagaatactaccagaggaattacacagtgattggcaaactggcctaaaataatcaggctttttatttatacttccctttttaaagttgtcatttgacaacagcttccatctttaacagcaggcaaaagaaaatgaggtgccatgctatattaattaaaatattccacaatgaaagaaaatacaaaacctgaaaataacttcagtgctatagacatttaaaaagttacaatggttaaaactctgaataaaaagatcttgagaacaggtacatttcaaagcaatattttacacgctttggaaaaaatagctatttttcaaataacttgatatatggtttacatatttcatgcagtctctgaggttttttttctctacaatactgttttgcattaaagtctctcatgttgtttaccagtaattgtttccttaggctgaaataaaactttgcttgttcattagttttctgtatatcccatttggttttgaaagcagctcttcgtgttttccatattcagtaatttttccttggtcaagaacagcaaccatattagcattcttaatggtggagagatgatgggcaataactaacgctgttcttccatccatcagtggatctagagcttcttgaacaaggtactcattttcagcatccagcgcactggttgcttcatctaggagaagaattttgggattcttcagcagagcacgggcaattgcaatccgctgtttctgcccacctgagaggagaacacccttttctccaaccacagtgttgaacccttgggggaaattccggatcaagaccactgcattggccacttcagccactctctggacttgctcagcggtcacagaggaaggccatcagcaccataagcaatgttctcagtgatagagcaagaaaacaaaatgggtttcctgtctcactgtcccaatcttggatctcagccacactgggtttagctgacggatgtcatggccatcaagactgatagttccagaagcagggtcgaacaacctcagcaggagcgaaagcactgttgatttgccagaaccacctgggccaaccagtgccgtgacagatcctgacggaatggaaaggctgaaatcctgaaatatgggcgcctctgggcaagcgggatcggcaaaatgcacgttcttaaactccaaagcaccctggaagcttttctcatttaagataacccttccccctccttaaaaggcagattgggctctctctccaggagctcccagaggcgccccccggcacccagtcctttcatcagctccgagtagaaaaagctcagacctccaatgcttattccaaccccgaaagcatacataggaaggaagagagttcacccatggtcatgtgggcactgcccatcagcagcccccctttgtacaggacagaaagcacaatcaggtttccggacagcctagttctccaaagaagccagcctgagcgaatgccgctttccttgctgactacatcacatggtccactttgctggcctatttttctatttcagtcatttctttcccaaaagctcgaacagttcttaacatttccaatacgttcctcctgagtggcttgtgccagcgaatcctgggtgactttggtcagtttccgtagatatcgtccataaattacatcaatgattgacactagaggcaccacactcacaacaaaggtggcccgattaggtgagacacaaaacatcgtcctgatgcctacagaagcccgggccccggccctgagcccatctgagaggttttcagtcactgagcgccccaggagtgcagtgtccgatgagaggcggttaatcaattcccctgtgccagccttgtcagagaaagcaacctcctgccccagaatggaggagaataacgaagttctcagcctcttcacaacgcgctgacgtgaagtttgcatgaggtagacacgaatggcattggcggcagcaccacacagaaacacgccactgaggccaaggcagaggcgggtcaggttgtcgctgtagtccacagtggggttggtatagatggcatcgatgatcttccccaggaagaaaggggcagacatggagataacaccggacatcggagaaatccaaccgcagctgccagcctctggcgctcagggaactccagccccaggagcttcccggcctccgagagtccgggcgccatgggtcgtagccgctggtcgtcccgggaaggcgccgcccgcccgctccgccaggcctcctcccctgcccaggcagtggcggtgggaccgcccgggaacccggcgcgcgggagccgaggagcgcccggccggcaagagccccgcacctgcagctgccgggcccaagcccacagccccgggagccgtccgaggcccgcgtggccccccgagccgcccagacccccgccccggcagcagctcctccagcggcgcgcggctccaacgccccagagcagcgccggccccgcgccccatagccgcgccagcctcggggcagtgaagggcgatatggactgggggcgcggctggccggggcccacacacaggctaccggcaggagccgccctggctctgcggggcccgtggcgccgatacatcttaaaagaactagaaaagcaagaataaaccagacccaaaataagtatagaagaaaggaaagaataaagataagagcaaaaattaatgaaattgaaatgaaaaaatacaaaatatgaacaaaacgaaaagttcgttttttaaaaaagataaaccaaaccagtaacctttagccacactaaaaaaaaaacaaaaaaccctaaataaataaaatcaagatgaaaacggggacattttcattgatactgtagaaattctaaggatcattagaggctagtatgagcaactatagaccaataaattagaaaatctagaataaatggatactttcctagatacatacaacctagcaagaatgaaccacaaagaaatccaaaacctgaaaagaccaataagtagtgagacggaaacaattttcccaggaaaagccgggtgcagtggctcacgcgtgtaatcccagcactttgggaagccgaggcgggcggatcacgaggtcaggagatggagaccatcctggctaacacggtcaaaccccgtctctactaaaaaaaatacaaaaaaaaaaaaaaaattagctgggcatggtggcgggtgcctctagtcccagctactcaggaggctgaggta[135 bp omitted]ccgacggctttactcctgaattttaccaaatatttttaaaagtagcacaaaatgcagcagcaggattctcctgccccagcctcctaagtagctggggctacaggtatgcaccaccacgcctgactaatttaaaactgtttttgtagagacaagatctcactatgttgcccaggctggtctcaaactcctaggtaaaatgatcctcccacctctgcctcccaaagtgttaaaattgcaggcataagccaatttttttttttttttttttttagtagagacgggtttgaccgtgttaggcaggatggcctcgatctcctgaccttgtgattttcaaagctgttcgagggcatttatcaggcttttaactctaggtactctttcccacagtgtgaaggccaagagaagggatcctgggctctcttccctggccccaggatgggaattcagggggaaaaggtcacctattctcctattcttatcccacaaaagaaaacttatgcatcagttgtcaagctaaggagcttcagagtccacaaatagggaaattgctaagagcttatcagtagtgtccactacccatccccacctggggtcacgtggagaatgatggtgggggcgacgatcttgtcctacttcaggtgaaaagcaggggtgtgggggggtttcattgtgaagggctcctttgttaaaattccttccaattccaggaaaaacatgcactcgaaagccattatctcttttacttcttactagggaacttccaggaaagagacggggggggggtggggggtggggggtggggaagaagagggcaaaacagctgcagtgaatgtagtcacctctccgattgcttttcttgttgcagaatatttcacatgccaggattttccttcttgtcctccggactgttgatacacccaacatcttaatacgctttcaatcacaagttaaagacatccagagccagattgcttgagcctaggagttccagaccggcctggacaacatggtgaaacccagtcatatatatttttttttagggggaaatttgctcttgctgtccaggctggagtgcagtggcgaggtctcagcttgccagacctccgtctccggggtttgggtggttctcctgccaaagcctcccgagtggctgggattgcggtgtgagccaccatgcccgactaattccttaactgtgcaactacaaggtcactaaacaaataaactcaagtcacaaaacatatttttccttaaatagtaaaaaataatataatgcatgtttcaattaaataacaatctttgtttctcgcttctataatatacttctccctgcacagatctcccccttcgccccacataatgcttgaaaggtaactcttggttcagtgctcaatcctttaaatgttaatccgactgggccggtgcacctaaataattaataaatgtcctcctaaaccccatgagtctatctaattccttaaaaatccctctacaggactgcaggtgtgagccactgcaccccgcctaatttattaatcagagaggaatagatcggcctggcgtggtggctcacgcttgtgatccagggactttggatgatggagcactggggatcacttgagcctaggagatccagactggcctgggcaacatggtggaactcggtctctctcttttttttgtttttttggaggcagagttttgctcttgttgcccaggctggagtgcagtggtgcagtctcggctccctgccacctccacctcttgggtttgggtggttctcctgcctcagcctccctagtggctgagattgcaggtgtgagccaccatgcccggctaattttctttttttttttcttttggtacacacagggtttctccctgttggtcaggctggtctcaaactcaggacctcaggttatccgcctgccttggcttccggggatgctgggattgcaggcgtgagccagcgcgcaaggcccaattgattaatcagaaaaaaataaatcagcctggcgtggtggttcacgcttgtgatcccaggacgtcggacggccgagcgctggggatcacttgagcctaggagttccacaccggcttgggcaacatggtgaaacccggtctctcttttttttggcggggggggtacaggcagggtttctccatattcatcaggctggtctcaaactcccgacctcaggttatctgcccacctcctcggcctctggggatgctgggattgcaggcgtgagccagcgcgcccggtccagtttattaatcataaaggactagatcggcctggcatggtggctcacgcttgtgatcccaggaatttggacggcaagcgcggcggatcacttgagcctaggagttccagacctgcctgggtaacatggtgaaacctggtcactttttgtttgttttgaggcggagattcgctcttgttgcccagcctggagtgcagtggtgaggtcttggctcaacgggcctccgcctccagggtttgggtggttctcctgccacagcctcccgagtggctgggattgcacgcgtgagccaccatgcccagctcattttgttttttgtttgtttttgtttttattgttggagatggggtttctccatgttcataaggctggtctcaaacttcccacctcaggttatccgcccgcctcggcgtccggaggtgctgggattgcaagcgtgagccagcgcgcaaggcctaatctataaatcagaaaggaatagggccggggatcccttgagcctaggaattccagacaggccggggcaacacggtgaaacccgctctctcttttttttttttttttttttttttttttttgcggcagtttcactcttgttgcccggttggagtgcagtggcgcggtctcagctccccgcagcctccgcttcccggatttgggtggttctcctgcctcagcttaccaagtagctgagattgcaggcatgagccaacatgcccagctctttttgtatttttttttttttttttttttttggtatagacggggtttctcccttcgtcagggtagtctcaaactcctgacctcagattacccgtctgcttcgacctcccggggtggtgggattgcaggcgtgagccaccatgcccagcttatttttttttcttttttggtagagacgggtttctccatgttggtcaggctggtctcaaactcccgacctcaggtgatccgcccgcctcggcctcccagggtggtggggttgcaggagggagccaccgcgccgggcgcaatttattaatgagaaaggaacagatgggcctggcgtggcggctcatgcttgtgatcccaggacttccgatggccgagcgctgcggatcgcttgagcctaggagttacacgccggcctgggcaacatggtgaaactcagtctctctctctctctctctttttttttttttgagagggagtttcactcttgttgcccaggctggagtgcagtggcagggtctcagctccccgcagcctcagcctcccgggtttgggtggttctcctggctcagcctcccgagtggctgggattgcaagcgtgagccaccatgccctgctaatttttttttttttttttttttttttttggtagagatggggtttctccatgttactcaggctggcctcaatctgacctcaggttatccgcccgcctcagcctcccggggtgctgggatcgcaggcgtgaaccaccgcaaccggcccaatttttaatcagacaggaatagatcggcctggcgtcatggctcacgcttgtgatcctaggattttggacggctgagtgtggcaaatcgcttgagcctaggagatccagacccgcttgggcaacatggtgaaacctgttttttttttttctgagacggagtttccctcttgttgcccaggctggagtgcagtggcgcggtctcggctcgccgggcctccgcctcccgggtttgggtgattctcctgcttcagcctcctgagtggctgggatcaagggcgtgagccaccaagcctggctacttttatttatttatttatttatttatttatttatttatttaggttgagatggggtttctccatgttggtcgggctggtctcctgctcctcacctggggagatccgccggcctcggcctccaggggtggtgcgattgcaggcgtgagtcactgtgcctggccggaaacccagtcccttaacggaaaaacaaaacaaaaaccacaaagattagccagacctggtgggcccccctgggtactcccagctaccctgaaggctgatgcaggaggattgcttgagcccggggtggaggtggcagtgagccatgatggcgctgctgcagtccagactgggtgatagagcaggactgtgtctcaggaaaagggaaaggaaaaaaagaataataaagaaaaagaagtatataaaattgctaaatccaggaacagcttcacagtatattgagagaaatagaggcaaaggttagcagacaccaatgttcacttagtggaactgcagttgtccccagacaggaggctgctacttttacaaaagaaatctattattgacaaaaaaaaaaaaaggtggtttgttacaatacacaaatagctaaactttatatagccacgaccctcttctagcactgctctaagccttttcctgctctggaatagctactattgttacctccattgtagagaaaacagatgggggaggttgttgtggaaggaccagggaaactgactatgaaattgacttgtaagttgaggacttaaaggttcttcctgctttgctccttacattgccacattttagttaacatacctcttaaaatactggtcctttctgtatttggagggactcctcttgcagtttgaagttttttcttacactaagcatctggttagaagatcatctccattttatgtcagtttaagtttagacattgttcagtaaggaatgtaaatatgagcaaacagttatctgattgaaatagataaactagaaaaaaagtcacctatgagaaagtcaacaaaatgtcaactctggatttgtggctattttcagaatattaattttttgatatttaatggcattgtgaatatatttatttttaagaattccttgtcttctacagatacatataaggtaattaaaaatgataggatgtataggttttacttcaaaatcattcagaggaagaaggaatgtatataaatgaagtgggaatataaatgaaacaaaactggctgtggccaggtgtggtggctcacgcctgtagtctcagcactttgggagaccgaggcaggtggatcacctgaggtcaggagttcaagaccagcctggccaacgtggtgaaacaccatctctactaaaaatacaacaattagccggatgtggtgccgggtgcctgtaatcccagctactcgggaagctgaggcaggagaatcgcttgaacctgggaggtggaagttgcagtgagccaagatcatgccactgcactccagcctgggcaaccacagcaaaatcccacctttaaaaacaaacaaacaaacaaaaaacaaccaaaaaaaaaaaaaaactgtccataccatgaatgaaaaattgttgatgatgtgtatatgtagggcaattatatcatttattatatataatatatatattatttttctcaacttttttttacatctgaaactttctattgaacacatggacatgtcccttgataactggggctgcttccccattattctctcagcagcccttctgattttcactccatcttcattcttagagattctggattttatttttttttgggggaagttcaagtatgtctttgcaaggattatccagcatgtctacctactcaatcatattatcagaaacagaaaaagtgtccagattcttgtcttgtcctgttcagattttttaaattccaagaacagtcaccttctaccagacactctgatgttggaagacaaagcatatttggtaagtggcatgatttctgggctccgatttagaacagtcacagctttcaacaatccaaaaatagctgactgtgactcaccatatttagaaagatggagattattaaaaaaagaaaaccttaatttattatgtgaccgctaagtgtctcggctgaaaattgtaaagatagaaaggtaaatcaaaagatacagagactgtaatcatgcagttaataaagcgctaaatcaaaatgtatttggcatatgtgaaagagtttaattttatcccattttctactggcactataggtatttgtaagtacatataaaactacagtgttacatataaactaccaaaaaggaacttaagaaacgagactaatctagcaactttatttaaaagtttatcttaagggaataattaaggatgtccatacaaaaggatttagccatgacacgagaatgttcttcctggcaaatcaatggaaattattaaatgtgcaaaagggaactgttggaataaattctaatgccttcatatgatcgtatgtcgtaaccttttaaaatgatattaaagagttgcatacattgacttaaacagatattcataacacatcactgaataggagaaatacgggccagcaaagaacatagagttggtccaatttctacaaaaaaaagtagactaatagcatgacagcagggaagggggaatatgtcaatgtatgtgtgtatatatatgtatgcatagcaagtatgaacttgaaaggatatatatcaaattgtttacacagattacctcagagaggtaaataactggcctttggtgttctgtgttccatagattctgaattttctttttttatttaaatagagatgggatcttagccaggagcagtggctcacacctgtaatcccagcactttgggaggctgaggagggcggattgcttaaggccaggagttcaagaccaatctggccaacatggcaaaactctgtctctactaaaaatccaaaaattagccaggcgcagtggcttatgcctataaccccaggtactcgggaggctgaggcataagaattgcttgaaccaggaggcggaggttgcagtgagcagagattgcaccactgcactccagcttaggcaacagaccgagactctgtcaaaaaataaaaacaaaacaaaacaccaccaccaacaacaaaacagtaataaagagaaaatcttatggacaggagcaatgtctcatgcctgtaaccccagtgctttgggaggccaagatgggagaatcgcttgagcccaggagttcaagaccagcatgggcaacatagcaagaccttttctctacaaaaaatttaaaaattagccaggcatagtagtgcatgcttatactcccagctacctgggaggctgaggtgggaggatcacttgagcatgagagttggaggttgcagtgaactgtgatcacaccactgggaagccatgaccccatccctgccttcttcctctgtcctatgctagcaataagtaagtttcccagccacaaataattattagaacctcctccccatgtgccacctccaaccaccgctaggtatgatacaggggtggccctaccctctggaatatacaaaaccttacacagacacaatatatacaccggggaaggggggccaccccagcagcccatgccttcgcctggtccacagttagccccactgtcctgcctcagctacctctctgaataagaagattggagcccccactgagggaaaagttgctatggtgagagtaaggaggccatgaggcctcctccaaacaaaccaactccaccagcctctggctcttaaataacaatatcatccagaaatttaaggactcagctctggtcaaggtggcaaagggtctgtttgtctttcctcgttagacagtggtcttgtcttgctaccctaattgtaaaggggtgactgggaaggggagatagggacagtgtggtggtggagagaccccagccccacttctccaggctttgctgacaggggcctgcttttaatttttatttttatttttatcccatgcctttttttttaaatcccataacttctttttcataactttttttggtaacttttcataaaactttcttctactttttggtcacaagatttttttgccacaacttttttacattttttatcccataactttttcaccccataacttttgttaatcccataacttttttattttgtgttcttttaataaacccttgcatagttatattacaattttgtaaaaatgaaacattatctcatgccaagcatgctcagcatttgcacagtatcaatacctttaatactatatttttcaagacacacagaataaaattttaaggcaaaaacagcactttgcaacaacttaataatttattacattacagtagcatcacaccagcagtcaataatgccactttaggcaaaagtctttcagtatttccgttttacattccgcttacaagaattcataaattggtaaaattcattctaagaaaacttggcaaataaagctttggactggaattggcatttctttctctacttttccttcccaccatttatttcctttacagtattcatattttaaaatgttttaacttatttcagaacattaagatagcagttacattgtttaatagttattttaaaatgactctttcagataaagttttagagaaactatagtatggatagggctgatttacattttcaaattttctaaaaatcagctttggttttagagctgatttttgttcatttctggaaaacctatcagatttaatccaatactttaaaaatgattattatatattgcactctttaaatcggtgatttgattcttcctacagaaattcaaatttattgaattgaactcacattttagaattctgtttctgatgaactctaaccttccaatgttgccttctaagcaaattgaaagctgccttataccgaatgaggaagaataccaatacttggctgaatgaggtatcgcaaaagactgcaatgcactttgaagaaagacttaagttatagtcatgcgatttccattctttttagctttttcttaaatatacgacaaatatctacacaaagagtggtatttctgttaatacagtcaatttattttccagattgacattcagcttaaatatgccagtatgtgatttaatccataggcacctgatgaacacattattgtcagattggttacagatgctcgtagttgtctttaaactgaactcaaagaatgcaaaaacatcaagttcagaaaataaaaggcaaggacaggactttaagtgcattttaaagccacgggctagaaatcgtaccactgttaactagccgcattatttggtctaacattttttctttatcattctgaaactgggtttatctaatacattgatacattcatacaatttggaagagtccgttgaagtcacaaggacccgatatttgcactctttcagtgattgccggcaaatctgttattccatcggcaaaatcgtactgctgctctcctgttaatgtcgtatttataaaagtatcatgaggatgccaactgctaaaaatggagatggtctagtaactagaaatccccaccccagggagcacacatacatatctccctacatcctaataatgtgatgtgttttggaacacagacattagaacttcatgaagttttaactgttgagtctttcccaagcatcatcaagttatgatttaggcaatgtacaactgaaattcattcattcatcatgcataggcacaatcacataaatactgcacaaaatatgcccgtaagtgaaacccagaggtacagaaacacatttcactcttcacaaagaagtttgtgaggaaatataactctgtgattgtatagacatgtttcctgataatacactgacattcaccaacagtagattgcactgcagtttgtacacattttaagttgcataaacttctccttgattttcaaagatagtataatactgtctactaaaactcctttttgtttcaactaagcactctcacatatattagtttataacaatgtttattattatttcaaagtgttttccattcaaggaaaagaagtcaattcctatgtcaaagtaaccaaggtggttgaagaataggcagagtggtctagatggtaaaatcaatcttcaagcctcaaagaagctccatgaacagaggaatgccaggtgtcacacagctttccttcactctaattcattcttgactagagcctgtatgcgtgttccagggacatttaaactcttaaaggatttcttctgatctttactaaatacattaagaagaatgccaaccagtgcccttttgtgtactgggacatgcagtcatgtgattaaaacaggtaacatgaactctgactttaaaatatagatacaaatgctctaagctaggaaaggttttccacatccatagtcaatgatgggaacctttcattcctcagaaataagccctttttaggtcatcaaaaaagagtacaactgctgcagctcatgatgcaatatcttcatgagcccagagcacatacaaatcctaaaggaactacaatagtacagcactaattcttggcaacagaacaaatgaaacacactctatcttgcacatacctgccagagcaggcaactttcctcttctgtgaaatttaaaaagctcccccaaaatgttattactcccatcaccaatacacagaaaatgagggaaaggctgtttccagttctcggcctttaaacaactctaaatgtcagtactcttggtggcatattacaaagtattaaatagtgcaaacttggggcaaaccacatattgtgctaatgaagagctcactgtgattaagattagatcaaacaatagcagaacataggcaaattttatctgaattctgtaatgaatatacatgcttcaataacattaaaaacacatggcagcctattccaaaccagcaagaatagttttgtgcaaatagtgggtctttgtgtgtttgaactcccaccacgtaagggcaaactcaatatgcatgctaatgacctacaatcatgaaattgaaaaagaaaattgcgaaagtatgccagagtgaacatcagtgaaagccacagagacccactctcttttaactatttacaaataaacttaaactataaattagaaacacaaataatcataagtggctataacattcaaacgaagtaaatgaattgtgtaggagattaaccccataactttgtttcttttttaaaaatttcttgagcagctctttgacgatggtcatgtttatctccttcttcttggcagccaagcccagcaaaagaatggcacacagcagttgctgcccaagcctgggtgctcctggtggtcctgcacgatcggctgtgcagtagggttgtcgtggggagaaccctccctggcctctccttgcacaggctccacgctgtcagtgaggctcacctcacaaagatctttggagagagggaggcggggatctgagctcagtgagagcccccctgctcctgcctgcccaccccgcctgagggctctactcaccaccatgcttgtgggcagccccaagctcctggggggctggggctcctggactgggctcatgagcagggttctgggcagtcaccaagaatttgctgtgtcccttgtagtcgccaccagctgcaacaccatctcctgcagctccagcagcttcacctggagggaggggtgctcagctgtcacgctgctgccagcgctcaccgtcacagccacccccacccccgcagagatgttgcacactctaccttcatctcctccctgtccagggccagcctgatggtgtcctcctcccggtgctgcatctttggcactgccccctggctttgttatagggtgataaactttcctgcgggaggacagggctcagacgctggggcccctccaacagccctgcagctccccctgccatgccctggcctcccactcactgatggcatccctctctgtagtactggaagaatccaagttcttctttctccaccagctcactcaggtctgccttctcctccaggtggtccataaagccgctctggagccaaaataatggggtcacatctcgccagcgacctgccctcaggtggcattttcaagtcatggagaaggcggaggtgagttccggcatgggccagcttctccatgacttcctgcagggcccggtgggtctccccactcacagactcgcccccaggccctggggctgggaccgctgcctctggctccttctgggccgaggccaccgggtgagccaggcgctggcagcacaccctctgctctttcacctgctcttgtaactgtgcctgcttctcctgggcactagctccagcggacttgaaaaatgccacctgagggcaagatgtgagcattcttctaggggcatacacagaagaaatggggcagagaggtggagcgcagccccttcccttggggccccagagactgcacatgttggtcacaggtgaaatggtgtctgaccactggctctcggaaggggtgagggtccagagaaatcagaaggcagggaaacgaagagcataaaggggtcttggagggaccacagagaaaggtggcaaaatgggtgcagggggagtcaggctcaccatggcctccctgctctccaggtcctctgggacactcggcatgggccgaggtgcctcctccccctcactgtccagatgttctcctccgtgtcctgtggggggtggccagaggggtcttcagacaactcaacaagggaagtattgtgggcccacctctgcctccaccctcattgtgtaaccctgagccaggccctccccagagaggaatgagctgctgttatttatttttactttgaagaaccaagatcttgctatactgcccaggcacattcccactactggtcggtgcgggagttctgacctgctccctttctgacctcggccagttcagccatccttaggcaacttggtggccccccgctcacaggaggtcaccatattgatgctgaacttagtgcaggcacccggttagtataatgaccagctgttctaaaggtctcttccaactcctcaatcctatgctgctagcagtccccccttcctcctggggctctctcctcttcctctgagcggtctcccgtaccttccccagggagagccatgaggctcaactgggccgttagctgctgtttctgctggctggcagcttccagacgctcctaaggggccaggaaagagtgagaaggcacagagtttgccaggtcgtccccctcacggccccatcctcggcagctccctcccctgggcctcctgcaacttttggcaggccatctcggccaccgctttgccccaagcttcctgctgctgcagctggttcattagctgggtctgctgcagtcactgcctgtacagcgcctccttctcacaggtcagctgctgataggcggccacctgctgctgataggtggccacgtactgctgcaggtgacccaggtaatggtctggctgctgctgcagactctgagcctcttggctcttcagctccacctgcaggaagaccctgggtgtgagggcacgtggtggctggtttccagattctgggcccattaatagggtagcgagggcactgtggggctctgtcgcctgcccaggcccctggccccttactccaggcctaagtgactgcctccctttcctagaaccccatgcctccttccccagcctcaaatctcatgtcctcttcccaccatttcaactgtaggccacagaatggtagaaaagtagtgggagccaaccaccatctgctaaatgtgctacaggcctaatgcttcccatgtattatctcatttaatcctcagcacctctgtaaggaaaatgctaacttccttttgaagttaaagaaacagagacttagagatgtgaagtacttgaatggtgaccagtggaactgaggctggaatccagttttaatctaaggagtctttttgttttgttttgagacagagtgtcactctgtggcccaggccggagtgcagtggtgcaatctcagctcactgcaacctccacctcctgggctcaagcaattctcgtgcctcagcctcctgagtaggtgggattacaggcatgcgccaccaccatgccccactaatttttctttctttttttgttttttgtttttgtaattttagtagagatgaggttttaccatgttggccaggctgatctcaaactccaaacctcaagtgattctcctgcctcagcctcccaaagtgttggcactataggcgtaagccaccgcgtctggcataagaagactgttataccactctgtctcttcccctgtgattgggggtgctccatgtctctagctggaatgatgatgtccagacctgggaggagcccagggctacccacctctaaaatcagagggcaggaagcaagaaacagccacaggactgccctggagggtgctggggtcacctgcccccgggctggagctgcctctggcctggcacctcccctccccagaggctggtgcccacctcccagaccttcttggatggggtggaggttaccgtctccttcaccttgcctagcttctcctgcagctcctttacttgctgctccaactgtagtacgctcttgttctcattgttctggacagagagaagcaatcagcagccacccactgcagctggagaccccagaacttggtgactgcctcccatggcaccgggaagggtggaggcaggttagaaaaatcatcccctgtctcccacagccaccagagcagggctctggctcacaggtgcctttaggagtaacatttcacttgagggctacactgccccattttataggtggggaaacaaaggcctggagggctagggaggagggcaggctccccagctggggcaacgcaccagctccttgaagctgttctgtggctcggccagctgccgaagcctctcctcctgctctggaagcctctcctgctgctcctgaagcctctcctcctgctcccgaagcctctccttttgcccctcattcaggagacttatgcgctgattgtactccacctgggcctggagcgctcctgccactctctctagttccttcctcaggtgctgcagctccacctcagagggcactgctgggggctccgggggcagaggttcagctgagaaaggaagcagataataagagcctctggattccaaaaaaaaaagaaaagaaaagaaaagaaaaaaccctcctcttggcgcacagctcctctccggctcctcaaacttagcctcactgctaatgattcctcgcacccagatgggtagccagtcttccaaagcactttcagagaaagagcactgcgggtggctgacaacgggccctctttgctgatggggacactgaggctcattgagatgacaagacttgccgtctcctggcacagacctctttccctctgcctcaaagcccttccatccacccacctcgctggggcactccaagacaccctcacagccctctgatgccagtcctgctgccaggtcacgccagccccatcttacccatctggtttttgagtttggacaagctcctctccagcttctctacccgatatttatcatgcttcttctccttcttcaacgagcaaacctgcccaaagcacagggggaaagggccctggagagaggggctggaggctggacatgctaccatctctctctctgcccccacctccacaaagcccagacccatgaccacctctggctgtactattcccattttacaggtgcccagaaagatccagtgacctatctaatgtggggggggctgaagggtcagatctcacctcctgcgacatttttctcatcctctgctgccaccgggccctctctccttttagatgttcagcatattcatccctctctagctggacttctttaagtgactccttcaactgcaagaatgggcacagaaattaggaagggctgtcactggtcctcacctgctcctggttacctggggtcatcttccttccacatccctccctctgaacacctcacctgtgtcagctgcgctttcagcagtgcctgctcccgcatggactgctctaacttccactccatacgtgctttactgcggctggagaactgctgaagagtgagaagtttcaatctggggaggccgggccattccacacagtgccccttaaaagggccagggctaggcccaatatacaactcggtcagtaaagatcaaggcatttccaagcccgtggtttggtttttaaagaactcagtaaagttggaagggacagggaaagagatcgaatttatagctggctaacagaggcccagagagatcagataatattgctattgttattactgttattattaccactgtttgaacttttatggagtgcttcaccagataccatgctagcaatcccatttaatcctcgcaaccaccatgggagacagttactatgatgacctctattgtgtagatgaaaaaacatggagtatttgaggttaagtgcttgcctaagatcacttaggcagagctgggatttaaacacccagatctatccaattctctaagcccatttttcttgctgggggtgggggcacagctaggaaggggaaaattaatcttttgttcactttttgaaaggataatacattcacatagtcccagactcagaaggtacagaagggaagtatctcccagccaccctgttgctctctcctgagtttttatgaacacttgcaaacatattttatgtatattatcataatatgtacacacacacacacgtttcctctctctacagaaatggtaacatactaaaggtactcttctgtaccttcacagtacaagtagccaataccccacttaggacttggccaagaccacagccaggtaaaggcatggcaggcacttggcctccaagctctacgtcctgtgttctctccccagagtgccccccaactcacccacagcagctgactcagtcccaagctgccgctaacaaccatacaaaaaagcagtgagaaatggccatgctgccttctgggcaggacactccatcctgcagaagggacctttaggctcactcctctgtctgtgaagccaggctaccaggggacggggcaggtggttggactcaccctctccgccttcttcttctgtgtggcggtgacagcagagagagcccgctctaactctcctttacgctgcaatgaatgttgcagacggacggccagatccttggactcttctgtaatgagagagttgagatggggcccaaaggactccccctgaagacctgtcaaagtcccaggttgaaggatgacagggtacccagattcccaccttcaaagtatctgagagaatgtttcgtgtggtacaggtccgtatttagtttccctttctgtatgttcaatctctggatttgaacctttgggagaaaagccaagcaagtgctgaaagagaaggaaagaaacattctccggaggacaggagaaaactgcacaccgtccactcacctctagctccctttcggctttctgtttctcgttgtttgctttcttttcctgtaggaagtggaagacagagatctaaccaggcggaggcagagatggtactgcaagagacatgtccccagaatgccaccactgcccctgccccgggacaggcccacccatgggaccgggttatcagggaccctgtgggggatggggtggactctggggggtgagccttcttccccaggctgggagtgggtgagacgagactcggggcctctacatctgagtgtcccccaaaccgagcagtcatgtcgcgagcaaacaaagaaatcatgttacttcttccagctgatgttccacttgtttcttctgttgtttctgtggggagagtcacattaaggtgatggagggtggccccctcaactctattccccagagcaggaagtggtaggcagggaccaggaatggattttaaaggcaaagttctcagacccagtgggaacacgaactggtaaactctcctcaagctcccaaggacagaggatttgggtctttgttggcttttgtccacagccacagaactcaaggtctgaatctggaatctcttgacaggacagtaacataaacctctagagatggagtttgagaaaggcccccccttctgccagcttgtgatttagaaaagtgcattcattcaataaacatttactgagcacgtacgggccaagtacggttcttcacagcagatttagggcggaaaaggacagacaggagcctttggccctgaggtttccattctaggaggcctttaaatctcagactctcagagctaacagagacctatgatactcactacttcctctggaaacacgagcccaaaaaggagaggtggcttgtccagaatcaaagagcaaattagggactgagtcatggcagaaatacagggcccctgacaaccagtcaggctagcacttccccaagaggcaacaatcccagggcgtgtgtagcaaggactcgagcagggacgtctggagaggggagagtcagcaaacagggcagcaaaaaaagagccatgctgcatgctccggggtccctccaggtgaggcctgggcgccccagctccctattcgcccttggcaccaggggccgccgtcccctttcttcagggccccaaggggaaactagagcccaggattggcagcgtggaatcaggggaccccagtggactcttaccaaagatttgatggtgttcttcagttgactgacttttacggacctcgagtctgggactactgctagttcttggcacgggctctgaggcgcatgcagagaggaggaggtggaggaggagtggggggagaggtagagagagcaatcattagggctggggtgtgtgtggactgtctcagctggcagaggggcaccccgtcccacctggaggaggaggttggagggctgccctgcagggtcactgcacctctgcccagagcctcttacctccagatccttcagggtagcagatgatgtagggctctccccgtggatacctgttgctgactacaagagatgagagtgcacatgaagatgttctgtcccactcagtatctaagccctctgacttcttttcttccccatcaactggcacaattttcttttctgcctatcttggaccctttgtcccataactcctttgtgccaacttctctcatggttcttatctccccaccacagcaccctgcggccctttcagtgactcctgtgccaagtgactgttctcattgtcctggcttccccttgagactggggatgaggaaaatcgaacagcaatgaccatatcctgggtgttctgggtgtttacagcaggccatgtactagggattaacataaaaacaacaataacaaatctcatttaaacttcacaaatggaagtgaaacaataccacctctattatacagatgtgaaaagagaggcccgatgaggtcaagcaacttgccctaattcatatccctagcagacaaagaggcaggattcaaacccagaattcttcacaggtacccaacagtccatccacaatcttaacaattaccctctagtgccccttgggtcccctgtccccaggaacctagtcagccaagactcacatctccaggtgagtggcaaccaccagaagtggctgtctcatggatgctgccatttgttttcctgttcctcttggctcctgctggaacaccagggctgtttctctgccaatattcttttaactgtcagaaacaagagcagtaatactcatgagaactatcagcccctgcagccacatcctcctttacagtttttataaaatactcttatacaccatctgatttaatgacaccaacaactgtacaaggtgttgtcacaatcatttagtgactcaaagagattgatatcatggctagaaaaaaaaagaagaaaagaaaaaggcgacagacgaactttgaaactcagtcttctgactccaaactctggggtattaccaagaatcagcagctgccagggaccaaaaccagaggcagaggtagaaaagtaaacattaagtaggcaggaactgtatgccatgtggtttagagtcatacatcctcacacgtctgttagtgtgaagaagtgcaccagtacctctcaaactcttatatcaatgtatcctcatggcagaaggcagcctttctgttaaatctgggaatttatcagaaagaggacaacccaagcctcatttcagagagaggtctggtatactcttagaaacctatgtgactgtcatccctaagtacattaatgttttttctcttgatctcaagagaatcaatggaaactgatgcttcagaaagatgtcccatatgtatcctgtggcactcaaagtaccccaggtttacataatatgaggaagattcaagctgtcaagttcagtttcccaagatctattccacagaagatgagcaaatctcacttcacagaccactgactgaagggcagtctggtcccagaaccatggagaattagaatgtgaggtggagaactcacaaaaaatttgttaaaatctctctggaaagtagaagcctgggagaaaaccaaaccaagtcaaacccattctccagttgccatccagaggtactgtcaatgttttgagctcacaggggaagtgtaggcttttcccgctgtcaatgtttgtgttaagggagtgaggcagcctgaaacctcttgctcctaggtcccaatctccattccccttccagctggaaatttgtgctgtgacaagaggaaccagaaatggggtggcaatgcttaggggactgggtcataagatcaaaggccagtctcgcagtaatgacagttactggatggaccatgacatcactacattccactcttcctggtgagggggagggaccacatcagcatgatgtccgagtcaccgctccatgataggggagggaaaaacagagctgggacccaggtccttggagacgccagtgcacacagcctagggaggtccaccttgaggcagcaggagggaagggaagagtcagcagcagggagccccaggattcaccagcctaaagtcacccagggatgactggtgagggtggggtctggggctgtgggacccaggtccttggagatgtgagcccaaaaagccctgggaggtcaagcttggggtggcaggagatgagggcccagtaaaggagcggggagccccaggattcacctgcccaaagtcaccctggggtgattggtgagggcagagactgggctgcttgctgaaggggtggggctgactggcaaaactttggtgggggtagcccagaggcaccggtgtgggggtcccagtccggtgaacctcgggattggtatggactctggcagcagtcttgtcgttggagaggatctatggctgggttgggggtccgtgacctggtgtgtttttacctttctcttggctgctgccaatttactttgtcgagtttcttctgccattgcagggtggggagggaggcgggcttggggccacatcagcaaaatcccaccaagcactgatcaacacctccagtcacctaccaggtagctgtgcgactgagccagaggaggcgtaaccagggatgcagtagaaggcagaataggggcgtggccttaatgctccaagcccattggttaatgagaaagatgaaagggaaagggggcgtggccaggcatcatgtgtccagagggacctttggctcacaaggaaagctgcccatgcaaccactgtccccacccactctaagagaggggagaggccgccaactctgggagaggggcagggccggcttttgctttaaaagcttttaaaaaatatatatgtgtatactttatatatatgtgtgtctgtgtgtgtgtacctgtgtgttcctccagagctgtcttcatgatccagcttctatgcaaggtctatgattttggcctatatttttcatagagtacaaaaattaccagtattaccttaaccgagatacagatcctatgaaaatggaaaatccatagcatgcttgatgattactgaagcagactgtattatccaacattccaataagataaaataatcacaatgacttctcttttttggaaaaatgtttctcttattctcctacgttattgtgaagactttttttcttaaacaagaaacatgtgtaatatttgtaaaaacacaaagcttttgggccgggtgcagtggcttatgcgtataattccagcactttaggagcctgaggctggtggatcatgaggtcaggagattgagaccatcctgactaaaaaggtgaaaccacatctctactaaaaatacaaaaaattagccaggcgtggtggtgggtgcctgtagtcccagctacttgggaagctgaggcaggagaatggcgtgaacccaggaggtggagcttgcagtgagctcagatcgtgccactgcactcgagcctgggctacagagcgagactccttctcaaaataaataaataaataaataaataaaacttctatttctttcactttctaatataattttaatatctcctcctgggatttcactaagacacattttggacctcattctgatcttcctctcccctccaagcccaccaacttctgccctatcatctatcctcatgtctctctgtgtgacatgctgacttactttttggagagaatcgcctaaacaattaattctttcttctcgtgtctaatccatccactagtttcttatttcaacaattacatttttatttccttatttcattttattctgcgactgagtctcattctgtcacacaggctgaattgcagtggtacgaacctgcagactcggcctcctgggctcaagtgatcctcccacctcagcctcttgagtagctgggactataggcaggtgccccatacccagctaataccatacccacacagcagagacataaaagatttccatcctcaaagaaggttccattgaacagcactgctctaattcaataaaaaataccactgagcacaacatagtaatagaaaagattgaagaggcagtgctgatacttaaaaacctggtattttcagccaggcatggtggctcatgcctgtaatcctggcactttgggaggctgaggtgggaagatcgcttaagcccaggagttctagaccagcctgggcaacatggtgaaaccctgtctctacaaaaaatacaaaaaattagctgggcatggtggcatgtgcctgtagtcccagctacttgggaggctgaggtgggagatcacccgagcctgggaggtcaaggctgcaatgaggtgagatggcaccatcacactccagcctgggtgacagagtgagaccctgtctcaaaaacaaaaaacaaaaaacaaaacaaaaacacctgatatttatttttaagtacactattttcaaacattcagaagttatttcatcctaccttcatggtttccattctatgcctggtttagaattgggatctgataaaataaacgtgttcaacagaaccacttctcatggctgtataacagatgatcaatatgtatttgctgaggaaatcatacaattttcttaaatttttttaacaaaaattgtgctttcaagggaccaaacttgaatactacaccttcatgttctaagaatcaggggacttatataaaacctcagttgcctgataaggactacatcaaagtgaaaagccatgggaaagaactagaaagtatacttttgaccctagttctgtaaagtttccttatgccacaggtaatacacatcgcaattcctgccaaattctttccctcacctctgtttatggtctcgattccataaataggagaagggcatgaatttgctttagttagatagacagatagatggatagatagatagatggatggatggatggatggatggatagatagatagacagagataaagatagagacaaagatggagacagagatggacatagagacagatttgcagaagataagttctaggtgaactagtgtcaacattaaagtggtatgcctacatctaactattctggagagaaaaacatacctcaaagaaattgacttaaatatatacagagaaaaagtttaagctgaaagctactgcctttttatatgagacactttaggaaattacttggggggcaagagagaaaatgggtggacatagcttagaggttacacagtagcagatatgtaggatgaacaagcctagaaatataatgtacaacgcgagaaatataggtaataaaattgtgctgtattgggattcacgctaaatgagattttaagctcctcttgccaccaaacaaaaagaaaacgggtaactatctgagttgaaggatacgttaatttgcttcactgtagtaatttttttaaccatctatatgcatcccacaaaatcatgttgtataccttaaatacacagaatacaatttatttaacataaaaaactactccaatattttctgcatttttaatatgctcacccaaagaaagcattaatttgcatctttgatgttaaacagatagcctaatcaagtcactatcaagatcaagactaaaagttacagcttttttcttttgatgcctttcagatatatctatttatatataaaaatatatatacacacacacatacatacacacacacatatatatgtagttatgtgtgtgtgtatatatagttacagttttggccaggtgcaatggctgacacctgtaatctcagcactttgggagaccaaggctgaaggcttgcttgaggccaggagtttgagaccagcctgggcaacgaagcaagaccctatctctacaatttttttttttaaacaaaattagccagggatgatggcatgcacttgtagtcccagatacttgggaggctgaggcggaggatcccttgagcccaggagttcaaagctgcaatgggctgttactgtgccactggatcccagtctgagcaacagagcaagactttgtctcaaaaacaaaatttatagttatagttttatgaaccttgactgcaactgagggaaaatcccgtaattggcaaaatgaattctgcctgcttgcaaaacttctgactaatacggaatgaataataggaagcccatattagaggatccacatcagttaaaaagtttccaaataagagtgactctgagttctgcagagtgaaaagattgggttcaaaccaaacacttgcaagatcttgagtaagatacttaatccctctgtgactcactgttctcaaatgtaagtgaagataatttgtaactcaaaaaaaatgaaaaagttttctctaagattgcaaatcctaaggataatttcattttaatatcagttatttagtctggatacaccataatgcagactaattttccctctgcttaaagaccacacaaaaacattaccaataaaatttacttgtgtatcaacttttactcctgagacttcatcgtttgtttggttaaaaaaaaaaaaaaaaaagcgcactagaccgggcacagtggcccatgtctgtgatctcacttgcggaggccaaggcaggtggatgagtttgagaacaacctgggcaacatggaaaaaccccgtctctacaaaaaaaatatataaaaattagtcaggtgtggtggcacataactgtggtcccagctactccagagagtgaggcgggaggattgcttgagcccaggcagaggttgcagtgaaccaagatggcaccactgcactccagcctgggtgacagagcaagaccctgtctcaaaaaaaaaaaaatcactataaaattgaaattcacaacaaaatgtgcatacttaaccttctttttatttatttatttatttatttttaatattttgagacaacatcttgctatgttgcctaggctggtcttgaactcctgggttcaaaccatcctccagtcttgacttcccaaagtactgggactacaggtgtgagccaccagccccgccagccctgttacactattcttggcccctcaagtgactgtatgaattttaggatcagcctctcgagttccacaaaaaaattctattgggatttgtgtaggaatttcttgaatttatagattaatttgttgagaagtagtatgtttatagcattgagtcctacgattcataatatatatggcatatatttcagtttagtcagttctccctttaagtccctgggtaatttttatatttgtcttagtcccttcatagtgccataacaaaacacctgagactgggtaatttacacagagcagaagtttattttctcagttctggaggttgggaagaacaagatcaagactccagcagacacagtgtctagtgagggcctggtctctgcttccaagatggtacgttgaatgctgcttcctctggagcaggcaaatgctatgttctcatgaggcagaagggacagatttaccaccacccacaagcccttttataaggaaggcactaatctcatgcatgagggctcacccttatgtcttaatcacttcttaaaggccccacttcttagtactatcatcttgggaattaagttttaatacatgaattttgggagacacattcaggctatggcaatactcttcatgaaaggcctgtgtatactttgctagatatattctcagggttttgttgctattgtgaatagaatctctttttttttttttttttttgccacggagtctggctcctttgcccaggctggagtgcagtggcgtgatctcggctcactgcaagctctgcccctccaggtttaagcagcctgttgcccaggctggaatgcagtagcatagtcatagttcaatacagcctcaaactcctgggcccaaatgattctctaagctaatatttttaattttttagagatggagtttcattcaaggatcactaaaggccagtgatcctcccgcctcagcttctgaaattgctgggattacaggtgtgattgagccatggagcctggccagacatgggctattgattctcgctgttactcttttccctttccttctaatccttgtattgggaagaaaacagtatggaaattttatttcttcattttattgatacgtagatctctgcttagaagacaattttagttttaaattataaatgtttcgttcattattcatagaaaactagatttgccatgggatatttataagtgttgcacgaatgaagggttttctagtcaaataagttgaaacacattacgttaaacaaacttggacagttttgtttccggtcatttttagagttctaaattatgattctactcaagaggatattgtatgcggtattttcaaaccaactcatcctgcgtcaggttgtggttacgctttgggagaggaagctataatcttatactgagactgtaatgaatgtattaaggtaattttcgtagctttctctttttggagttacctgagaaattatgacacccttttccaaacaggccaacctgctttgcaaacacgatttccataattttaacaatggtgaggccaggcacggtggctcatacctgtaattcctcccagcactttgggaagcctaggcaggaggatcacttaagccaggagttcaataccagcctgggcaacatggcaaaaactcatctctacaaaaaatacacatattagccaggcgtggtggcacacacctatagtctcagctactcagaggttgaggtgggaaaattgcttcagctcaggagctcgaggctgcagtgaacggtgatcacgccactgcactccagcctgggtgacagagcaagaccctgtctcaaaaacaaacaaaacaaaacacaaaccaagggtgagagagatgttagatgtttttgtccttgttacagatgtaaatgctcagttggaaagagggaagtatttagagtgaaaaagtttcggtggaacacacacaaaaataggaagatcaggtataactgttccaaaaaaaagagtatggcagtatagaagaaaaggtctccatgaaaatgcagaagaacaatttcacagctggtgctggcatttcagagaccttgagctgggaatcaaaagatgggaatttcagtctcggatgtgccactccttagaggtttaatatctactaaacccggcgggctccacttggtggtgtttgctatttaaaaaaacaaaaacatgtggcaatgatcttccacgtgattctgacttgagccccacgcgagtctgcagacttacccttccactgctttgcccttcaagtttgtgcccattagcaaagagaaattttctctttgggatcactgctgtgttgatctcaggaatatttggcgttgaatttaacatatttttcatatgtgtgtgcaatagggaggctgagaaagttgtcttttttttaaggtgttcatttttggggtacaggtagcagcctgctctacaatccacacagaagctggaaatagcctctagagaatttccacgtttagagaagataaatttatacatttgtatctaatcaacattttttaggtaacatagtagtctaattatactatgtataattatactatgtataattatgggtactgaaatgacacctggcatatgctgtatgctctgttatatatacatatatatttacacatatacatatatattacacatatacatatatatttacacatatatatttacacatatacatatatatttacacatatatatttacacatatacatatatttacatattttacatttacattttacatttattttacattttacatttacatttgacattctacatttattttacatttacatattttacatttacaaatatttacatattttacatttatatatacatatatttacatacatatatttacgtacatatttttacatacatatttacatgtgtatatatttacatacattcacatacatatttacatatatatttacatacatacatatttacataatatttacatacacatattacatacatatatgtacacatatacatatatttacacatatacatatactatgtataattatactatgtataattatgggtactgaaatgacacctggcatatgctgtatttaaaaatgtgaggttcagtgagaacacatggacacaggaagggaaacaacacatactggggcctgtcagggcgggtgggggaggagcatcaggaaaaatagctaatgcgtgctgggcttaacactgaggtgatgagttgataggtggaccaaaccaccatggcacacgtttccctacgtaacactcctgcacatgtaccctagaacttaaaacaaaattttaaaaataataaaaaataaaaatgtgaaattcagcacataaactgttggttttattattcatattttcttaattcagaaattattttctgaactatggtttattcgataattttgacgtaacaattttttaagaggaaatttaagttttactttttaattggggctcttggttctttttaagaaagacagagataaatcatttatacatttaattagaagagactgggcttgaatttttaaaaagtactagaaatcgtagccactatatatgttatctttgaaatgttttagacactaattacctaaacaaggagcaaataagttaaacctcttggattttaataagaactaaaatgtacagttgtattttctggttttttaaattgttacagtctaaatttattcttcctaatgaagaaatgtatgtgccgtcaatatcaggttctttgtgggtactcacagttccctttgccttttacgcagtgaatgtgggcaacatgcgtggaacagaaatgatgtcgttttctttcttttgaatatcactatgaatctaataattcaaagattcctaactttctgaatgccattattaattggattcacaatgacttaccaggtacagagttgtcccgtgtgtcttggggtgaactactgagagtggtatgagggaagcgattctcagctagcgctgagtggggccacttccaaagaggtgatggggtaagaagcacacacaatgtggcattttcactgcaaagggaggtttgtgctgcctctcctcctgtggcaggtctgctcgcaggggaggctccaaagtttggctttgctgggtttggcatgtgagaactgatgaaatatctgtatgtagtatctttcaaggatttatatcggttggatttctgtgtaaatttgcatatccctttgactgctttaccccatagaagctttgtatgcttaacaaaatctgtaacttttctgtcactttctcatttagcatctgcctttctggctttttactttatctttttattattgtttttagtttaatgagattatggttagagagaaagatgggtgcatgattccgcttctttggaatttgttgagattttccttatggctcagtacatatgtacttgggggggtgaatgctgtcactttggagagatatgttttttctgtacattaagtcaagcttgttaattttctagagagatgtaaatcttctatgtctatgctgattgttttttgtctcttttatcagacactgagatatgtatttaaattgccctctgagggttgcaattttgtcatattttgctttcatgtattttgagtgctagttattagatacattaacattttagattaccttctcccttggtttattagaatttttatcattatattgtggccttaaaaaatctcccatattgctttttgcccaaagcctattttatctgataataatatagcttccaacccttctttgggttaggtacatatgacaggtgtatcttttttcaatctctctcagtctttctgtgactttatgttttagatgtcttttcatactgtttattttctgttttttgtgtttttttgtgtgttttttttttttgatacggagtcttgctctgttgcccaggctggagtgtaatggtgtgatctcggcactgcaacctctgcctcctggattcaagcgattctcctgcctcagcctcctgagtaactgggattacagatgttcaccaccacgccggctaatttttgtattagcagagatggggtttcaccatgttggtcaggctgctctcgaactcctgaccttgtgatccctccgcctgcctcatcctcccaaagtgctgggattacaggcatgagccaccacgcgtgccctaattctgttttatagtcattttctcttaattattcagtctatttacatttattgtgattgttggcatagtttcttttataactttcatcgtattttgtgctatttgttccatctgtttttatttcttcatgtcttttttgtttcgtttttgctaattccttttatattcatggttattctgctcttgaaatgtatgctatgtgaatatatttgtgagttgacaatactttattagcaattaaatatactatttctctttttttttagaacttgctcaaatgttacataacctcaatatccttagtatctaaattaaactgactttctgaacaatcatcattttaaggcagttaccacgatctactaaaaaataaaaaaaaattagccgggagtggtggtgggcgcctgtaatcccagctactcaggaggctgagg[131 bp omitted]taaaaaaagactgggtttaaccatgttgcccaggccggtctggaactcctaggctcaagcaatcccccacgcttggccagtccaaagtcctggaatcaaaagcgtgaaccaccacgccaggccgatcacgcctgtcatcccagcacttggggaggcggaggtgggtggatcaccggaggtcaggaatttgagaccagcctggccaacatgatgaaaacccgtctctactaaaaatacaaaaaaaaaaattagccgggtgtggcggcaggcgcctgtaatcccagctactcaggaggctgaggcaggagaaccaccaaaacccgggatgcagaatttgccgcgagcggagacccagccactgcactccagcctgggcaacaagaaggaaactccgcctcaaaaaaaaaaaaaataataataataagagacagattttcaccatgttgcccaggcaggtctggaactcttaggctcaagcaattccccacgctcggttgtccaaagtcctgggatcgaaagcgtgagccaccacgccaggctgatctatttctttctgattaataaattgggccgggagcggtggctcacgcctgcagtcccagcaccccgggaggccgtggcgggcggatcacctgaggtcgggagtttgagaccagcctgaccaacatggagagacctgtctctaccagaaaaaaaaaaaaaaaaaaaaaagagccgggcatggtggctcccgcctgcaatcccagtcactcggaggctgaggcaggagaaccacccaaacccagaggcagaggccgcggggagccgacaccgcaccactgcactccagccctgcaacaagagggaaactacgcctcaaaaaaaaaaaagagagagagagagagaccggttttcaccatgttgcccaggctggtctagaactcctaggatcaagggatccgccacgctcggccggtccaaactcctgggatcaaaagcgtgagccaccacgccaggccgatccttcctgtcatcccagcactttgggaggccgaggtgggtttacctgaggtccggagttcgagaccagcctggccaacatgatgaaaacccatctctactaaaaatccaaaaaaaaaaaaaaaaaaaaaaaaaaattagatgggtgtgctagcgggtgcctgtaatctcagctactcaggcggctgaggcaggagaatcgcttgaacctgggaggcagaggttgcagtgagccgagacagcgcaccactgcactccagcctgggtgacaaagtgagactccgtctcaaaagtatatatatataaaaataaaaaatgaaataaaaataaattgggtgtgtgcgctggctcacgcctgcaattccagcatccccggaggccgaggtgggcggataacctgaggtctggagtttgagatcagcttgcccagcatggagaaaccccgtctctaccaaaaacaaataaaaaaaaattagcagagcaatgttggtcaggcctgcaatcccagccactccggagactgaggcaggagaactactaaaaccctggaggcagaagtcgctgcgagcggagacccagccactgcactccaccctgggcaacaagagcgaaactccgcctcaaaaaaaaaaagagagagagagagagagagagaccgggtttcaccatgttgcccaggcaggtctggaactcctaggctcaagggataccccgcgctgggccatccgaagtactgggatcacaagcgtgagccaccacaccaggacgatctattcctttctgattaataagttgggccgggagcggtggctcaagcctgcaatcctagcacctcgggaggcctaggcaggtggatcacctgaggtcgggagtttgagaccagcctgaccaacagggagaaaccccatctgtaccaaaataaaaataaaaaaaaaatacaaaattagccgggcttggtggcttatgcctgcaatcccagccactctggaggctgatgcaggacaacgaccgaaacccgggaggcggaagtcgcggcaagcagagacccagccactgcattccagcctgggcaacaagagcgaaactccgtctcaaaacaagacaaaacaaaaagaccaggtttcaccatgttgcccaggcctgtctggaactccaaggcacaagcgatccaccctacttggccgtccaaagtcctgggatcacaagagtgagccaccacgccaggcagatcaaagcgttgagctgaataaagagttatcttttagcattttgtggagcccgggtagatctgtgcagggggaagcatattacagaagcgagaaacagagagttatttaattgaagcacgcattatgttttttttttttttacgtttttaggaaaaatatgttttgtgacttgcatttgtttgtttagtgaccttgcagttgcacagttagggaattagggttttgataatgcctgggaagggagcgataaggctcactagccataggaaaacaggtagtttttttaaaggactaaggctctttctcattctcagggggaattgggttttttttacatacagctgagtttttgcttacacattttttcatttcttttaattcctgttccaatcccagcatccttgcggtgcggtttcccagcggctctcttgccttgcagcttgtgtcgggagttgcagacagccatggcccatgggcctggcgctgacggaccctggagcggtgtctgagggaggtgggcaaagccactggctggcccgagtgcatcctcacgtaagtgcacagatcccgggctcgggtgcgactgcggtcgcacgtggacacgggttgcagacccctggcaaattgtggagctgggggaaggtaaggggaaatgtaaatcacttttccccacatttcagaggacctaggctatcaaaattttaaaaattgttaaaacttttacagtatggatctctcagttgaatgttattgaaatcaacctaacctcagttattcacgcctataagctccccttgaggcttattacggcccccatccccctacacacaactgtgttggtttctccttccgcctgtgctcctaaagcactcagtgtttacctgccatcatactttattgaaagcacaaacttgtcacttgtctgtctaccccactaagcttcttgagaattagaactttcatgtctcttcccaacacaaacgttttatgtgtattttgttgaagaacttcaaatatgacctataaaattatgactcatttatgtttcaaactccaacctctcccttgagttccttgctcacaagcaactccagactgagcttagttggaattcagtagcgcacaactgggatatccgcaccgtacggcttttaacaattttttaaattttggtcctctcagcatcacaaattcaccgtgtccaaaatacagtagaatgttgtttctacccacctacactctgccatccgctgaagtcctttccccttgctccaccactcaagccttgcctatcgcagtaaatggcagttctgtctctccagttgctcgcacataaaactaggctgctattttgatgtcttcacttttctctattctgtatctaattccttagcaatcctgtcagttctacctccaaactgtactcagcatattcactgctctaactccagcttaaatcaccatcatcctttgcctggaatgctgcatcaaccttctaatcactctactttcctcctcctccttcctccctttcttcttccttcgtataaatcatcatttcatccttctgcttaaaatcttctcacattttcttattacacttaaaacggcaaactcttacccttgagccctgcagaatttggctcccatcagtctctccgacttcaccttctgcctccttcacgctatagccatgctcacttttttattcctcaggcttaccaagctcaattgcatcttagagaatttgttcttgctgtttcttctgcctggaatacatgtttcccaatctttataagactatacttgtctgtaagtttcacctcagatgtcacatctaggagaggttttccttgaccactgtaagccaaagcaaatgttgatcattgagtgaataagggaatgaatgaatggagtggtatataatgtagcagagtagaaaatttaaggctaattctctatacatctccaagcaaatagatttgtaatgcttttcctgccaacaatctatacagctgattcacaaatacttggttgacaggttttatatatcattgtggctcatcagcttatatattgttggggccagaatctatacttacactttattcaaatttgattttacagaagagttgaggtttttatttttcttttaattaagagggctgtgaaattattatctataattctaaatctcatttaattcctcccaataggtttcaagctggattggaaccaaagttcacttctttaacgaaagtgctttatgactttaataaaacagtagagaatggtagaatccatggcagctctttacaaaaacttgtgatagaaagttttgatgatgagcagactttgcaacaactggaattgcaaaatgaagcaattttacagtgcttccagaatgcggttagtgaaagaaagatgaagatatcagtcttctcccagagagtgaagaacaggagcatgaagaggctggttcagaaacagaggctgatggccaggaggacttagaagatttagaggaggaggaggacgtgtcagatatgggtggtgacaa[187 bp omitted]gtggcaggtgcctgtagtcccagctactcgggaggctgaggcaggagaatgccatgaacccgggaggtggagcttgcagtgagcctagatcacgccactgcagtccagctgggcggcagagtgagagactgcatctcaaaaacaaaaacaacaattacttaactttaggatgctccaataatcaaaattgatagtggcttgtgaacagatagattacttgaatagaatagagcccagaaataaacccaaatgcttctgggggagtttggtacattataaacatgacattttaaatcaatgaggaaaagaaatcatttgcagctcaccccaccatacacagcaggaataggaagtcattggcagaataaaaagatggtaagaacagaacagaattgtagaacagtacatttctcgcttccccacttttcaaagtattttttgctttttcacaaatgtaagtgtaattttattttctaaatgtatactaattcttttcttctctttcttagatgaatgacaaaaattacatctttagaaaaagagttgttagaaaaaagccttggctgcatgtgggggaagtgacagcacagaagagaccagagaagagcctcctggaggagagcctgcactttgaccatgctgtccggatgggtgcagtgctcttttctgcaaagtgttcacttctctgctttttctgtggtcccatttcatagaaagatttggggtgatgtttctttccctcaacttttattttgaaaacttgcaaacacagaaaagttgataaaatcatacagtgaacatctgtatgctattcaactggattcactagttaatgttttgtcacacttgttttctgtcttctgcgtatggaagattgtatatgtgccctttttccccctgaatcatttcaaagtaagttggcagtatcagagcatttcactgttaagtactttcgcagatatcttctaggaaccaggacttctcctatataatcacaataccattaatccacccccaaaatttaacatcaatacactaatgatacctactgtatagattataatcagcttccttgcagcaatctgtttagaaggcttgcatcctgtcactgtccactgattaaattttgaactctaacttgaaaccctggtcatctcattgccttctttcttatacccattaagtcaaaaggagctctcattttatttcaacagaaaagagaatggaaaagaggggaagagtccctagtaccttggataaagtatgagcacttactaccatatgtattctagttctgtagttttcaaacttcagggagcatctcaaggcttattaaagcacagatagctgtccttccccactttctgattcaggaggtgtggggctggcccaggaatttgcatgtctaacaagttcccacgtgtttctgatgctgagggtgtaaggactacaatgcgtgaatccgtggtttagtggatccacctaatgaatacatgttgtatttcctttggcacccgtgattacagaggaaacacctttcaactggaaggtatcattaaacagaggataagagatcaggtcagtaagaattaaatttcacttaattgaaatgtcactcaaatgtttagaaataatatgacaggccaggcacagtggctcatgcctgtaatcccagcactttgggaggccaaggcagacggatcacttgaggtcaggagttcgagaccagcctgtccaagatggtaaaacttcctctctactaaaaatacaaaaattagctgggcatggtggtgcatgcctatagtcccaggtactcgggaggctgaggcaggggaatcgcttgatctcgggatatggaggttgcagtgagctgagatgcgccaccgcactccagcctgggcaacagagtgagactccatctcaacataaataaataaataaataaataaataaataaataaataaataagataaaaataaaaataaagggaagatggggcagctttgtgtattgcatgtcctgaaaatgggctgatttctctcaagaggcagggatttaagctctgtagcctatgtgggatacatacaggagaaaaaagaagaaaaagaaaagaaatgtaaatataaataaatgaaaataacacttttccatgattataaaggaaatcacattgtttttgtaataatttggatgacaaaatgtaaagaaaaatctttaattttgccactcaaaacattccggtttgttgcttttcacactttttatgctgtaaacattttaaaaagtagaatcacaatacatggtcttttgtcacttactatattttaagcatgtttctatggagaaatataccctggcatcatcactggatgtatgttaagtgagtcattgccaccccagaggtggatttccttctatatatattttaatggactcgagtcaggatttttgcactgaattcatagaagtagaatttctagaggaaagtaatataaaacagttttaggatttttaaaagaaatgttcaaatcatcctacaggaaaattggttgagtttatgctcccaccaacagggacagagctccaggttcccccttccatttgtcatcttcgctggtctttaagcagaaaatctcattgttttcattacctttctttgatttctagtgcttttgaatctttttcatttgctcattggccatttttattcttgtgggaagtgctggtttctccattgcccattttctgctgcaaatcattcatttttttttctgagtaattttaaagatttctttataggctaaggctacaaacctttaatctgtcattgaggttacaaagatcttctcccagtaagtaatttgtcacttcactttatttatttattttttgctagcaaagcaccaaagtcaaatttcacttaatttttatcctgctgaatgaacacattttaagttagtgattttagtggaaacaggagcaggacagaatgtaataattagatctcgctctgtcaccccaactggagtgcagtggcatgatcatagctactgcagcctcaaacttctgggctcaagtgattttcccacctcagcctcccaagtagctctaggactacaggtgtgtgccgccaagcccagctaatttttaaattttctttgtagagatatgaattcgctatgctgcccaggctggtctttaactcctgacttaccccaccttagcttgccaatatgctgggagtacgggcgtgaactactgctcccggccaagagcttactttggtttgctagcaaggttcttggtatctttttatatttgaggctttcgtgctagtgctgaagtattacactcaccatctgaggtttacaggacttttgttttaatattgaaccgagggaactgtttagttttgcatctttgcaggtatacaaaatgtgcctaccaggactctgctttatatccattgaaaagcaagaagtaatacagtaaaagtttgcctggctacaggctttggaagaatggagtattctggtttaattctattaacttggaaggatgaaggtggaaaaaattcaaaactttaatttcctgttgaatgcaatttgaaaatatagccaatgagtccacttttcttctctagtaagtttggacattcagatctacttggtcttttatcatagaactcctagtgcgcctgagtcttacgttgtgaaaatccttttctaaaactttagatgtaagaggatagaaatgatattggatgagatcaggctggatgagaactgatacctgtagatatattttttagatgaaatctctgattgccacacgttttcttattgaactcataaaaataaaacacactggctggagggtggaagtaggaaggagatttatgtcttttaattgcatgtcattgtttcatattgagacagaacatatagtatccctggctttggacctacagaaggaaacacatttttctacctgctgtatggcagaggttcctgagcacctggagggattattgcagcacggattgctgggccctactgcagagtttctgattcattcgtgtctagggtggggcctgagaatttacatttataagaagttcccaggtgctcctggtccggagactacatgtttgagagccacccttacatactaactgtaaattgtagaactctagaaaaaagcgtagtttggactgggagaagaagcacacaggtaatggagcaaatcatgaaaaagtcaacccttgatcccaggtaacaagcaatacacagtgacataacacaattcttggttttcatgattgcaagtcatagccaagtatcgagtgagaaattcagtttcattttcagggcttagaggccaggtgattctagaaaaatcggatttagtgattaactcatgagagtaggagttatttatgtcctttttctctcccccatcacttagcatttagccttactttagaagggtcctgtatttgctttaaccttgtaaagaactttgagtgcttattaaatggaaagccttgtgtgtgtgtgtgtgtgtgtgtgtgtgtgtgtctgtgcgtgtgtgtgtgtgtgtgtgtatttagagacagagtcacattctgtagcagcccaggctgaagtgcagtggcatgattttggctcactgcaacctctgcctcacaggttcaagggattctcctgcctcagcctcccaagtagctaggattacaggcacctgccaccatgcccagctacttttgtatttttagtagagacaggatttcatcatgttggccaggctggtcttgaactcctgaattcgggtgatccacccgccccagcctcccaaagtgctgggattacaggcatgagccatcacgcctggctcaaagctttgtatttttaaagatattagacatgtttcttgtttgtttgttttttttaaaaaaactaaacgctaatgtaggagaataagagaaagtttttccaaaaaagagaaaacattgtgattatcttattggaatgttggataataaagtctgctttatcaatcatcaagcacactataaaatttccattttaataggacttgtacctcaattgaggtaataaagttttaaagtttttaaagtgaaagccagccccgcccctctcctggagtgggcggggacagcggttgcataggcagctttccttgtgacaacacaggtccttgatgacacgctgctgtctggccacacctccttttcctttcatctttctcattgaccaatgggcttcaagcatgaaggccacacccctattctgcattctagtgcagccctggttacgcctcctctggctcagtcacacagcgacgtagaggtgactggaggtatatacttgtcctcacctggatcatgctgatgtggccccaaccccacctccctacccatccccacctccctacccatccccacctccctacccatccccacctccctacccatccccacctccctacccatccccacctccctacccatccccacctccctacccatcctatgatgtccaaagaaaccagacagagcaaattggccgaggccaaggaacaggtaaacgcaccaacaccccaacccaacccgaggccccctctgacagccgaactgctgccagagtctgtgccactcctgagggacaccaggctgggccccccaccccagtgcctctgggctccccacaccaaaatcttgtcagccagcccaaccccctcataagtcctgcccctgctctgcccggcacaccagggtgactttgagcaggtgactcctggggcttccaactccatactccgcccttacctcctgctaccccaaacccgacctccctgggctccttgagctcacatctccaaggacctgggtgccccagaacctgccctcaccagttgccacagggtgactttggggatgtgactcctggagctccttgctccttaattggccctcacctcctgccgccccaagcctgacctcccggggctctttggggtcacgtctccaaggacctggctcccaattttgtgaccccctccccagtctcaaagcggcaacttgggcattgcactcatgtgtcccccccaaccactccaccgaggagtagaatgtagtgatgtcacagtcccgctacaaactgtcattactaccacaagaccggcctttggtcttaggacccagtcccctaagtgttcttgcccacttctgtttcctctggttgcagcacaggtttccagctggaaggggaatggggactgtgggacctagaagagagaggtttcaggctgcctgacttccttaccacagaccttgacagtgtgaaaagcctacacctcccccatgagctcaacacgttgacagtgtctctgggtggcaatgggagaacgggtttggtttggttttctcccaggcttctactctccagagagattttaacattttttctcagttctgcacctcagatttgaattctccattgttctgggaccagagtgcccctcagtcactggttctggagtgagatctgcttatcttctgtggaacagatcttgggaaactgaacttagcttgagtcttcctcatctcatctcaacctggggtactttgagtgccacaggataaatatggggcatctttctgaagcatcagtttcccttgattctattgagaggcaaaacattaatgtacttagggatgaaagtcacgtagatttataagcgtatacaagacttctctctgaaatgaggcttgggttgtcctctttctgttaaattcccagatttagcagaaaggctgccttctgccatgaggagacattgatgtaaaggtttgagaggtactggtgtactttttaacactaacagacgtgtgagggtgaataaccctaaaccacatagtgcacagttcctgcctacttaatatttgcttttctacctctgcctctggttttggtccctggcagctgctgatttagggcaaaatcccagagctcagagtcagaagactgagtttaagttccattactgccttttttttcagccatggtatcaatctctctcagtcactaagtgattgtgacaacatttcctacagttggtggcattaaatcagatggtctataagagtatttagtataaactgtaaagcaggatgtgactgtaggagcttgtagttctcatgagtatcactgctcttcctttccacagttgacagaccatcatccccagaccaaccctagtgttggtacagcagcaagcgacaccaaaaagaagaaaataaataatggcactaaccctgagacaaccacttctggtggttgccactcgcctgaggatgtgagtcttggctggccgggctcctggggacagagggcccaaggggtggtggagggtaattgttaagattgtggaagaactgccaggtactggctaagaattctgggtttgaatcctacccctccatctgctagggacatgatttagcgcaaattgcttgagctctttgggcctctcttttcacatccgtaaaatacgagtggtattgttttccttacgtttgtgaagtttaaatgagatttgtcattgtgtttttatgttaatccctcgtccaggacctgctgtaaactctccttcttgggcttgcgtttcctgaggtagagttagagagtatcagaggtttctgttagctctgagagcccgagagttaaaggcccactagaatggaaacctcggggccaagggctcctgtctgccttttctgacctctattcccgctgtgaagaaccgtccctggcccgtatgtgctcaacgtttgctgagtgaatgcacctttctaaatcacaagctggcggaagggtgggcttttctcgcactccacctctgaaggtttctgttactgtcttttcaagagaatctagtttcagactttgagttctgtggctgtgggcaaaaaccaaaaagacccaaatccttcttctttgggagttgaggagagttgaccagttcatgttcccattgggtctgagaactgtgccttttaaatccattcctggcccctgcctatcgcttcctggcctggggaatagagtcaagggggccaccctcagtcaccttcctttgactctccccacagaaacaatagaaccgagctcagctggaagaagtagtgtgatttctttgctcacgacatgaccgctgggtttgggggcactcagatgtagaggccccagcctcatctcacccactcccagcctggggaagaaggctcacccccaagattccaccccatccccacagggtccctgataaactggtcccatgggtgggcctgttctggggcagtggtgccattctgggggcatgtctcttgctgtggatctctgcctccccctagtaagagctctgttttcctctttctataggaacagaaggcaagccaccaacatcaggaagccctaaggagggagctagaggtgagtggagggtgtgaagttccctcctgccctctggagaatgtttctttgcttctctttcagcatttgcttgtcttttctcccaaaggcccaggttcataccatacgaatccttacatgtcagaaaactgagcttcagatggcactctactacagccagcatgctgtcaagcagttggaaggtgggaatctggcaccccatcatccttcaacctggcactttgacaggcctttagggggagtcctttgggccacatctgaatgtctctcattccaggagaggccagggatctgatcagccgcctgcatgattcatggaagtttgcaggagagttagagcaggctctctctgctgtcgctacacagaagaagaaggcggatagggtgagtccaaacacggccccgtcccttgggagcccagcttcgcagatggaggagtgagcctaaaggtcccttctgtaggatggagtgtcctgcccagaaggcagcatggccatttcttgctgcttttgtgtgtggttgttagaggcagactggggctgagtcggctgttgtgggtgagttggggagcactgtgaggagcgagcactggacatagagctcagaggccaagtgcccgccctgcccatatttggctgtggccttggccaagtcctaagtggcggttagggtacttgtaccataaaggtacagaagagtatcttgagtatgttattatttgtgtggagagagggggcaggtgtatatgtgtgtgtgtgtacgtattatggtaacatacataaaacacgtttgtaaggattcattaaaaaactcaggatagaggcacagtgttggggggagatatttcccttctggactttctgagttttggactatgcgaacgtatcatcctttcaaaaattcaacaaaggattaatttcctccttcttaactgtgcccctacctccagcggaagaatgggcttagagaatcagatatacctgggtgttgaaatcccagctccaagtgatcttaggcagcacttaacctttaataccgcatgtttttcatctacacaatagaggtaataatggtaaccgtctcctatggaggttgtgaggattaaatgggattgttagcatagtgcctggtgaagcactcaagaaaggttcgaacaatggtagtactaacagtaataacaataacaatattatctgatcgctctgggcccctgttagccagctctaaattcaatctctttccctgtcccttccacatccactgagttctttgaaaaacaaatgagggccaggtgctctcgctcacgcctgtaatgccagcactttgggaggctgaggtgggcggatcacctgcggtcaggagttcaagactagactgaccaacacgaagaaaccccgtctctactaaaaatacaaaattagcccggtgtggtggcacatgcctgtaatcccaactactcgggaagctgaggcaggagaattgcttgaacccaggaggtgtaggttgtggtgagctgagattgtgccattgcactccagtgagggcaacaagaatgaaactctgccaaaaaaaaaaaaaaaaagaaagaaagaaagaaagaaaaacaaatgagaccatgggcttggaaatgccttgagaacacgtcaggtgtgattgagagtgaggaagtgttactgtggagtagtcactgtagcagttgttcctggtcgtccagctactgctgtgcctgctctatcctgacttaacctttctctatttgcagtacattgaggagttaacaaaggagagggacgccctgagtctggaactgtacaggaacacgtaggatgggggaaggtggaatgggaggtctgggggcccttagcatgggtggtgtgctgggaggtggggggtccaggtgagtgtggggagaggctcatacatgttttcatgtgtgcacacggaagctctagtgctggctgtgccactgactcatggggtagcctcaggcaactcatgtcttctctctggcctgccacctgggacttttaattcctggggtcccttccagcgccacggttctgtggttgtggggcgagggtagggggtcaatcaccaaagtggtcttttatgttcttcattcattcctttctctactgcctctggccatagcataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacaggtgagcagctgcagccccgggggttgtgggagacccatccagctgggaccatggtctagggatcatgcagggtatggggaggctccagccaagagctggaaaatttgggtccttgttctggtcccgccatagaatcctctagagtgtactaaaaatgtacaaattggggccctgcctggggaatcagaatctcaagagttagggcttaaaaatatttttttaaaggatcatggatgaaaaccattattttatagattacatttatttatttatttatttatttatttatttatttatttgagaagtagtctcactctgtcacccaggccagagtgcagtggcgcaatctcggctcactgcaagctccaccccccggcttcacgccattctcctgcctc[225 bp omitted]tctgaggttcaaaaaaacactttcactattccagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagtgggaggagaagatacaggagcaggaggagaagatacgggagcaggaggagaagatacgggagcaggaggagaagatgcggaggcaggaggagatgatgtgggagaaggaggagaagatgcggaggcaggaggagatgatgtgggagaaggaggagaagatgcggaggctggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggagaaaaagatgtggaggcaggaggagaagattcacgagcaggagaagatacgggaggaggagaagaggcaggagcaggaggagatgtggaggcaggaggagaagataagggagcaggaggagatatggaggcaaaaggagaagatgcacgagcaggagaagatacggaagcaggaggagaaggtgtggaggcaggaggagaagatgcacgaccaggaggagaagatacgggagcaggaggagaagatgtggaggcaggaggagaagataagggagcaggaggagaagatacgggagcaggaggagaagatacgagagcaggaggagatgatgcaggaacaggaagagaagatgggggagcaggaagagaagatgcaagaacaggagaagatgcggaggcaggaggagaagataagggagcaggaggagaagatacgggagcagaaggagaagatacgagagcaggaggagaagatatgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacaccaggtgaggctgcaggagctggaggagaggctggggaagctggggcagaaggccgagctcttggggggagcaggcggaggtgtgtgcaaaccctggagatcatacagaacgacctcaccacaacttagcagatggtggttggctccctctgcttttccaccagtctgtggcctacagtttaaatggtgggaagaagggtgtgagatttgaggctggggagggaggcatgggcctctaggcaagggaggcagtcatttaggcctggaggaaggggccagggccaggggcctgggtaggcgacagagccccgcagtgccctcactaccctgtttatgggcccagaatctggaagccagccactacctaccctgacgcctatcctgcaggtggagctgaagagccaagaggctgagtctgcagcagcagcgagaccattacctgggtcacctgcagcagtacgtggccgcctatcagcagctggcctctgagaaggaggcactgcccagctgcagcagcaggaagctcagggcgaagcggtggccgagatggcccaccaatagttgcaggagacccggttgagggagttgatgagggcggggccccaagggggatgatctggcaacctccgtgccttctcactctctttcctggccccttaggagcacctggaagctgccatctaatgagcacatgacaagaaggcaaagacaataaacatgtaaaagccggcagcaaggcctggagaagagtaagccgccatgtgactgtttagaatatagtctgagcacaaacctgaaaaaaaaattttatttattttaaattgtggcaaaatactggccaggcatggtagctcacgcctgtaatcctagcaatttgggaggccgaggtaaatggatgacctgaggtcaagagttcaagaccagcctggccaatacaaaaattagccgggcatggtggcgcatgcctgtaatcccagctacttgggaggctgaggcaggagaatcgcttgaacctgggaggcagaggttgcagtgagctgagatcgtgccactgcactcaagcctgggtgacagagcgaaactccgtctcaaaaaaaaaagtttcttccttacatgtatgtttctattagttttcttcttggtctttctcatttagtcttgtgttgtcttttgacattcatagtaaacttttatctgcctccagagagtattgactttgagtttatggcacacaattggagtaagggcagatcgccttcatctactttgggactaagctggttcaaagcaggttttaggttttctgatggctggtctatgttttattcatttggactcccaggggtggcccttccagggtccccaccaaggtcccatctccttcctgggacccaaattctcattaggtcatttcagccctgtgagagtgccaaacattcagctaggctctccagcctcttaactaccacttcatactcagtttcttagcctcttagccctctactgttgaccaatcaccaaatgtgggaaagcactacagactgtcaggatcacctcctaggcctggtcactcaagtcctgactgaggtctccaattaccttccaacaattgtttttgattgggggcggggcacatttttatccagtttttctaactgctcttgtggggaggcgaatctgtaacaagctcctctgcctttactgaaagttgaaaaccttcatctgtcctttttttgttgttgttgagatggagtcttgcgctgttgcccaggctctagtgcaatggcacgatctctgctcactgtaacctctgcctcctgggttcaagcaattctcctgcctcagcttcccgcgtagcgtgtgccaccatgcctggctaatttttttttatacctttaatagaggcaggatgtcaccatgttttccaggctggtctcgagctcctgactcaggtgatctacctgcctcagcctcccaaagtgctgggattacaagtatgagccactgcatccggcccatctgtcttttaaaacatgtttttaattggaggtataatttctattagtgaaatgcacaggtctggtttacattttgatgagttttaactcatttaacattactatggaacccacctcctttgaagatacagagtatttctatcatccagaaagttctcctgtgctttcatgctgtcccgcactcccccagcagctgatgaacatgctgaggacattggtactggattctggccgccccaaaagagccgctttgaccaggcttacccagcactaaatccctgcctgctctctcaaaatttccatctttaaactggttgtacctataaccctccctcatcaagtcaatagataaacaaaccctgaaaaataaacaactcttcctggcccagcagcccacagcctaatatttactgtattcccaggctttcagaaatgtaactcgcctgccggttcaccctcactagggcggcagctgcacgggagcagctgggctcacccattaagcaagaagccaatagctggacagtgacactcagaccccagcctgggcgagcctggctgaaagcccccttctttccatccgactgtggagaaagggggcggagcacacacaactctactgccctccacatccttcacctgtgcttcctcctgggagagggagccgctccttaatttggccaaagccttcttgagggctgtaggtttcacaggctgggtgtgtgggggccaccgtgctagagacagaggctggtgtgtcagaaggcagccacctggccagaggggggtcaacccccttggtgacctccttcccccggctggacacagtgccctgcactctctacatgtgactgttcccctcagagctgcttccaggggaggggttctaatcctgtgggtggggacattgtgttactttacagtgggccatggctccctctgacatctccaactcagaggcagtagagagaagatgagaaattccctgcccctcctccctcagcacccccacctctgcacacgtccacatgtggagaccctgacaatgggccctgggagtgccgccatctgtgcctgctttccatgcctgcagcagccatgcccactctccagaccctcacccgcctgggtcagtagacgcttcactgcctgtggtcctgcgcctacacctgggcctctgtacccgtcagttcccccagtctggttcttattccctgcaaagagtagggagcctgtaaggtcacctgttgagcaagctgggggagaaaagtagggtggggatgggaggatcaggatgagaagctcatggtcgtgctggagactcagctgagcagagtctctgcaggcccattggctgcctagccagtggtgatctcgctcccaccctcatttcttctttgttaacaaaaccatgacctcattaaatactggacacctataaacctcatggaccctcctccagcctccccaccgtgtaccggtgagtctaagtcaactctagtcatttcattcctctggacattgactgcttagggcttgggcatgagctgcctcttcacctgagcctgagccacaggtaccctctgcacctaccacgctgatgcactgggccagggagagcgccgtctggatggagatgagctgtgaggagctggtggctgggcggatcaggttgttgtaacaggttttgttcagaaggtcgtccatcagtttctgctcggcatgggccatgcggcagtcccctgggtaaacacacagacatgctgggcccttgtgcagctgtctcccactgcagctgacagctatgaagcaggagctgagagggccagggagcacagacaccctgagagctggctgaagcagtgaaggggctggccggcctggctctccctggggacttcaaatgacattcacgacagagctcagctacctcctccccatgccatacctcttcctcctcctcctccctccgtcaatgaacagcatcccacgctctacacatctgatacaaaactgggtgtctcttcctgactcctcccttggttcacccaagtggccaccaagtcctgtctgtcctcccatctccacggctacagccatgtccctgcctcccctgccctgcccaccttctattctctccacctgcactctgcccctgccatccatgtgccatacagtggcagactgatctttctacagcaaactggacgagggcccttccctacccacagctctcagagctggaggtggagttgaagctcatgttttggcttggcattcagagctctttccccctcagcactggcttatccagagtgctcacagtgcagggcaggagcctcgtgactcaaatgtgggtttggtgcagaactgggtctgaggtggtgctttccctgtgaagagacagggccgacatgggggaattttctgggttcaaagttagacctagagagtgcaaagtttctctgaggcaccaaatggaggggtccagctagcagctggctcctggtctggagcttcaaggagaggtctcagctcagagccacattcaatagccagcttacatgtggcctcctgcagggagcccctggagcttccacagcctccgttctgcccctctgcataccccagatctcctgctaagtggcgtttgggtcttcatgtcatctccctcccatgtctgggagtaaaggtgaggtgcagggacttgcgcttgtgtactctggtgtcttaagggagagtgtgtcaagtagagtggaggcggcttggaaagagggagactcagaggagagtgaaggacacatgaccaggcgagcctgggagcaggaaaagagagtgagcagaggcaactgctgggtcaggggagcggatgggaggatcagggaatgcgggggggctggagaggtaggggtggggacgttggcgaggggctgcctggctcgccaggctcaggagtcagttacatcctcccacaagggccagctcacctggtcgccccaaagacctccctctgtgggtgggatcagagggccaagagcacggataacccaattgagcaggactgaggcggactcaggtgggtgctgggccggactcctggctgtggggagcagccgccaccctgcctattgcatccactttccaactcgctgcctatctgagcagatgcgatattgggcaccttgtgaaacatgctcctggtgcacctgctgcctgctgcccctcctgcagagtgcccgggctctccagaggggattcctatggaggcttggcctagattctgagtcctgcctctcatacctggggctgctaccccagaggccagctgcttgagtaccccggaagccagcctgtagccccaggctacagctgggtccatcccacagcccttctctaatgtacctatttggactggctgctcatttcatagagaggggtgtgtcttgccccagaccatctggcatgtctaaggcagctgtggggtcagaatctgcagctcccagccctcagcccagcaatagtaggaaaggctggaccccacatctctgaagtcccgctgggttggtgcgagcgggctcccgagtacagggctgctctgcaggctgtggggctcatgcgccagctctgagcccacctgatgtgctcacgttgctcacctttgggcctgtccggcctctcaggcattcggctgaccctgagggcctctccctcatcttgaccaccagctacgggctctgatttctcagggatctagaactacaaataccatttgacccagccatcccattactgggtatatacccaaaggattataaatcgtgctgctataaagacacatgcacacgtatgtttattgcggcactattcacaatagcaaagacttggacccaatccaaatgtccaacaatgatagactggattaagaaaatgtggcacacatacaccatggaatactatgcagccataaaaaaggatgagttcatgtcctttgtagggacatggatgaagctggaaaccaccattctcagcaaactatcgcagggaaaaaaaaaacaaacaccgcatgttctctctcataggtgggaattcaacaatgagaacacatggacacaggaaggggaacatcacacaccggggactgttgtggtgttgggggaggggggagggatagcattaggagatatacccaatgctaaatgacccgttaatgggtgcagcacaccaacatggcacatgtatacatatgtaacaaacctgcacgttgtgcacatgtaccctaaaacctaaagcataataataaaaaataaaaatataataaaaacaaaagtcctgtgaacctcagatggtgagtataatacttcagcactagcacaaaagcctcaaatataaaaagataccaagaacaccactagcaaacaaaagtaagctctcagtcacgagcagtagttcacacctgtactcccagcatattggcaagccaaggtggagtaagttaggagttcaagaccagcctgggcagcatagcgaattcacagctctacaaaaaaaaattaaacattagctgggcatggcgtcacacacctgtagtcctagctacttgggagactgaggtgggaaaatcacttgagcccagaagtttgaggctgcagtagctatgatcatgccactccactccagttggggtgacagagcaagatctagatattacattctgtcctgctcctctttccagtaaaatcattaagttaaaatgttttcattcagcaacataaaaattaagtgaaatgtgactttggtgcttggctagcaaaatataaataaataaagcgaaatgacaaattacttatgaggagaaagtctttgtaacctcaatgacattaaaggtttgtatccttagcctataaagaaaaatttaaaattactcagaaaaaaaaaatgaatgatttccagcagaaaatgggcagtagagaaaccggcacttcccacaagaataaaaatagccaatgagcatatgaaaaagattcaaaagcactagaaatcaaagaaatataatgaaaacaatgagattttctgcttaaagaccagcgaagatgacaaatggaagggggaacctggagctctgtccctgttggtgggagtataaactcaaccaattttcctataggatgatttgaacatttcttttaaaaatcctaaaactgttttatattactttcctctagaaattctacttgtatgaattcagtgcaaaaatcctgactcgagttcattaaaatatatatagaaggaaatccacctctggggtggcaatgattcacttaacatacatccagctattgaaagtgatgatgccaggatatatttctgccatagaaacatgcttaaaatatagtaagtgacaaaagaccatatattatgattctactttttaaaatgtttatatgcataaaaagtgtaaaaagcaacaaaccaaaatgttttcagtggcaaaattaaagatttttctttatattttgtcatctaaattattacaaaaagagtgatttcctttataatcggggagaagtgttattttcatttatttatatttacatttcttttctttttcttcttttttctactccatgtattccatgtaggctagagagcttaaatccctgcctcttgagagaaatcagcccattttcgggacatgcagtacacaaagctgccccatcttccctttatttttatttttatcttatttatttatttatttatttatttatttatttatttatttattttgagatggagtctcactctgttacccaggctggagtgcagtggtgcatctcagctcactgcaacctccatctcccgagatcaagcgattcccctgcctcagcctcccaagtagctgggactataggcatgcaccaccatgcccagctaatttttgtatttttagtagagaggaggttttaccatcttggacagcctggtcttgaactcccgacctcaagtgatccatccgccttggcctcccaaagtgctgggattacaggcatgagccaccgtgccaggcctatcatattatttctaaaaatttcagtgacatttcaattaagtgaaatttaattcttactgtcctgatctcttatcctctgcttaatgatatcttccagttgaaaggtgtttcctctgtaatcacaggtgctaaaggaaatacaacatgtattcattaggtggatatccactaaaccacggattcacgcattgtagtccttagaccctcagcatcagaaacacgtgggaacttgttagacatgcaaattcctgggccagccccacacctcctgaatcagaaagtggggaagaaggacaactatctgtgctttaataagccttgaaatgctccctgaagtttgaaaactacagaactagaatacatatggtagtaagtgctcatactttatccaaggtacctacggactcttcccctcttttccattctgttttccattgaaataaaatgagagctccttttgacttaatgggtataagaaagaaggcaatgagatgaccagggtttcaagttagagttcaaaatttaatcagtggacagtgacaggatgcaagccttctaaacagattctgcaaggaagctgattataatctatacagtaggtatcattagtgtattgatgttaaatttttggggtggattaacggtattgtgattatataggagaatgtcctggttcctagaagatatctgtgaaagtacttaacagtgaaatgccacgatactggtaacttactttgaaatgattcagggggaaaaagggcacatatacaatcttccatatgcggaggagagaaaacaagtatgacaaaaccttaattggtgaatccagttgaatagcataccgatgttcactgtattattttatcaacttttctgtgtttgcaagttttaaaataaaaagttgagggaaaagaaacatcaccccaaatctttctatgaaatggaaccatagaaaaagcatagaaatgaacactctgcagaagagggcaccgtacccatccggacagcatggtcaaagcgtaggctctcctccaggaggctcttctctggtctcttctgtgctgtcacttcccctacatgcagccaaggcttttttctaacaactctttttctaaaggtgtaatttttttcattcatctaagaaagagacaaaacaattagtatacatttagaaaataaaattacacttatacttgtgtaaaagcaaaaaatactttgaaaagtggggaaggaagaaacgtactgttctataattctgttctgttcttaccatctttttattctgccaatgacttcctattcctgctgcgtatggtagggtgagctgcaaatgatttcttttcctcattgatttaaaatgtcatgtttataatatactaaactcccccagaagcatttgggtttatttctgggctctattctattcaagtgatctatctgttcaagtgatctatctgttcacaagccactatcaattttgattattagagcatcgtaaagttaagttaaataataataattattattattattttgagatggagtctctcgctctgttgcccagtctggagtgcagtggcgtggtctcggctcactgcaagctccacctcctgggttcatgccattctcctgcctcggcctcccaagtagctgggactacaggagcccgccaccatgcccggctaattttttgtatttttagtagagacagtggtttcaccatgttagccaggatggtctcaatctcctgaccttgtcatccatccaccttggcctcccaaagtgctgggattacaggcatgagccactacactcagccaagtaattatttgattaggatattagtatttgatggagactgacccttttgactctaaactcaaattcttattatctctaacttctaaaagacagcaattatgacttcagtgtataaaatgccagctttttcagctaccttacagaattctcttattttcctatatcaattcagtttatccatttggtcttctctccaaacactcatgtttttattttagtatccttaatctttttttttttttttgagacagagtcttgctctgttgcccaggctggagtacagttggatgacctcagctcattgcaacccctctgcctcccaggctcaagcagtcctctcacctcagactcccaagtagatgggatcacaggtgcatgtaaccacgcccagctaattttgtattttttgcagagatgaggtctcaccatgttgcccaggctggtctcaaactcctgagctcaagtgctgggagctcctgaactcccaaagtgctgggattacaggtgtgaaccactgctcccagcagttttcctaatctcttatctttatcacactatgaccacgtgagattactccaggtatgcaaatgctgtagaatttgaaaaacaattaatgcaatgtattatagcaacagctacaaaaatcataatgtcatattaattgatagagaaaaagcatttgacaaaatccaatacccattcatgatgaaagaaaaaaaaactctaagaaaattggagataaagaataggaatcagagtgaccttcctccactgataaagaacatctacaaaaaatctagagttaacattatccttaacatggaagcctaaaaatgctttccctacaaggccagaaacaaagcaagaacatctgctctcactgctcttattcaacatagtactggaaattctagatactaaaataaggcaataaaaataaagggcacacaaacaagagagaaaaaaatacaactgtccacatttacagatgacatgattggctatatagaaaatctcctggaacctgcaaaaaaaacaaaaacaaaaacaaaaaacaacaacaacaaaaaacacctagaattgataagtgagtttagtaaggttgtagaagataaaatcaagaaacacaaaaatcacatcagttaaatgtggaaactgaaattaatgatgcaataccatttacaattgctcccctccaaaaagaaatactaggtatatacttaacaaaacattatgaaattatagaatgctaatgaaagaaggtttttaaaaaagctaaataaatggagggagacaccacgtttaaggatcagtagaccatacagtaaatatatcaactatccctgtactgatgcattagtttaatgcaagcccagcaaggttttggaaaatatgaacaagctcattccaaaacttatctggaaaagcatataggtcccagaacagctaaaacaatcttaacaaagaagaataaaaggagaggactcactctgtccaatattaagccttattatgatcaagtagtcttaattacagtaatcaacacaatgttgtattgataaagggacagacacacagatcaatggaaaagtttagagaacccataagtagccccacacatgtatgtccaaatgatttttgacaagacacaaaagtaattcaacgcaggaaagatagccttttcaacaagtaacaccagagcaattaaatatccacaggcaaaaaccaaaaccaaaagaaaacctctaactaaaccttatattttatatggaaattaactcaaaatggatcacaaacttaaatataaacatataaccatggaatactatgcagccataaaaaatgatgagttcatgtcctctgtagggacattgatgaagctggaaaccatcattctcagcaaactatcgcaaggacaaaaaaccaaacaccacatattctcactcataggtaggaattcaacaatgagaacacatggacacaggaaggggaacatcacacaccggggcctgttgtggggtggggggaggggggagggatagcattaagagatatacctaatgttaaatgacaagttaatgggtgcagcacaccaacatggcacatgtatacatatgtaacaaacctgcacgttgtgcacatgtaccctaaaacttaaagtataatttttaaaaaagtgtataaccataaaaaatattttttaaaacaagagagaaaatctttggactctagacagggttcttatacttgacatcaaaaatacaaaccatcaaaggaaaaactgataaagtgaacccattaaaattcaaaactttggttctgtaaaatatcctgttaagaaaagatgacaagctacacacagagagaaaaaatttgcaaaccatatatctgacagtgggctcatgtctaaaatatataaagaactctcaaaattccacttttggccagtagaagctccttcacattggctcctgcattctttttaacatgaccttagaagtctctgataacttccttgctttcaggaaagacatgtcccagcctcaatttgttcatttctggcctaaatgtaaagctgtgccagagacttggaacctatttatacaacagaccatgatttgagtagaaaatggtacttagaaattaaaacttgaatactagcttcttagtgttataaactgaattctgttcccctcaaaattcacatgttgaagccctaatcctcaatgtgactatatttgaagataggtatgtatttggagatagggctgtatttggagatttaagggggtaattaaggctaaatgaggtcatatgggggatgtctaatccagaagacagccctctatgtaagccaagaagaaagacctcaccagaaaccaaacctgccgggaccttgatcttggatctgtagccgatgaactgtgagaaaataaatttatgttgtttaagttgcctgatctgtggtactctcttatgacagcccaagcaaactaatacacatagataaaactatgaaatatataatttccttaaaaagatggaaaaataaatgagtttatcctaacacttttgagtcaaattaaagaagagagaattttacttaattatatttttctaattgtacatttaattttacactaataatattggttattattggagttagcataattattagtttcttcaccatatatatagagaccatatacatatagatatatagatatatatataaacacaccagagagacatatatataccatagaggccacatatatatatacacacacacacatacaccatatatagagagagcatatatatacacacacacaccatagagcatatatatatatatacatgaaatatataatttccttaaaaagatagaaaaataaatgagtttatcctaacacttttgagtcaaattaaagatgagagaattttacttaattatatttttataattgtacatttaattttacactaatactggttattattggaattagcatgattattagttttctcaccatatatagagagagaccatatatatatatatagatatatatacaaacacaccatagagacatatatataccatacaggccacatatatatatatacacacacacatacaccatatatagagagagcatatatatacacacacaccatagagagcatatatacacacacacacagaaacacacaccatatatatatatatatatatataaaatagtttcaaatggcaatacatatattaacactgacaaccagaacactgaatgcagtttaaggtttcttaatgggattaaaatatattatattatgattaagatatattatgatagaaatattctgccataatactgtaatttaaaagcattcgctttaaacatctcttctctggggaatcataccacaaacttgacacacagattgctttcaatttttaaagaccactttatttttatcatttttatttttaacattatataaaacatttgcctggttcttaagtctagaccataaagcaggtacattcagagaagcatagctcattcctggccctgcaccttccttattctgtttctaatcctgtaaactatcactctttttaatttatttaactttccattctgtcttttgtaaaatattagtaaaggcacatatcttctctgttttcaccccctttcttagacaaaaggtattaatagtatgctatgaataactgttctacatctgactcttatcaggagaataatgtcttgtagatgactccatggctgtgtacagacatcttccttgtgcctttccacaactgtgtagccctccattctggggactgtgatggttggcagaatgctaaagatccccctgcccccaaagccccaccatcctggccattcaaacaccaatctagatacttccgctggtccccaacttacattaattcaacttgcaattttatgatattttagtttgcgatggtacaaaaacaatattcagtagaaaccatatatggaatactcgtacaaccattctggttttcactttcagggtggtattcaataaattacatgagatattccacactttattataaaaacaggctttgtgggcagggtgcagtggctcacacctgtaatcccagcactttgggaggccaaggcaggtggatcacttgaggtcaggagtttgagatcagcctggccaacatggtgaaaccccatctctactaaaaatacaaacagtagtcaggcatggcagcacacacctgtaatcccagctactcgggaagctgaggcaggagaatcacttgaatctgggagacagaggctgcagtgagccaagatcacgccactgcactccagcctgcacgacaaagcgagactccatctcaaaaaaaaaaaagttggctttgcattagatgattttgcccaactataggctaatgtaagtgttctgagcacatgtaaggtaggttgggctaagctatgatgttcagtaggttagaggtattaaatgcatttttgacatgatattttcaacttacgatgggtttactgaaatgcaacttcactgtaaatcaaggagcatctgtattgggaagtgagtttgaagacataattaaagtcccaattccattaatcttaagatagattatccactttgggaggcc[134 bp omitted]gaggc[138 bp omitted]gcctaagctaatcaagtgagacatttaaaactcattttctctgactgatggcagaggaaggaagtcaaagatgtttgaagcatgaggggaatgagtccctgcttctcaggacatgagaagcaatcttgctggccaccaagagaaagtaaacaggtatgcagtaaactgtcaacgaagaaaaaggacagattcctgaagctgagagtgaaccccagccaaatatcagcaagaaagtgaggatgtcaaagactgcaagaaaatgaattctgtcaagaatcagcgagcttggaagagaacctcaagcctcaaatgagaatctcagcaccagccaacaccttgacatcaagtatgtgagttgtgagcagaggattcagttataacaagcccagactcctgacccatggaaactgtcagattaataaacaagcactgccttaaatcacggagtccgtggtaattttcagcttccaaaacacaaagacaaggtaacaacattcatctgctttagccatctttccctttgcttctgcccttgtggtttcacgtcttttaattcttttattctcatttgagtacagtatcagaaaagagcatgttcaaccagaagatgaccgctatgatttcctcgactggaaatcctcctccatctgttctttactcctcctaaaattcttagcacttggcatgtgaggtctcctggatctccactcgtactttcttattgtttcctctcaagtttccatgtctttgtcatcagctctgaatggttcaatgtgccctttcatactgcctttcaaagcaccaatgctatccccagcagaggccattctcttcagttttagactttcagaaacaaacaaacaaacaaacaaacaaacaaacaaaaaagccactgccttctccatagagttttcgatatttgttaaaattcttttctgtctcttccatttgttttgcctccataagaaatgcctgatctggccgcgtgtggcagctcatgcctgtaatcccagcactttgggaggtcaaggcaggcggatcatcaaggtcaggagtttgagaccagcctggccaacatggtgaaaccctgtctctactaaaaatacaaaaattagctgggcgtggtggtgagcagctgtagtctcagctattcaggaggctgaagcagaagaatcactcaaacccaggaggcagaggttgcagtgagccgagatcaggccactgtactccagcctgggtcacacagtgagacttggtctcaaaaaaaaaaaaaaaaaaaatgcctggtgtgcctgttctttctctttcaagtactatgtttccctaactgggctgggacaaatctctgcctactgacttcttaagctactcagcacccaatcaggacaggtgtggcaaagaagcaggtagtaagagggagctgttcttttcaagggcaggaaggtgatgtggtctttctcgaaccttacagacggggacagattggcccaccatttcagttctgctcaagatctcctgggaataagactgcaagcccaaaccaccacatgtagaaagcatctgcattttagaccctacagaagcaccaagttctactattcatgctgagcttaggaacccaaggacaggggcaccatctctgccacacagtgcaggagaaatggagcctaccttacctccccagcaaggctaaggtcatctgccagaccctctctctacaatcaccctgcttgttgtgttgctccagagagtgagaagagtggaggtcagtgtcaggggcatgccttcaaaccaccacgttcccaccactgctccagcttctaaacattcattcagagacaagtcacagcaatttccagggaggagggatcacatatgtcatacccaagctctgaaggtgtaagtggtttagttgcttccagttaaagagtttctgaagttgaggttacgggtattttagataacgtcatcagggtggctctcagaagaagtaacccttggacagagacttgaatgatctgaggaagccagccatgcaagcatctgaaagaagagatcataggcacaggaaacagcaaccaagaaaagccctgaggtgagcacaacaggcttagtgcattcaaaaagcaacaggcaagccatggggctggaatggagtgtgcccaaagaagacaagggctaacacaagggcaagaattagacaaggcaggacaggcaggacatggtgaggggcaggggtattatttcagagtgactgcatgttactggaggagtccgagaagggaagaaacaaaagctgattcacggtatgtaggtactctaagctgctatatagaaaccagactgtgagtacaagaaatgatgtaggagcatccattgaaaaagttttttacttgttctttctcttttattgttttattttctccttttttttctcttttcttgccctaactctatatggtagaactgttgagaaacaatattagttgttctagtgaaaaatgacagtaaatgcaaagacagatcagaggtagcgaagccagtggtgaggccattaaaaataaatagacaagagtgacttccacttctggccataatagactaacagaaacaggattcgccctcccatctaaaacaaccaaaaaatagacaaaatacatgaaacatcaaacttcaagacactggacaaggaaaaatagtgatccctaaatgatgagaaacaaggaggtttgttaggaaattccacacccctcaattggaagtgattgatctataatgtaatgacatcctgaaacacagaaatcaagagaagaatctaatagaattctacaaatgccttcccagtgacaaatatgctcaattaaaatcatatgctcatgagttgatattgttatttggcagtatctacctgtgtgaagacattttcaaagacaaaacacattaaatcacattaaaaatcagcactaagagaacatttgccattgatttaatgataaagacactaactttgatgcccaattaagcaaaatgtcatctcccccttcccctgaaaaaattctcttctcattaacagacctgtattacaaaagaaaaatttcattcaattatgattggtatatttttatgtcaataaaaaacatggtctgggcatggtggctcatgcctataatcctagcactttaggaagctgaggcaagagaatcactcaagcctaggagttcaagaccagcatggacaacacagtgagaccctgtctccatcaaaatattttaaaaattatctgggcatgatgatatgcacctgtagtgccagctactctgggagctgaggcgagaggatcgcttgagcctggtgtggggctcaaggctccagtgagctgtgattacaccactgcactccagcccgggcaacagagtaagaccctgtctccaaaagtacacatggaaatttgtgtccttgtttgttatataggaaggtatataataggcccaattttgcctcttgacctacaaagcctaccctctcactgttaccaggaaaaaaaaaaaattgtcaacccctaatctagatcaatctcagcaataccaggctctgctcagtactctagaacaagtaaaaatctggatctagaaacaggcattaaaccaaattgccagggcttctctgggcttcaatacagcatggatgagatggttcagaagatgttaatcagaaagcaccagaacatgaagaaaacttgaggagcatctagaatagctcctccttttagaggaaagagttacaagccaggagaaagacctgcccttcctaggaccagtccataaactcttgccccctgccctgctcctccttctgagccttcagctacttattccagaatcttacaataagcaaaattacaaccaaaccactggtccaatattgactcccaaaggtacaaaccagaaccttctcaacaccctgctttggactgttctcagatctagggctgtattagctcattctcacactgctatgaagacatatctgagactgggtaatttataaaggaaagaggtttaattgatccacattgctggggaggcctcaggaaacttacaatgacggcagaaggtaaaggaaaaacaggcaccttcttcacagccggcaggatagagtgaatgccagcaggggaaacgccagctccttataaaaatcagatgtggtgagactcactcataatcacaagaacagaatgcggaaaaccactcccatgatccaatgaccctcacttggtcccacccttgacacatggggattatggggattataattcaaagtgagattcaggtggggacaaacagccaaatcatatcaaggacacaccaggcatttctcaccctgctacagtttcagaggtcttctcggggtcctcagtacttccaaactgagattacagaagaaatattaagcccctggaaaaactcttaaaaaatatataccagatacacagaagccaaaaaataccctaaaactactaatacaagaggcactaaattgaagctactgaagaaaacatcagagaaaatcttaccttgcttggcaattgaacagcaacatttcacggttataaatcaaaatatatagaagaaccaggaaggcttttgctctaacgtatgctgagaggctgtcaagtaaatggataactgtggagacaaaatcttgtggaagacatttaaaaaattttttgagagaacataaaaaaatagggcagtctcaattctcagggtgaacagcctataataatcaagcagatggcaggaagtaaaataatatcaactactgttttcgcattctcaatttgtgccagatcccataactaaattttaatattatctcatttaaatctgaaagtcataaaaagttgacaatattggccgggcatggtggctcacacctgtaatccaagcactttgggaggcca[134 bp omitted]aggcagaagaatggcatgaacccaggaggcagagcttgcagtgagccgagattgcgctactgaactccagcctaggcgactgagcaagactccatctcaaaaaaaaaaaaaaaaagttgacaatattgtccccacttgaaagagaaaaatgaatattgaaaagttaagcaattacccaaattcagataataagcaatttacccaaattcagataaaattcaactggccttgtataaaatccacgccagttgaatgacaaagcctgcctgttcactactcaatcacacaactggaaatgtggcagcaaataatacaactgtcagtcacaactgcatgtagatataaatctctgagaagagctgcatacagagagatcatatctctggtctacacatctgagggcttaacagaaaatgaagacaatactcaatacatgacacaaagaaacatatactcctataccactcttcaattaaaggtataattcaacacagaggactaagtattgacaaggaatactgctactttcccttttaaaaaacagactataaataatttatatcaatatgcaaacagaaaacagacacacatgcacacacatggttaatgaatgtaaatagtcagaaatatggaatcataatatcagcaaggtgactacagagaacaggaatatataagttcccaagagagcttaacagaggccagcacctaacagtaacactgtgtgtccaagatagatttaagaagctcgattttttttggccacactccaatccttttctattcactggtatgtttccaggtaggaagaatttacatagtcatgtatatgccatgtaaactctatactacttaaggatacaaacatatctaagcatcagtctcacctagttcctgaaccaaattatcaaagccaaattattcatctcgggtaaaaaacaaatcaatgcagtcatccttgagtagaagatctgttttctacctttccagcaacagacagtagaaaatccatctccccagatgcattcctgattctaatttatactctgtggtctaaggaccacaatcacaagtctgtttcccatatcaacaccacccccaacatatacacacataattccaaagccattcaaatttccagcaatcatagactgaaaaactcttccagattatatgagattaaaaagacatgataactgacttcaattcaagatctggaagttctgttccccataaagaacactattgggacaactggcaaaatctgaataaggtctgtagattagctaacaacactgaatgttaatttcttgattttgacaatcacggcttgtttcaaggaaacattcagtgaagtaattagatttagaaaagcatcatgtccacaaacttctcaaatgggtcagaaaacatacacacactcacacacatgtgcacacaaagtgaaagagataaagacagagagacagataaatcataaagtaaacatagtagaatgttaacatttggtgaatgtgggcaaaggatctattgcaatcatttacactgtatgtccaaaattacactcagtgcctactctaaacatgatactcctactctgaggatcagtctactagccaaactcagaagcctgggtaccatccttgacccttctttcctttgtcccatgcccaattaaccccaagctctgtgaaaatgacacccccactatggctgtcttatttctatgtactattatatctttcctgaattactacaacaggctttacctaattttcctttattccatctattctacaaattttagccacagtggatcctctataagagcaaatataactcacctataaaatattctcaatagttacactaccattaaaaagaagctaaaactcgtggcatatgaggttcttcatggtctggcttttcgttatctttccaaaatcatgtatcataccatcaactccactgaataccctcaacactcaccatgaggaaataaaaaaaggaaattgagaatattgaaaaaaggaaagtggcaaagggaatcccaggatgattccaaggtgacagccttcaccagacagagagcagcccatctgtgtggaagctggtcagagacccccagagagaactcaggagaaaaaactgacagactatctgaagcacctgagtgtaatttgaaacacaaagtgatgtaaacaaagaaaggtccactagatattgatccacacaaaattaacagaccgagtacatatgcatgttggagcctatctcatgtcctacttcaaaataaacaccaaacaaatctaagatttaagatctagaataggccatggcaggtaggaatacaaacatatatacgtacatatatacatatttcaatctcagactggggaaaatgttcataaataatttatcagaaagaacaaaataagcgtgagaaatgtaaatacaaaaaacattaaatgccacatagaaataaaacactatatagaaaaacacataaactagagaatgtatttgcagcacattttttgaataaagtggtgattctcttgatatataaatatcaataactaagaaaagaactaaagaactaagaaagtaagagttctagaaacaactgaaacctctgatctcttccatatggaatatcacattaaccaaggataatttaaagtatttcaaaaaatacagaaaataggaggcaagtttcatataaagctatccatacaaacctatttcatatataaagacaacaaaaaaggaaaatcaaaaacatttcagctgataaaaactttttttggagaccgagtctcactctgtgcccaggctagagtacagtggtgcaatctcgccttactgcaacctccgcttcctgggttcaagcaattatcctgcttcagcctctcaagtaactgggactacaggctcgtgccac[137 bp omitted]gccgggttgaaatgctctgattttacctgctatggtctgaatgtttttgcttgcccccaatcatatgttaaatttaatctccaatgtaataatgttaagaggtggagcctttgggaggtaagtaggtcataaggactacaccctcatgaatgaggttagtacccttataaaagaggcctgagtgagtttatttaccctttccaacatgtaaggacacaaagaagacactatctgtgacaaatgggcccacactagacaccaaatcttctagtgccttgatcttggacttcccagcctccagaatggtgagcaataaatttccattatttatacattacccagtctaaggtaccttgttatagcagcccaaacatactaagataccactcaaccaaaacaaaaaacaaaacaaggcaaaattaagggagaggtaagctgtactgtaaccgctcaatttgaaggaactatcattaagtaagcatttatagacatcaaaaaggtccaagtcacttagttatacaagacaaggaggtatagacaatataccttaggaatacagatgcaaagactcctcaacaaaatataagcacattgatccagaatatattaaaggaataaaacattatgaccaagtgaggtttaccccaggaattcaaggctgattcaacatttgaaaagcaatcagtgtaattcatcataattaacggatgaaacaagaaaaatcacataaccatatcaattactaataaaaaagcattttacaaaattcaacatacattcataataaaaactctcagcaacctaggaataaaagagacgtcctcaatctgaaaaaaggcaagcagaaaaaaacctacagctagcatcatacttaatgatgaaagactaggtgtttccccagaaactgggaagaaagcaaggatgtccactcttatcacccatgattcaatattttactgaaagctgtagccagtataagaaaaataaataaatgacatttagatttgaatgagagaaatatttgcagatggcatgatgatctatgtagaaaatcccaaggaatttacaaaaaaaagtttctataacttataagtgagtttagcaagatctagtatatttcaatataccaataatgaacaaatggaaaataaatcctttttaaagtactacttttcaatagctccaaccataacaacaacaaagaagtattgctttcaccctaacaaaacatctacagaatctgtacattaacactctaaaatagtgataaaataaaactttttaaacatataatgaagagacattccatgttcatgtagtaagactcaagttagtcatcaattctccccaaattgatctatagactcaatgcaacttcaatcaaaatcccaacaggatattttgtagatataaactaagtttaaaatttctatggaaaggtaaaaaaaaaaaaactagaaaatgcaaaacaattttggggggatatgcaagaatcacacaataattttaagacatacaaaaactacagtgatcaaaacaatgtagtattgacaaaatgagacacacagaatgaggaaacaaactagagttcagaaatatagtcaattagtttacgataaaggtgcaaaggcaacattggaaaaaggataatcatatcaccaaatgatgctggaacaactgaatatccgcatgcaaaaatgttaacttacactcattcctcactccatatgcaaaaattaacccaaaatgtattatacaactgaatatcagtaaacttcatcaaaattaaaatttctcctctgtgaaggacactgtaagaaaagacaagccacatactcagagaaaatatttgtacccagaatatataaagaactctcaaaactcaaaattaagaaaaaaaattttaatgaacaaaatatttaaacagacatttcaccaaaaaaagtatctgtcaaataaataaatgcaaggatgctcaatatcataatcattacagtagtgcaaattaaaatcatactgactataactatgaacttattagaatgactagcatgaaaaatggtgagtatgtgaagcaattgaagtttttcatacattgctagtggaaatgcagaaatggcacaggaatcctggaaaacagtttggcagtttcattaaaatgttcaatacatacctatcatatatgcctcaaccatcctacttctaagtatcctaatgaaataaaaacttaagttcacagagaatcttgtacacaaaaattgatagcaatatttagttataatacagattgagtatcccaaatccaaaaatctgaaatctgtaatgctcccaaatccaaaactttttgagcactgacatgatgcaagtggaaaattccacacgtaagtacttaacacaaactttgtttcatgcactgaaaatatttaaaatattgtatgaaattaccttcgccttattttatacaaggtgtatatgaaacataaataaattttgtgcttagacttgggtcccatccccaagctatctcattatgtatatacaaatattgcaagatcctaaaacactgaaatctgaaacacttctggtctcaagcatcttggataagggatatttaacctatagtcaaaaaccgaaaacagttcacatgtccttcaatgtgtacatgaataaagaaactgtggtacatctacataatgaaacagtactctgcagtaatgaactactgatacatgcagtgacatggatgaacctcaactgcactgtattaagtgaaagaaaccagctgcaaagattatatgcagtatgatcacatttatatgacattctggaaaagctaaagctataggggcagagaagacatcagtgattgccagggactgggatggagggtggtttgcctaagaaaaaagcagcacaaggtcattttttgggaaactggaattgttctgtatctttctacaaaaattagccagctgcagtggctcatgcctgtaaccccagttactcgggaggctgaggcatgagaattgcttgaaccaggaggcagaggttgcagtgagtcaagatcgcaccactgcactccagcctgggcaacagacagactccatctcaaaaaaaaaaaaaagagagagagagatatggggtcccaccatgttgcccaggctggccttgaactcctagattcatgcaatcctccagccacagcctcccaagtaactggggctacaggcgcatacaattgtgcccagcttgaattgtctatactaaaatctgtgaatcctaaaatctgtcgctataaatacagtctgataacgattaaagtaaattagcattaactactttaagtttttagagattataattatagaaatttgtaatgagctcatccaatatatttctccccagtaaacagcaggaaatatccatgagccctcaaactcctccagccttgaaaatgaaatatttgggccgggcgcagtggctcatgcctgtaatcccagcactttgggaggca[131 bp omitted]tgaggcagaagaacggcttgaacctgtgaggtggaggttgcagtaagccaagatcacaccattgcactccagcctgggcaacgagcgaaactccgtctcaaaaaaaaaaaaaagtttcctattaagtgtttaggggaaaaaaatggaaaaagtggcttactgagtgccaggcaccctgctaagcgtggtatatacactggctcacttagtcctcatatccagatgagcaaattgaagtctagagaagttacgtgaattgctcaagatcaaagattggaaaatggcagaggaggggcttgctgactcctaagtccatctttagcttaaatcttacacttgacttctaatcttctaatttttcattttattcccttcactgtggtctcacaggtttcccttgtttctgacaattgataaacttgcctcttttttctttgaaatggagtttcactcttgttgtctaggctagagtgcaatggcccagtctcggctcactgcaacctctgcctccagggttcaagcaattctcccacctcagcctcctgagtagctgagattacaggtgtctgccaccacacctagctaatttttgcatttttattagagacgaggtttc[142 bp omitted]ctccactcccactggccccacctcccaacattggccctactccaccccacaggcggtaacagggatttacacctctttccagatccacctgccaactcctgctctgctctcctccctcagggacccattagctacacaggtctttcctgtgctctttctaaaatgcaaatctagatatttcaccaacttaattaaatgccctcagctgtccttaggaatgagactaaggcctttcctgatctggtcctcgctacctctccagcctcctcacccacttgctccttgccctgtgcctaatcgacacactccttctgggttctagccaccctctggctgaaattcctgttattcctagtctgcctactcatcctccaaggctcgtctgaagacattcctctaaatgtttccagaaacacttcaagacagaacttactgttcctcctccatcctttcccagaccacaaacctggatcacaccgcactatgatcactagtctttcctaccggcccagaaggtctttgagagcaaatacatttgattacttagttctgtcagtgccctaaacaattcaggtttttaatcagtgtcagctggatgagttactttcccttttcatgcctattttaacatattccctctggataaaaattctagatttgcagggctacaaacagtagagctgtctttggtccctccctggaggcgcttcaattgctggcgagatggctgcctcaaggcaactttgctcacagaggatcacaggaaaaagctcttcagttcgagaggtatttacctattgattaggttcctctgtgcgtcggtactatcgagaggaagctgatgtcgtaactccggtcctttttcactttcttaaatttttttcctcccaaatgaaaagtgggtgaatgaatgaaaatccactgaccatcaaatgtattttacactctgaaacattccccatttttgtgagtgcaaattaattcaaataggatttcccttcctaacggcacaatcaactgcactgtcttcaaaaagagatgtggactgcttgaaaatgagacgcttgtgtcacaaggacattgcacatggacacagagcagcatgatggtttccaagccacacgcatcatgccaggcagaccccaccgctaaggctagaaggaactctggtgaagcactgactccaaacaaagagggactttggtccagcaaccccgtcccaccctacagcagacgggctggggcctggacgctctacaacagtaagtagtctaggattcagttctaactggcttagagaacaatgggtcaggcgctttgggtaattttttataacaggctcaccttttttataatatttgatccagattttgacagttatgctttatttatttagcccacccaggaaatcaagtatcctacataaatcaatcttccagggagcaaagctttaagggttctctcagaaccattattttgaccattcttatgcaaatcttttaaagatatatacatttctttatttctgaagtgactacagtgattataatttagtcagtgctaaggagtcggcttcatcaaaaagaacatcagtgattattctgtgttgtgacactgtgataccctgaggagctattgagatgtgaagctcttttcccataaacaaaatggtcccagattacaatgcctttaattcttctgacagcttttcataattcttctgtctcctccttccaatgttgcccatcacttcttactaatgttaattactatgacttcatttcctaaactgctgccttcatttaattttatagagaatcctaaatcaatgggcctgagggagctgtcacacctctcctacggagtagtatctgtgagctctgtgtcattcttctcagagctgaaaggcccctctctctcacttctggatttctagccactttccaaatggctgatgctgccaggaacattaaattttacttcgcattcaatgaatacatactggctggcagaggaggatagtggcctagaaacttctttggttaaccctaggaggtcaactgagattaaatcttgctatggacaactcacaaaatgtgtaattgacagtggtctgcagccagaatacaaaggtcttaagaccaaaagcttctctgtaaagcttttgtaaagcaaaagcttgctttactccgctaaagcaagtaagaaggtgacgcatccatggtattgtctagatcaaagtcacagctgtttttttttttttaattatactttaagttctagggtacatatacacaatgttacatacaggttacatacgtatacatgtgccatgttggtgtgctgcacccattaactcatcatttacattaggtatatctcctaatgctatccctcctcccttcccccaccccacaacaggccccggtgtgtgatgttccccttcctgtgtccaagtgttctaattgttcaattcccatctatgagtgagaacatgcggtgtttggttttttgttcttgcaatagtttgctgagaatgatggtttccagcttcatccatgtccctacaaacgacatgaactcatcattttttatggctgcatagtattccatggtgtatacgtgccatattttcttaatccaatctataattggtggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgacgatgagcattttttcatgtgttttttggctgcataaatgtcttcttttgagaagtgtctgttcatatccttcgcccacttgttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttagtttcattagatcccatttgtcaattttggcttttgttgccatcgcttttggtgttttagaaatgaagtccttgcccatgcctacatcctgaatggtattgcctaggttttcttctagggtttttatggttttaggtctaacatgtaagtctttaatccatcttgaattaatttttgtataaggtgtaaggaagggatccggtttcagctttctacatatggctagccagttttcccagcaccatttactaaatacggaatcctttccccatttcttgtttttgtcaggtttgtcaaagatcagatggttgtagatgtgtggcattatttctgagggctctgttctgttccattggtctatttctctgttttggtaccagtaccatgctgttttggttactgtagccttgtagtatagtttgaagtcaggtggcatgatgcctccagctttgttcttttggcttaggattgtcttggaaatgcaggctcttttttggttccatatgaactttaaagtagttttttccaattctgtgaagaaagtcattggtagcttgatggggatgccatttaatctataaattacgttgggcagtatgtccattttcatgatattgattcttcctatccatgagcatggaatgttcttccatttgtttgtatcctcttttatttcattgaacagtggtttgtagttctccttgaagaggtccttcacatcccttgtaagttggattcctaggtattgtattctctttgaagcaattgtgaatgggagttcactcatgatttggctctctgtttgtctgttatttgtgtataagaatgcttgtgatttttgcacactgattttgtatcctgagactttgctgaagttgcttatcagcttaaggagatttggggctgagatgatggggttttctaaatatccaatcatgtcatctgcaaacagggacaatttgacttcctcttttcctaattgaatgccctttatttatttctcctgcctgattgccctggcgagaacttccaacactatgttgaacaggagtggtgagagagggcatccctgtcttgtgccagttttcaaagggaatacttccagtttttgtccattcagtatgatattggctgtgggtttgtcatagatagctcttattattttgagatacgtcccatcaatacctaatttattgagagtttttagcatgaaggttgttgaattttgtcaaaggccttttctgcatctattgagataatcatgtggtttttgtctttggttctgtttatatgctggattacttttattgatttgcatatgttgaaccagccttgcatcccagggatgaagcccacttgatcatggtggataagcttcttgatgtgctgagtcacagctgtttctgagtctggtcttccctagttgaaccacagacccatgcaaaggcaagtttcaaaggaaggctggggccatactccctggggcatgtacccccttaatcctttctgtgactctcatctgcagtacttccctaagtgtcctgacaaaggagattcacagcacacaaactttccctgggtcttggcatgccctgaacatctagatcagaccatgagatttttgcccaggtttgacttccccacctggaagagccagggccctttccacataatggtgttacttacagtgacaggcaggtctagaggattaaggtgcttgtcctgccggcagaaagcaaaagcatagagagaagcagacggaatgagctttcagcttacattcaaacaaggaccaggaaggaagattaacagagccaagccatccaccaaagacaaggacagaaagaaccacagatgcttttggtcttccctctagaatctaccaagagctgggtacatacatgatcccacttagatttcatcttactgagcccatgagattgtcagagaactaaaacgtcttacttttaacaccacttgggcttttctcagagaaatctagaatgttagtgttggaagggctgtcagagatcatttaaactggccctttcattttacaaaaagagaaactgagacccaaagaggttacaagcacttgcccagccagcagcagggagagtacttagttccaggccccttggctcttaggtcagggcttgttccaccacccagctgattcttagtttcctcatctgtgaaacagggagcttgtttttcctcagacacccttgtgagctaaacaaggcagatgttgttgctgccatgtgacaggtgaggaaactaaggttcacagaggcagagctatttgcataatgtcacagttaatgaacaggcgaaagaagatgtttagaatctgcatcagagaacctttaaacataaaacttagtgtgaagtcccatttatattggagcccttggactcagggtacccacagggtctcttcttccttattcttgatcctctaacccaggagttggcaaactatggccatattaggcttgttgcctgtttttgtaaataagattttattggaagacagccatacccattcatttacctactgtctgaggctgcttctggctacaatggcaaggttgagtagctatcacataggccatatggcccataaagtcaaacatgtttattctctggccctttagaggaaaaagtttgaagggccctaatctcatctaagatccagctggtttctcctcatagttcttccctgggtcttccttagcaaagccaccctgctgggctctagaccagagggctaggaggaaggactcttgggaaaatgcctggatttgtgctctctgaacagcaaagagtacgtggggtgagaattcttctctcagaagagcccagatgaagaatgtgaaaaggcagccacagatctgtctctagtcctcgggaggcttcagaaaaagtgcattaatcagtgcaatggcgtaggtctgaatctcctgtctggagctatgtcaatggagaaagacggcacagggagattagaagactgaacagcaagatgatgcttagagatagtttaaaacaatcatttacagattataagcaaataatgacctggagctaagtctcaaaagcatccaaagtggacatgctcttgacccagcaatttcactaatagaaacttatcctaagacagtaatcagagagctatgcaagatttactgacaaggcatttcactaaagtacaacttaaaaaagaatggaaagtaatccaaatgatcacagtagccaactgtttatatatatgagaatcttaagtagttattaaaagtcatgttttagggtaaataaacattcttaacctgggattcagggatgggcttagagtatctgtgaaccccaggaatgatacagaaattattctatgtagtttgctgacgaagtggtattttctccaaactggtgagagtacatacttgttaaccagattttcaaaggtgtctaggttgcaaaaaagacttagaactaccttttagaaaaatctttgacatggagaaatgttcaagatatattattcagttaaaaaaaatcaaggtacacatagtatatataataagatcccaattttgttaaaaatatgcataaaaaatactgaagggatatttaatgtttaacagtgggtatgtctggaggtgagataatgggcaaataatttatttttgggtttttctgtatttttaaagtcttgactataaacttattttattatgaacaaacaaaataactacaatcattccctggaatcttacaatctcagtacttgacatctccacctgccatgtcttgggagcattctgtggctgtctttccagaggggctgatgggcttcctggttagtcacagggtacccagagagtctaccagagggcacgaagtgtccctcagcccaaataggaaagcatataggttctggcgacagctgtgggctgaaagtattcacgattggcccctgtgaaatgccatgttcccgtatcgaccctagggaggcaactagggccactccgaattcagagacaaaaaaacagaggtagacgtgaggttacgggaaaatcagaattctctatctggagtttataatatccctctcatcttcatcaaccttggtggctcactgggtatgaaagctgaggctagaccaggcatggtggctcacacctgtagtcccagctactaaggaggctggagtgggaggactgcttgagcccaacagtttgagaccagcctggacaacacagcgagac[136 bp omitted]atctctactaaaaatacaaaaaattagccaggcatggtggcaggcacctgtagtcccagctacttgggaggctgaggcaggaaaatggcatgaacctgggaggcggagcttgcagtgagccgagatggcaccactgcactccagcctgggcaacagagcgagactctgtctcaaaaaaataaataaataaataattaaaaaacaaaaaaaaaaactagccaggtgtggtggagtgtgcctatgattccagctactcaggaggctgagatgaggaggactgcttgaacctgcagtgagttatgatcatgccactgcactccagcctgggtgacagattgtttcaaaaaagaaaggcaaagaaagctgaggctgaaaatttcttaaaagtgacaaggagaaatcagagttgcaaagaaataattgtgcttcctttttacttggattagtggggagaaacaagttgggaacatagctgagtgaaaacagggtcactataacctcccaaatctgggagctatgacttcccctcaaactggtggggggattctggcaacattctgacaatatccaaaaagacagaagtgaacaacagtcagaacagaatcatcagtagtgccaccgctgttctgcaaagtccagcttccttacctggtgtaggttggttggacaggaagtaaaaacaatgaagacaggagaaacataactccaatgggttcatttgtcatatggtttcattactggtaaaatgttttaggatgtgatgagagtcttaacaaacaaaagcaaaaagcccctgaatttactgaatacttaacctgtgctggccactatgctagacttttttaaaatctcctttgatcctcacgtgagaagtgaagatgattaacctagtctagagatgaagaaactgaggccagaagagactaggttacttgctgatagcagagacccagtatgcagaagagcctggatttgaattgatattccaaactcacgccctgtgtgatacttcttacaatcacccacagcgcatcatcagttcagtaagcattcattcaacaagtactaataaaacaggggatatgacaatgattgatctctgtttctagggggctctatgttcaaaatgggcaacagataataaaaatccagtattttatataattatcataggtacaaacagactactgggctcatgtggggaggaagcatctaattttgcctggtactagggcagtatgggaagactgggaaaatcttcattttaacctaaggggcagagagagttacagaggattttaggcaggagcatgacatgatgaggtctgaatgatggtagaaattctggcaggagtgtggaagaggcgatgaatgaagaagccaaccagcagcttggaatataagcaaagcagagtaggattggaagacttcaaataagaggagagacgaggacagacaagtgaagggagggaggtgtaggggtgtagggtcttttactcacacctggaagtgtgagatgagctgtcccatggtgatttcctcagctatcttctggtacagactctggtatcttctggtgtggactatgctctccaggatggccagggacctctgaaggactgaaacatccaccgtgggctcgctcacataccctgcaatctaggcccagagatggcacatcaattgagaagctcagggcctaagaaagatagaagcttagcatctgatgctagcccttggagctctctctgcttcacatttgggcagctattgctaggtggacagtggtacctggtttacggctaccctggccaatgtgccagggattcccttggcatggataccttaatttcagattatagtatccacttaattgtgtttcctcaaaatctaaaagcttaattctttttatcaaaataagagttccagcatg[134 bp omitted]cccatctctactaaaaatacaaaaaattagccgggtgtggtggcgggtgcctgtagtcccagctactcgggaggctgaggcaggagaatggtgtgaacccaggaggcagagcttgcagtgagctgagatcgcgccactgcactccagcctgggtgacagagtgaggctccatcaaaagaaaaaaaaacagcagaggattttactcatactgggatctcattttatctccatgtattcctcccctgacacacattctccctaaacacacttaagactttgagaggtagaaaggaccttgaagccttttactctaatccttcttctcaatccccattataatatacctgacacatggtcatttcacttgtgtccagggtcggggagtcccaatgtcctaagccaatgataagtgaagttctagggcagcagagagagtattattcaatggttttaattcagttttctgaattgacactgctcctttgtataaaagaaaggaaggtaaaaccagaagtaccctctcctacccactgagcttagtctgacaatacaaacaggctaccttgcagatttgtaaatagaaggcagatttgcaaatgaaatgcacatttttttttaatccaaagagaagagagagctcaggaagtcagtcaaaagactcagggatagtcctggttgactggctggctttatccccagtctcactgacaacctaactctactttgatcatatttagttctgacggtccagttccatctcagtgcaggccctgagagtataacaaaatccacatctttcagaagccacaaaagaccagaacttgaggatgaaaaatctggccccagggaatataaagctgatatcaccaaaatagcgatattgcttgtatctccccttaaaccctgtgaactggcagctgagggaggagagaaagacagaatgttggatgcctcacctgcttaataaaggtgattgaaaccatgtcccaggagacaatgccatggtccatgagctctaggaaggcagtcagggtgaatgccagcatatcactgtagctgagacacacacaaaatggacaaagatgcagactgggaaacacaggtgtgagggcagccacaaaaaagatgaattttaggctgggtgtggtggctcatgcctgtaatctcagcactttgggaggctgaggcgggtggatgagatcaggagatcgagactatcctggctaacatggtgaaaccccgtctgtactaaaaaatacaaaaaacttagccaagtgtggtggcgggcacctgtagtcccagctactccggaggctgaggcaggagaatggcatgaacctgggaggcagagctggcagtgagccgagattgggccactgcactccagcctgggtgacagagccagactccgtctaaaaaaaaaaaaaaaaaaaaaaaaaaaaaaaaaatgatgaattttaatgtgaacaccccatgggaaatcagtcgatgcaactgtaactgtaagtgcctgtgcgcacacctagcaagtagagcaggttcagcccaggtatctatcactgccaaaaaaaatgctgctggctgatcagacctttcttctctatgtgcttcatcctagggacacagaatcacttatctatttctcaagaccaaagaagacatcggacccttgtcaaactccagcacctattgggggaacctaaggaggcataagtgccatgttaacctttgggccaagaggcagtagagtgcaagagatgggctcagttcttgtccaccttactaaccaagcaaattttatcttttcaaaactcaatgtcttcctctgtaaaatcaagttagtctcacagcgttaacctcacaggattgtggagagggcaagatgatgatgtatgcaaagcacttattctagtgctgatagagaataaggattaaaatgttttctcttttctctcttctcctttatatatctgtacagtgctctagaattaacagatgatattcccatttacaaagcatgttcagacacagtctcattaacaatacttctcacaataatactgcaaggtagctattattatcctcaggctaaagagagggaaactaaggccagtctaaccctgcactctcgggagactgtagaactgtgtcagtgctgatggcagctgaaggcttcaggacttgagtacagctggaagatccaagatgtaaaacaaatatctatgattagttacttgatttggctgaaaatttccatagttcatctacgggctgagaagatttctgattccctctttggcagcgtaggctccaagcacctgtttactgactgctcttcacaaggcacagctgcccacctcatgcatgtcaactctggggtatgatgaaaatgtttgtgggtatcataaagttctggtctcctcctccctgtgcaaaagtgtggcagggagatggtgacttggtaggttgtaacctgtggtaaacacaaacgaagctgtgtgtgtgtgtgtgtgtgtgtgttgtgtgtgtggtggaaggtgacttgagagagagggagcagggggtggttacagatggacacacacctgggacatattggaccatgtgctcagtaaccctcatcagaccaagcatttccagcaattaacaggtctgtcacaacctgaccgctctcctactgacttctctagcccctattttcactgctcacttggcacagtattgttttgtactattatttaatttgtgagagcccaactatactacaagatttagaagaacaacacggaattatatgtctcggtatggactctagtgctttgcacactgctctgtacataggtggtattcaataaactccttatgtgacttgatggaaatgagactaggatgccctgtgggatgtagtaaatcactgaagtctctggaatgagaccttagtcatactcactgggacaggagtttggttccattttccacaagcctcgtcagcacaatgatgccatccatgttgatgaactcagtagcaaaagtcacgtcagcagagcttggccagcaccttcatggtatccagccgggtctccatgttggatgactgggtcctctccatcagctgggcgtgcagcctgggactaggaaaccagggacaagacatgtgccatctgctccttggagcaggttactactctgtggatagctcacagaggctcttttgtggacatccaaacctgaggcagaactagcttttttaacactgcttaggagttgctaaattgtgggatcaatcagggagttattagcataccaaaacaaatctgtatttatctgtatcttttctgtaccactctggtctatggattaaaaaaattcctaccaagggaataccagagacatctgggaggcccactaatgagtcacagagaaacagatattggtttaatagaggaaggttgtctattaattaaagctgtctggctgggtgcagtggctcatgcctataatcccaaggctttgaaaggccaaggcaggaggattgcttgagaccagaagttagacaccagcttgggcaacagagtgacaccccgtctccacaaaaaatttttaaaaatgagccaggtgtggtggtgcacacctgtagtcctagctactcaggaggctgaggtgggaagattgcttgagcccaggagttcaaggttgcagtaagctaggactgtgccactgcgttgcagcctgggtcatagagcaagactgtctctcaaaaataaaaaaaataaattaaataaaactggccgggcgcagtggctcacgcccgtaatcccagcactttgggaggctgaggcaggcagatcacaaggtcgggagttcgagaccaacctgaccaacatggtgaaatcccgtctctactaaaaatgcaaaaattagccgggcatggtggcatgcacctgtaatcccagctactcaggaggctaaggcaggagaatcacttgaacccaggaggcggaggttgcagtgagccgagatcatgccactgcactccagcctgggcgacagagcaagactccatctcaaaaaaaataaataaaataaaataaaatttataaaactgttagacagcagaagaggtttctcttggggtattaagctccctgtcaccagaagcaatcaaggagaatgtggacaactatctgtcaaagatgctgtagaagggattcttgcattgggtgaagaatttaatctaatgttctctaagctcccttttaatcctaaaatgtgaaaagcttgataattttttaaaaactttctctcaaaatccatatgattattcctcaaagtaacagttctggagaaattttaagaatatcaaggagccagaaacaatttcccaatcattttttgaaaatgaaggctgatgaagacaaaacctcctcctagcacatgaactttttctagcaggatgcctgcctccttttctgcaaactgtggctaaaatccctcctctagcattcactgggctttccttctgctgagcttgttagtacatagtacctcacaatttactgtttcatcatactctgttttttgggtgttaatttaatgttctccactagaaaggaagagccttaagagcaaaaacactcctgtcttctttttctcagtgttaagcaagtgactggagcccaattcctgcggccaccacggagtcaggcctgttgtccctctcccctttgcctctcctcttttactattacaaagctggcccttcacagcacaatgctctctgtgatagagaagccctcactctgtctacagtggacaaaacgtgcgccacaggaaaaggtcacagcacagaacaatctgaagagcactggtctgcatcccacttagaaacttccaactctgtcaattttcctcctgatacagcatttctgggctgctgcctcccgctccagagagatgtgcttctgggaaaggcaactgcactgtgcaagaggtcggaaatgtgtcagcacttccataaaagtgtgtaactcccaggctgtcatattaaattaccagagcttaggagggaagaatgaagtccttaaaatgagaagagttcaggagaagagggggaggcagaagaacatgatgggaggaatatgggcctagagtcaggcagacctgggtctgagagcaggcttggctactttattagctgtgtgacaagtggcaagtaatttaacctctctaagccttggtttccttgtctacagaatgtggctattaagagtacctatctcatgggacgtttgtaaagattagatgatttaattacacaaagtatttagcaaaatacaggcattcagtaaaggttggctgatatcacttcatacctcccctcctctcagatgaaccagtctctctctctgcaccaagaaaagaggtgccatcacgcccttattttgctagctgcgcttctacgaatgtaaccaaaggtgcaatcatattggctgtcttcctcatgggcttagcagtcaaggtgattccctctacctgggctttgagtccttcctctcctggtccactaagatcctgttctattgattacctgctttcctgcaccttcaaccttcctctcttccatcttaacacattcttaagggcacataaaaaattgcaacagaaacaacaaccaggaagggtcagaaatgtggggaactgggcagatggggacaggagttgcagggagaccttttgctacatctctgtgaaaatttttgatttgtgaaacacatgaatgctttacgggcttttaaaaagcgcatctttttgactctacatcctcttcacgttatcaccttctctgtgttttcttttaaaaccaagcttcttgatacagcagtagactcaaagtccttacttttttacctttcttttacttgactcagttcagtctggccacctggcctccccaccataacttttttgtgaagatcaccaaggtcctcttcacctcccaagtcttgagacagcttctctgttctcagtttgctaaatttctctgctcattaaaaattgcagaccatgttttccccaatcctgacactctccctgcccaaagctcctgtcacttcacattcttggtgttctttctacccttctggttgcttccttggtgacctttaagggctgctcttgcaaaaaccagagtcattctccattctcccctttccttccacatccagcgtatcaccatactcataaaggttacctcctagatactcttcatatcctttcatctccattaccatttgccttccctgggctgttaacattcctcatttgcctcttaaaaggttcctactaccaccaacctacttcttaaggcccatcttccacacggtcactaaagtcatctttctaaaacttaaaatctaaacataacatatcttcctgcttaaaatccttcaatatccctagtttccttctggacagagttcaaacctatgagcaggccatcaaggaacattgaatacctggcttttcaatgattgctacaagcctccagccacccagcacttctgcttttcccaaacacagcaaacctctgtgccttggcatatgctgatttctctgactagaatacttttccttttcttatttctccagctaattcttgctcatcctttaacatctgagctaagtgaccctttctctggcaaggctttctggaaatctccaggctgagttaggtggtcccctttgtgagttctcacagctctctaagcaactttctctcaagatccttgagacaggccttcaattgcatgtgtttactccccactaggtggtgagaaccaagacactcttatcttcctatattatgtcctgatacaaaaggactgactttttaatctccagagtccttgtttctagaacagagcctggcccatggtaggtgctcttatttgtttgtgacatgaataaactcctaaggaaggaagaatacctactggggagatagccagttgtaagattgtctcatttttttttttttttctgagacggagtctcgctttgttgcccaggctggagtgcagtggcatgatctcggctcactgcaagctccacctcccgggttcacgccattctcctgcctcagcctc[135 bp omitted]cggcctcccaaagtgcaggattacaggcgtgggccaccacgcctggcccgattgtcccattcttaacgtcactgcgagtctgggtagtgaaaagcaaagaaacaacaaaggtaactaagataaaatgttaaagtggtacaagcaagttgaatcaacataatgttttgtcttttttacagtagatgtaacaggctcttcagtcgggccctcttctcctgcttattccttggcaaagagcttctaagatcctcttctagcaccctgggccctcaggaagtaaaagccacctttttccagccactagggaggaacaagggctggtacttcccagtctgcccagggagcgactctttacccaacacatggaagctacctggatgctgagtgaagataaatagtgctgtctccttgggtcatttacttccaagcaaggcccacattgattttgcctttccctatattaacctgttcagtgatgtacagctgaggatcatctgcatgacggagggtgtaatactctgggtttggcaacgaccacctacgcaagagaaaaacagtatatcccacttggccactctcttgtccagaagcttctcataagtcattttcagtagagttgctcaagggatcaggtggcctatttggaatacagtggaaaaaaacaaagctttaggttgtcatgttgaaaaaatcacagcctcagccttttgtaaagacaagcaccacaaaaggaggtgtgcggaactgaggaggggtctcagatcctaccatgacctcaagcagggcaatgctagacttacaggaaaaaattaagaagtataaacgtcttaggggtattgttgtcaactgtacctccttcccaagacaatgattcccaagagcccctttctggggacctgcctaactggagatccttcccagaactcccctcaaggtgtggcagtgctccttcagtcagagctgccactgtcaaaaacgaggtccatttcaacctacccatcacaaacttccttgataatggatgccaggggccatttctgaaaaagagagaaagagccttcaatagcagcaacatcctacccaagccaaggttcagacaagagagcctgccaagcagggtcaagccggggcatgagaatgtacttctttcctaacagcttttgttaaagaggaagcctctcccaagccatggtgacagaccttccctagggtgggccaggcccaaagcttagccttcctgttgatggttcttactcttgatgccagtagtccccatccctcaagatatcctctgccatgcactccccaggtgcctttcctcacttcaggagtgtacctggttgatttcaaggagctgggcattagcatctggacactcaatggccactttgacaatgtctgatggtggtggcatttttcccaaccagtgggctctaattctgcaagacaagaacacagacacgactgcctggggagaaagaatctgaaagacagaaaaagtcagagtacctcttcatttttcactcttgttacatgttttgaagagtctacagacagacactgcataaagtaacacatgaaactacttggtttgaatttttctagatcataccaaaacctctccttggggttttgttttttgacattaaatcagcaagaaaaaatgggacaaactgtctatcatccatagatcagccagcagcaacatgtgccaatgtggcacttcagtttaagagtcgagaggactcagtggtagaagaacgtatttactgcaaattcctgtcttgagaccttgggaggagagtgtgggggaaagagagatcagactgttactgtgtctatgtagaaagaagtagacataagaaactccattttgttctgtactaagaaaaattattctgccctgagatgcggttaatctgtaaccctagccccaacactgtgcccacagagacatgtgctgtgttgactcaaggtttaatggatttagggctgtgcaggatgtgctttgttaaaaatgtgtttgaaggcagtatgcttggtaaaagtcatcaccattctctaatctcgagtacccagggacacaatgcactgcagaaggatgcagggacctctgcccaagaaagcctgggtattgtccaaggtttctccccactgagacagcctgagatatggccctgtgggaagggaaagacctgaccatcccccagcccgacacccataaagggtctatgctgaggaggactagcgaaagaggaaggcctctttgcagttgagataagaggaaggcatctgtctcctgctcgtccctgggaatggaatgtctcggtgtaaaacctgatcatacattctatttactaagataggagaaaaccaccttgtggctggaggtgagacatgctggcggcaatactgctctttactacactgagatgtttgtgtagagtcaaacataaatctggcctacatgcacatcgaggcacagcacctttccttaaacttatttatgacccagagacctttgctcacatgttttcctgctgaccctctccccactattaccctatagtcctgccacatccccctctccaagatggtagagatagtgctcaacaaatactgaggcaactcaagagaccagtgccggtgcgggtcctccgtatgctgagcgccggtcccctgggccactgttctttctctatactttgtctctgtgtcttatttcttttctcagtctctcatcccacctgacaagaaatacccacaggtgtggaggcgctggccccctttaggagagaagcatatgctccgaaacagataagaatagccaggcttttcttggttgagtggttagctggaggagccaggctccttctgttctgcagtcatcctaggaagatcccagcatcagcggggcacagctacatgctctcttgcttccctcgcactcatcaatgccactgctttcccctcaaaggacactatgcaaagccacctctgtgtgggatgacatcagaaaatggggaagagaactgggacaggaaatgctattttcatccctattgccaagggcaatagcagctgacaactcaagtggagggagataaagatatcttcacacaagggcccgtcttataaggacaaggctttgcaagtacctctgaccacctcccccacttctctccaaaataaaggaaaataaattatcttgagcaagtctggaagatgggcccaagtgactggtatcctaggcaactctgatagcttactggtattccaagcagtaactaaagcattctctctccaaggtctgacgaagggaagtcacttggctgatggattatttcgatgtatatttacactccttgcctacaggttcaggagagggcttttttttttttttttttttttgagacggagtctcgctctgtcgccccaggctggagtgcagtggctgcgatcttggctcactgcaagctccgcctcccgggttcacgccattctcctgcctcggcctcccaagtagctgggactacaggcacccgccaccacgcccggctaatttttttgtatttttagttgagacggggtt[145 bp omitted]tccagatttagccattcacccacaattcatgtctcgcttatggggaccacctgcctctcctggcatacaaagcatagctgttgtgaggctattatgcacgtatgctatcaatttttcagcctaaacacagatgccagttctcacagcctgataagtataaacctctttgatgaaaaggagtaaaagtcctgtcccccacaagccccccggcctcagaaagagggatgctttcatgaccatttcctagtcaggatgggatgcttcagaagtctactgtcataaaaaaccagcatttccagaccatgacaatgtaaaggaactagttttcaaagtgctttcacttactttattgtgtcctcccagcagcaccatgaattaggcagaagaggattatcacctgcatttgaagatggcacaactaaagctcagtgttttgtcaagtgcccaaggtcacccagctagtaagtcataataggggacagaactcggactggcttcagccagtgctttccccttttcctctgagccagcttcaacttctgtccactgcaattaaacgcagcctaaagggattgaagtgggttggccttatggcccccaaagcttccataacttctgtggcttgtggcagaatttttcacagtaatttttacatgcctagacacacaacaaacctcagaaaagaaactggccctatcagcataatttctggggagactgctctgttgcagttacagcagggcagggagttctcgttccaggggtggcgccatcaatctctggatgcctagagatgcgtccttatccttatcggcaaagcggctgcaattagtagactaggactgcatggttgtgaggtcaattttaaaaactgagatataatttacatacaataaaatgcagagggcttaagtgtacatatgtttgtatgcatatacataatagacataaacacatgcatctccctgtaaccgccactcaaaacgggacactgaacattttcatcaccctagaaaattacttcatacttcctcttcctgtcaatcctttcagtcctttaaaggggaatttctgacttcttatcatcatccatgagttttgcctgtttttgtactccatataaacggaactatacaatatgactttttagatcatttgtttttcaatttggcttcttcttatttttaaaataagcaggtacaaaaggcacaacagaaagagcactgggctaggataattgtccctggtgaaaaaagtgactggatttagagccaaaggcctcaagacccaatcctagctctttcatgatgtatacatgcccctttaaccaaatctcagttttcttctattgagggatggataattgtccctgctgaaaaaagtgactggatttagagccaaaggcctcaggacccaatcctaggtctttcacgatgtatacatgcccctttaaccaaatctcagttttcttctattgagggatggataattgtccctgctgaaaaaagtgactgtatttagagccaaaggcctcaggacccaatcctaggtctttcacgatgtatacatgcccctttaaccaaatctcagttttcttctattgaaagatgtgagtgtaggccaggtgcggtggctcatgcttgtaatcccagcactttgggaggccgaggcaggcggatcatgaggccaggacatcgagaccatcctggctaacatggtgaaaccctgtctctactaaaaatacaaaaaattagccagacacagtggcgggcgcctgtagtcccagctactcgggaggctgaggcaggagaatggcgtgaacccgggaggcggagcttgcagtgagccgagatagagatcgcaccacggcagtccggcctgggcgaaagagcaagactccgtctcgaaaaaaaaaaaagaaagaaagaaagacgtgagtgtagaactaaagcatgtctcaggtgacttctaagtctaaaagtccatgattcttaagtggaattttaaaaatccaagtgaggatgcccattttaaagtcctcaccaaatgaagttacacccttccttaatttcgatggtgctgctaagaaacaaaccacattatttttaactcctttctgaaaaccatctttggagataattaagccaaagctcattatgttatacctattattttctcttgaccccatatgacatatcctaggttgatgctctgtttattaaagttagcactgaatgattctcagctgttcaaaagttcatatacattttaaagcatggagatttgcaactactgaactatttgaaagatattaataagcccccattctcagtgactctgtccttcccacaaagcccaggcagcctatctgaactgaatgacactctccacaaccctgccatagctgatgggaccaaagtgaatacccaactttagctgaattatt[132 bp omitted]catggcgaaaccccgtctgtactacaaatacaaaaattagctgggcgtgatggcaggcgcctgtaatcccaactactcaggaggctgaggcagggaggatcgcttgaacctgggaggcagaggttgcagtgagcctagattgcaccattacactccagcctgggcgacagagtgacactccatcataaatacatacatacatacatacaaacaaacaaaagacacagactaagggaactgggtgataacgggccctggagaagtaagatcatagtaagcttcagagcagttaccatggcaagccaaagattcgcataagccaaaaatacggagaataaaaaaccaagagcctttcagaggaagtgattctgcaagaggaatccagaaatatataaatgagctgaggccagaaatcagaaagatgagaaaagccattacctggtaactttcccgattacgtggctacacttcctatgcttggggtacctgaaagtccactgtatcctgccaataaaactcctataaattaagctagtctatgtatctactcattgcaactaataagcctaagaccaaaactgcccccaagttctgcaggaactctaaaatggaggtctgagcagacagcagcatcactggcataagatgatggttctgggtaagcacttaattaacaatggctgaattaatgacagcaaaatccacaggtttgctcttatccactaggtaagtctgatttgtttgcaacagatcagttatacagtaacttcgtagtaatcgtatatctaatagtaacgtacaggtagcgtctttatttttattttatttttatttatttatttttttgagacggagtctcgctgtctcccaggctggagtgcagtggcgcgatctctgctcactgcaagctccgccccccgggttctcgccattctcctgcctcagcctcctgagtagctgggactacaggcacccgccaccacgcccggctagtgtgtgtagtgtgtgtgtgtgtgtgtgtgtgtgtgtgtgtgtgtgtgtatttttagtagagatggggtttcact[140 bp omitted]aggctggagtgcaatggcgcgatctccactcactgcaacctccacctcctgggttcaagcgattctcctgcctcagcctcccgagtagctgggattacaagtgctcgccaccacacccagctaatttttgtatttttaatagagacggggtttcaccatgttggccaggctgctcttgaactcctgacctcaggtgatccacctgcctcagcctcccaaagtgctgggattataggcgtgagccactatgcccagcccaggtagcctctttatagttgattgctcacttctatagcattattttagttgatgctcataagaactctgaaaaacattcctatcttacaggtaaggcaactgaagttcagatggatcgacaaacttgttctccatgtacctctttctacacctccctcccaaatgaaggaagaaaaaaaaagaagggagggaaaagaacagtaagtcaacccaacacttcagaactgggtctgaagccaaggtcttaggactgatccctctacataatacttccttacatgatgacattagctaacaattacataatgctagggcactattttaaaggctctatatatactaattaatttaatctgcacagcaacgctgtgtggtatgttattatccccactttagagacaagaaaatagaggcacagaagagttaagtagcaggctcagtgtcacacagctaggaagtggcacagccagaatttgatcccaggttatctggtattgctggaaagccatgagaaagcaggtggctctgcacttgacccgcagcaggtgctttgtggcaatttctggtttgtgtatccgaaaccaaagcacactgaggctaagaaactttcacaagaactcaccattgtatcaaaagatagcactccactgtctacaggtgggccacggtcccttgtgtgctatttggtcctttacaatctagccagactcttccctggactacctgctatttctataaggccgtgttctttcaattcttctgtacctttgcatattctcttcctcctactgactgtcagaacagctcctattcaagcatcaaagcctagttcagatcagatgctacctcttccctgtactagtcttagctttctctaacttttcctggcaaaactaaataggacaggggcctctgtgttctcacagcatcctgttcatacttccattagcgagtgtgatcttgtcatactctattatagttacatatttacatatctccactagctcctcctccaggacaggtataactctgcagtgtcaacctagcacaacacttggtgtccagcgaaggctcagtaagcacctgtgtctgcttaaacccgatgactctgacttcttccaagctggaaccaagctggctccaaatggacagggatgggcatgaattgcgcaggttgtctggtgttccctctgtgtcccaataccctttcactacaaagtattttcattgtttaacagtttgttttggctgggcgcagtggctcacacctgtaatcccaatgctttgggaggtgaaggcaggaggatcacttcaggccaggagttagagacctgtttctacaaaaaaaataaaacattagctgggcatggtggcatgttcctgtagtccctagctacttaggaggctgaggcaggagagtcgcttcagcccagaagttcgaggcagcagtgaactatgatcatgtcactgaactctagcctgggtgacagagcaagatcctgtctctattaaaaaataaaaattaaattaaagaactgttgttttcatatcaaacattagaataattcttactgaaaaatcagggttagcacacctaactctagttaaagaggaaaacatctctctgcttttctccctatggaatagaaacatcaggagataggagactagaagtaattctattctccagataagattcccaggataaaatatatccttgtagggaaccctcccagcacatgtttgcttactctcttcattttcattccagaaaggaagtggaaattaggtagaaggaattcaataacattgcaaaattctcagggttataaatggcctcttgctccaccactcagcagtactgtagctcaaccgcaaaccaccagaataaaggagctctagttccacatcaaggcccagagggccccttccagattaaacaactctccacccttctcccttccacccctctttaagcattacagatataaggatgatttggaaaatcaaaatgctacaaaacaggagaggcacacactgacctgaagacaattttactgtaagtcattaagaataaaaggccagtttctcaaatatagagctgggaaaagtatagaaaaataggaacattagtgtctccaatagagcagtctctaagtggcttctagaaggtgtgcttataaaatcagcactgttacagaagaccccatggagctttatcaatcacccgtacagtgactgctgcttcacggagctggagtctgacagcagggttggaaaatccatctcaaggaaggaagtgaaagatgatctccttctattagtaaggaccccgccagcacggggtctgaaggaacgtgatttccttccaaatgcaagaggcagctttatttttcccccaaactttttttttctttttggtatgcagtcttagaatgaaggaaaaggctttggttccctgcgttaaatcataggttgtgagctctaagcggtcgtctggtggcactccgccctgtgcccagcgggcacttaccgcacactcaacagtggggatagctgtggtttggggaactgagtgggagtgactttcgtgtcagaggctgtgagcagccgctctgctcacaccgagtggggctgaccgtgggcgctgagcagaggcagaagggtacaacccggctgtgctttttggaagggatcccggaggtggcattcgtcactgcacctgcggatcggaacaaggctgggcaccgcgccaaggactcactcctgctgtctctcttcatgctcacagcagccctgtgatggaggagcaccctgatcccttcgctgcagatgaggacacaggctcacagagggtccgagatcttacagctggtgaggggcagagcaaaacgccaacctattcctgttggattccaaagtttatactttaatcgttcgtctagcagattcttacaacaatcctgggaggtgtgtattcagttgtcactttgcagataaactgatactcagcaaagagactacatagtgactaccgcttatagggcactgcacagtctgcaaagcagttttacatgttgtttcatttgatcctcaaaacatcttggaattaaagatgatttttcttagtcctattttacaggtgaataaagtgaggcttggggaggttgaggcttagccatagctaacattgctaaagctctggcaggagttactctttctccttctcactggctggcccagccttgaccttgtgatgatgatgatgacgtgctaggggacagagccacagcacagaaggtgccgaatgctacctgccgacttgggacactcacttcatactcttatgtgaaaaagaaatgatcttctccgttctttttattactaattttgatagcagggagggctgttagagccaaccctgcactcacacaacactgaggaagaaagccttaaattttgtaccctgggtgcctcactttgcttcattctagtcctgaccctgcttaatacacatttatccaaggaatgagtcactcacttaagctttacaagactgtgtaatttcttttgctgatattgccagtgcaagttctttgattgcaagtcttaagaatcaattctggctaactttacctgaaaaggattttattggcaggctagtgtctaactcacagaggtaacacgaagctggagaatcaggcttagaaaaggttagaaagcggagatgttttgagagtttaggcaggcaagtgaatcaattccatgttttttttccctttcttgaccagagctttctttgatgagtcaaagtccctggagcaagggttcaattggctgagctcaggtaacatgtccacactttagctaaggagggcaggcaccttgatggacagctccaccaagactgcacaggagtgcaaagttgcagatccctcttcctccacctcagctgctcccagtgggcaactaagttcaggtgccctgttttcaggctgggatcaaataggaggagttcctgcagtggaatgtcatgattacacaaatgcaattgtgtctggcatgtgggagagcatagcagatatcctgagctttgtaaccttatagacctttgtgctatttaccagctgtttgtccctgggtaagttactagatctctctgagcctgtctccttgtgtgtacaatggggagaataacagtaccagccttaatggattgttgtgagaagtgagatcactgcaaatgtacaacacttagcagaatgtctgcatataagtgctcaataaattgtaagttataaaatagtaacattatagtaggccttccataactacttattgtgtgagtgaattatctacccctctcatttctctaatccatttgacttttgtttgtttcttgtttttgagacagaatctccctctgtcactcaggctggaatgcagtggcacgatcttggttcactgcaaccttcgcctcccagattcaagagattctcctgcctcagcctcccaagtagctgggactacaggtgtgcaccacaacacccggctaatttttgtatttttagtagagacagagtttcaccatgttggccaggcaggtcccaaactcctgatctcaagtgatctgcctgcctcagcctcccaaagtgctgggattatacgcataagccaccgcacccggccaatatggcccatctttagagtggtggggagcttagagatgaatttttttttttttttgagacagagtcttgctctgtcgcccaggctggggtgcagtggcgcgatctcggctcactgcaacctccgcccctccaggtttaagcaattctctgcctcagcctttggagtacatgggattacaggcgcgtgccaccacacctggctaatttttttttgtatttt[151 bp omitted]gatgatctcgcactttacttctcagacttaatctattcctactctcccccaacttactgtttgagtctcacatactaatttctcattctgtgaacagtttcttctcatctctgtgcctttggacttgctgttccctctcttggaatgcttttcccccagctcatcacatggcttccatcttcactttattcaggccatgctctgttatctcctcctccaagtctttcctgacaactctatctcctatcatccagggcctccacccctcttcttcccttaacctgctctaatcttctccctagcattgcatgtcatattaactttttttgtttctaacttccacattagttgtaagctaactccatgacagcagagatgttgactgtcttgttcatagctgtatctctgctacctagaacatatctattataatacatgatatggggtcaatatcttttttgaccatgtaaaataatggttgcatcactgaataaaacaaaaatgacctatgagtaaatggaaggtctctatgaacttgacttatacttaaatcattctaaacacttacagattaatcatggcccttctcacatagaattattgtcaagtacaacccctgccaccacaccaaaaggctattttaatttttttgagatggagccttgctctgccgcctaggctgaagtgcagtggcgctatcttggctcactgcaacttcccccccgccccaccagattcaaccaattctccagcctcagcctcccgagtagctaggattgcagacacctgctgccacgcccagctaattcatttatttatttatatttttattagagacagggcttcaccatgttggccaggctcgtctcgaactcctgacctcaagtgatccgcctaccttggcctcccaaagtgctgagattacaggcgtgagccaccgcacctggccacagccagttttgtttcatttatattcccacttcatttatatacattccttcttcctctgaattattttgaagtgaaaactatacatcatatcattttttaattaccttatatgtatctgtagaagacaaagaatttttaaaaatatattcacaatgccattaaataccaaaaaattaatacattctgaaaatagccgcaaatccagagttcacattttcttgactttttcataagtgattttttctaggttatctatttcaatcagatacctgtttgctcatatttacattcctaactgaacaatgtctaaacttaaactgacataaaacacagacgatcttatgaccaaatgcttagtgcaagaaaaaacttcaaattgcaagaggagtccctccaaatatagaaaagaccagtattttaagagatatgttaactaaaatgtggcaatgtaagaagcagagcaggaagaacctttaagtctgaaacttgcaagtcaatttcatagtcagtttccctggtccttccacaacaacctctggcatacctacaatgaaggtaacaatagtagctatttcagagcaggaaaaggcttagagcagtgctagaagagggttgaggctatataaagtttagctatttgtatattgtaacaaacctacaactttttttttttaagtcaataatagagttctttgggaagagtagcagcctcctgtcggggagcacctgcagttccactaagtgaccactggtgtccgctaacctttgcctctacttctctcagtaatacactgtccagctgctccttgatttaacaattttatatactttctttttttttttttcctttcccttttcctgagacacagtcccgctctgtcctccagtctggactacagcagggccatcatggctcactgccacctccaccccccaccacacccccccacaccccccgggctcaagcaatcctcctgcatcagcctttggagtagctgggactacccgcggggcccaccacgcccggctaatctttgtggcttttgttttgtttttccgttaagagaccgggtttcgggccaggcgcagtgactcacgactgcaattccagcagcccgggaggccgaggccggcggatcacccgaggtgaggagctggagaccagcccgaccaacatggagaaaccgcatctctaccaaaaaaataaaaaataaaaaactaaccgggcatggtggctgacgcccgcaatcccagccactcaggaggctgaggcagaagaatcacccaaacctgggaggcggaggcctaggcgagccgagaccgcgccactgccctccaacctgggcaaaggagcgagactccgcttcaagaaaaaaaaaagagatcaggttccaccatattgcccaggcaggtctggaactcctaggctcaagcgatctgccgcactcggccgtccaaagtcctgggatcaaaagcgtgagccaccactccgggccgatctattcctttctgattaataaattgggccgggcgcggtggctcaaacctgcaatcccagcaccccgggaggccgaggcggttgggtaacgtgaagtcgggagtttgagaccatcctgaccaatatggagaaacctcgtctggaccaaaaaaaaaaaaaaaaaattagccgggtatggtggttcatgcctggaatcccggccactcgggaggctgaggcatgaggaccacccaaacccgggaggcggaggccgcggggagccgagactgcgccactgcactccagcctgggcaacaagagcgaaactccctctcaaaaaaaacaagcaaaaaagagacctggtttcaccatgttgcccaggccggtctgaactcctaggctcaagtgatctgccacgctc[131 bp omitted]tatgatgaaaccccgtctctaccaaaaatacaaaaaaatcagccgagtgtgtggcgggcgcctgtaatcccagctactcagaaggctgaggcaggagaatcggttgaaccttgcaggtggaggttgcagtgagccgggatagcgcaactgcactccagcctgggtgacagagactccgtctcgaaaaaaaataataaaaataataaattgggccgtgcgccctggctcatgcctgcaatcgcagcacccccggaggccgaggagggcgggtaacctgaggtcgggagtttgagaccagcctgaccaacagggagaaacccccgtctgtaccaaaaaataaataaataaataaataaatcagccgggcatggtagctcatgcgtgcaatcccagccacttggaggctgaggcaggagaaccaactaaacccggaggcagaggcctagcgaaccgagaccttgccaccgctgtccagcctgggcaacaagagcgaaactccgccccccacccaaaaaaaaaaagaccaggtttcaccatgttgcccaggagggtctggaactcctaggctcaagagatccgccgtgctcggccatccaaagtcctaggatcacaaacgtgagccaccacgccaggctgatctattcctttctgattaataaattgggccaggcgcggtggctcacgcctgcaatctcagcatccctggaggctgaggcgggcagttaacctgaggtcggcagtttgagaccagcctaaccaacatggagaaaccccatctgtaccaaaaagaaaaaaaaaaaatgagctgggcattgtggctcacgcctgcaatcccagccactagggaggctgaggctggagaaccacccaaacccggaggcggaggccacggggagccaagaccacgccactgctctccagctgggctagaagaacgaaattccgcctcaaaaaagaaaaaaattaataataataataataaatagaccaggtttcaccatgttgtccaggccggtctggaactcctaggctcatgggatctgccgggcttggccgttgaatgtcctgggatcacaagcgtgagccaccacgccaggcctatctattcctttctgataaataaattgggccgggcgcggtgtctcaggcttgcaattctgtagcgggatttttaaggaattagagagactgatggggtttaggaggatattatttaggtgcactggcccagtcagcttaacatttaaagcattgagttctggaaccaagggctatcttttaagcattttgtggggcgggggtagatctgtgcagggggaagcataatacagaagcgagaaacaaagataattaattgaaatatgcattatattattttttactatttaaggaaaaatacgttttgttgagtttgtttagtgaccttgcaattgcacagttagggaattagccgggcacgatggctcacgcctgcaatcccagccactcgggaggccgaggcgggcagataacctgaggtcgggagtttgagaccagcctgaggaacatggagaaaccccatctccaccaaaaaaaaaaaaaaaaaaaaaaatgacccgggcatgatggctcaagtgtgcaatcccagccactcgggaggctgtggcaggagaaccaaccaaacctgggaggcggaggcccggcgagccgagactgcgccactgcactccaccctgggcaacaagagtgaatctccgtctcaaaacaaacaaacaaaaaaaaacaagccgggcgcggtggctcacgcctgtaatcccagcattttgagaggctgaggctggcggatcacgaggtcaggagatcgagaccatgctggctaacacggtgaaaccccgactctactaaaaaaaatacaaaaaaattaggcgtagtggcgggcgcctgtagtcccagcttctcgggaggctgaggcaggagaatggcgtgaacccgggaggcggagcttgcagtgagctgagatcgtgccactgcattccagcctgggcaagagagcaagacgctgtctcaaaaaaaaaaaaaaaaaaaaagagagaccaggtttcaccgcgttgcccaggcggatctggaactcctggctcaaacgatccgccgcgctcggccgtccaaattcttgggatcacaagcgtgagccactacgccaggccgatctattcctttctgattaataaattgggccgggagcggtggctcacacctgcaatcccagcaccccgggagaccaaggctggcgggtaacctgaggtcgggagtctgagaccagcctgacaaacatggagaaacctcgtctgtaccaacaaagaacaaaaacaaaaaatacaaaaaaactacaaaatgagccgggcattgtggctcacgcgtgcaatcccagccactccagaggctgagactggagaaccacccaaacccagaggcggaggccgctgggagctgagaccgggccactgcactccaagccgggcaacaagagcgaaactccacctcgaaaaaaaaaagaccgggtttcaccatgttgcccaggccagtctggaacacctaggctcatgagatccgcgcgccctcggccgtccgaagtcctgggatcacaagcgtgagccaccgtgccaggccgatctattcctttccgattaataaagtgggccaggcgtggtggatcacccctgcaatcccagcaccccggtggctcacgcctgcaacccgggaggccgaggcaggcagataacctgaggtcaggagtttgagaccagcctaaccaacagggagaaacccgtctgtaccaaaaaataaaaattaaaaatataaaaaaataaaaaacaaatgagccgggcatggtggctcatgcctgcaatccctgccactccggaggctgagggaaaaccacccaaaattgggaggcggaggccacagccagcaaaaaccatgccactgcgctccagcctgggcaacaagagcgaaactcccagtctcaaaaaaattaaaaagagaccgggtttcaccatgttgcccaggctggtctggaactcctaggctcaagcaatcttctgtgctcaagcgatcctccgcgctcggccgtccaaagtcctgggatcaaaagtgtgagccaccatgccagacccatcactcctgtaatcccagcactttgggaggccaaggcaggtggaccacctgaggtcaggagtttgtgaaggctcatctctactaaaaatacaaaaattagccaggtgtggtgtactgtgcctgtagtcccagctactcaggaggctgaggcaggggaatcacttgaacccaggaagcagaggttgcagtgagccgggatcccctgactgcactccagcctgggtagcagagctctgtctcaataataataataataataataatagtaataattgtgattgtatttagaaattattgaaataaattttttagctacatcagatcaatttgggttccttcttaaaacggccatttcatcttttggttcctgtattattttattgtattccttaaattccttgggttgggtttcaactttctcttgaatctcgataatcctcattcctattcctattctgaattgtgtgtctgtcatttcagccatttcagcttggttaagaatattgctggggaactagtgcagtcatttggaggtaggaagacactctggctttttgaattaccatagtttttacgctgattctttcccttatgtgtggggctgatgttcctttaatctttgaagttatttcctttggatgggtttttttgcttgtatatgtgatgccctttggggtttgattgtgatgtaaggtgggttcatttgactgattttgtttctggatcattttaggggggctaaggcttagctcagcactcctgggctaactgctctaactctggggcactggttttgggctcccagctttcttctctggccccttgatttaggaatttgccggactagaggggccaaggtgtttctggtccactgacccccaacactccaatggggggtgtcagccaaagtgtttcattggggcaatggcagtgggatttatgctcactcatgcatgtcagcagctgcagcagcacagtggggtgcatgcacattggctggggaggggcactggtgagagcagggcagcagcattcctgcacatgctctcacactggcagcagcatggcagggacagggaacttgtgggggcagggttgctggtgtccacgtgtgcattcataccagcaacagcagtggcatgatgcgggcaggattgccagtgtccgtgcatgcgtttgcactggtgattgcagtggtgtggaaggggcagggttgtcagtgtctgtgcacatgttcatactggcactggtgacatggcagagtgaccacacatccgcaggggtggagagcagcagggtgcactcatgccagtagcagtggcatggtgtaatacctgcacacacatgcaccagcatggtaggcaagatctgcccatgcgagtgtgctgacaaagcagtgggggaagaggccgtgggtacactggtgtgcatcagcagaggtcagtctgctggagcttccaaaaggttaggtgcagtccaccagcaagggagctgtgatgagggtccctgggaagcacgctgattgggcatccaaggctgtgctgcaagcaggcatggccaggctgggacctcaggagaggccagcagacaagggggcactcagatcagactgagcaagaccaagggcaagaccatcctgctctgtccaggtccaacagtcatgctaaggctaaaatctcccagaggagcatggcgaaccttgggggatggatgtcactggccatgctccactgtagccattcccatgccaaaaccctctgggctctgcacaggctggagtcctgcccctactacctgtctaggcagctcttcctgtcagctcagatgtctatgggggttgtggggtctcctgcagctaggattctggaggttcatggtgagagtaggccactcctcacctgttcagtttactccttccccaggagatgctaggagcaagcaacaagtcctggtgctcagaaaccccgtgtagggctcccagcatactcccccttcagtccagcatctgtgtcctccctctgtccactctcaacacttttgttctgaagagctgctcagagtgtgccagtctctctcaatatcccagtatctttgtgggagaatattcctcctggctgcatctactcagccatcttggctcctcctcaagaatttcataatacaatcaaaagcattagcagcagaataggccaagctaaagaaagaattacagagcatgatatggtttggatctgtgtccttgaatctcatgttgaatcgtaatccctaatgttggaggtgggtcctgatgggaaggtgatttgatcatgggagcactttctcatgaatggtttagcaccatctatcttggtactgtgctctcaatagtaagtgaattctcataaactctggttaaaagtgtatagcaccgctcccctcactgtctcttgctcctactctggccatgtgaagtacatgctctacctctgccttccgccatgaatggaagcttcctgagggcttcccagaagccaagcagatgccagcatcatgcttcctgtacagcctgtggaactgtgagccaattaaacctcttttcttcataaattacccagtctcagatatttctttatagcaatgcatgaatggactaatacagaaaattgatacctagaagtggaacattgctacaaagatacctgaaaatgtggaagcagctctggaactgggtaatgggcagaggttaggagagtgtggagggcacagaagaagagaggaagatgagggaaagtttggaacttcctagagactggttgaatggttgtgaccaaaatgctcataatgatatggacagtgaagtccagtctgatgaggtctcagatggaaatgaggaagttattgggaaatggagcaaaggtcacacttgtgacaccatagcaaagaacatgactgcattgtgtccataccccaaggattcatggaaggacaaacaagagtgatgacctagggtatctgtcgaaagaaatttttaagcagcaaagtgttcaagaagtggcatggctgggtttttttgtttgtttgttttttgttttgttttgttttgttttggggggggggttgagacagagtctcactctgtcacccaggctggaatgcagtgacaccatttcagctccctgcaacctccgcctcctggattcaagtgattctctgaccttagcctcctgagtagctgggactgcaggtgcacatcaccaggcctggctaatttttgtatttttagtagtgatgagttttcgctatgttggccaggctggccttgaactcctggcctcaagtgatctgcccaccttggcctcccaaagtgctgggattacaggcatgagccactgtgcccagtcagcagggctgctttttaacagcctatgaccagatttgacagtaagagaatgacttaaaggtggaatttataattaaaaaggaaataaaccattaaaatttggaaaatttccagccttgctatgtggtaggaaaggaaagagcattttcagacaaggaattcaagggggcagtggagcaatctcttgctagagacataggcagagacaaaagggagccaggtgctaatagtcaagacaatgcaggaaagccctagaggcattttagaaatcttcaaggacacctctctcatcacaggcccagaggtctagggggacagtatgtttttgggtgccaggccccaggtgccacagctttgtggcaccttggaatgctgctcccatatccaagccattctggctgtagccatagcccaaatagcctcaagtacagcttgggctgctgctccaaagggtgaaagtcataagccttggcagtttccacatgtgttaagtctgcaaaatgcaagtgtgggggaggcttggaagcttccacctaggtgtcagaggatgtgccaggaatccagggtgcccaggcagaaggctgctgcagggcagaacccccaaagagagactctactcaggcaatcctgagtggatagtgcggttgagggccccacaaaaaaaagcctatattagggcaatggctaatggagctgtgggaacagggatgccaccttccagacccaagaacagtagagccaccagcagtgtgcaccctcagcctggaaaagccaaagccattgaactccaacctgtgagagtagccaggtgggctgcacccagcaaagccatgggggtgggaatgcccaaggccttggggggaccacctcttgcaccatggtgcccaggatacagtacatggacccaaatattattttggagcttaaaggtttaatgccttcgccaataggtttcagtcttgcatggccaatttcagtcttgcaataaccctttcttttggccaatttctcacttttgaaataagaacgcttacccagtatatgtcttaccattctatcttaaaagcaaacaacttgtttttagttgtacaggcttacaggtgtaaaaacttgaccttgagtctcaaatcagactttagactttggacttatgagttgatgattggaacaagttaagcctttggggactattaggaaagggtgattatattttgcaatgtgagaagtacatatgatttggacggtctgaggcgaaatgataaagtttggatattcatcccctccaaatatcatgttgaaatttgtacccaatgtggaggtgggacctaataggaggtatttgtgtcatgaggacaaacccctcatgaatgtttgatgccatcctctctgtaatgagtgaattctcactcttaattcctatgagaactgaatgtttaaaagagcctggaactcccctccttgctctcttgcttctgcggtctcatcatgtgattctgcacacacggcaccccttcaccttccaccaggggtgaaagccccccaggagactcaccagatgcagatgcaggggacttgcttctcaggcaagctgcacaactgtaagctaaataaacctcttttctttatcaattacccagcctcaggtattcctttagagcaaaacaaaaacagactcagatagaaaatacataaaaagaaattaagaacaaatgtgagaaatttcattccaatagcatgttgtcaacactagattacagagtgctctacgtgttaaccatttccattctctgaaagtaatgagcacatgatgcacctctgaaaaaaattgtttagatttacctttttttctttttttttttgagatgagtctcactcagttgtccaggctggactgcagtggtgcaatctcagctcactgcagcctccacttcctgggttcaagcaattctccttcctcaccctccagagtagctgggactacaggtatgcaccaccacacccagctactttttgtatttttagtagagacagagtttcaccatgttggccaggctggtctcgaactccttgcctcaagcgatccatccacctcagccttccaaagtgctgtaattactggcatgagccaccgtgcctggcctagatttaccttttaaatgtgcttatgtaaatacctcataataacctctttggaacaataataagaaatatcattcaagagcatgttgtcaacactaaatttcagaattctctgaaataataataaataattccactctctgaaacaaaaaaaaaaacatatggtgcatctctaaagaaacttgtttcgatttaccttaaatattttatgtaaacactttataataagccataggaacaaatgtaagaattatcatcaatagcatgttaatcaacagtagatcacagagttctttaagtgctaaacattctcattctctgaaagaaaacagcacatgatgtacttcgccaaagcttgcttagatttacctttttttgttttgtttttgttttttgtttgttttttgagacatagtctcgctctgtcacccaggcttgagtgcagtggtgcaatcgtggctcactgcagcctcaacctcctgggctcaggtgatcctctcacctcagcctcctgaatagctggaattacaggcacatgccaccatgcctggataatttttttgcattttttgtagaggtgggattttgccatgttgtccatgtttgaactcctgggctcaagcagtccacccaccttggcctcccaatgtgctgggattacaggcatgagccaccatgcccagccagacttaccttttaaacacgccttgtaatacctcataataaatccttaggaacaaacgtaaaaaagaaaatcattcattagcatgttgtcaaaaagagacttttaaattttatatgttataaacaattccattctctgaaacaaaacagcacatgacgcatctctgaagaagcttgcttatatttatattttaagtatttatatgtaaacacctcataataactcctttggaacaaataagaaatattatttaacagcatgttatcaaaattaaatttcaggccaggcgcggtggctcaggcctgtaatcccagcactttgggagaccgaggaaggtggatcacttgatcccaggagttcaagactagcctgggcaatgtagcaagacctcaactctactaaaaataaaaaataaaatataaaaacattagcccaatgtggtggtacatgtctatgatcccagctacatgggaggctgagctgggagcctgggaggcaggcgctacagtaagccaagatagtgccactgtaattcagtctgggtgacagagtaagactttgccaaaaaaaaaaaaaaaaaaccactaaatttcagatatctctttgtgataaatagttcatttcctgaaagaaaccagcccatggtgcctttctgccatataccttttaaatgtgtatatgttaacacctcattataagccctcaggaaaagtatttcagtgtaagaaatatctttcaatagaatgttgccaacactacattacagagttctctatgtaataaagactttcatattctgaaaaaaaaatagcatgtaatgcatccctaaataagtttacttagatttaccttttaaacatgtatatgtaaatttgtaataactcatttggaacaaagataagaaatatcattcagtagcatgttattaacactatatttaagagctctttggctgggcgcagtggctgtaatcccagcactttgggaggctgaagtaagcagatcacttgaggtcaggagttcgagaccagcttggcctacatggtgaagccccatctctattaaaaatataaaaattagccgggcatggtggtgcgtgcctgtaatcccagctactcaggaggctgaggcaggagaatcacttgaatccggggggcagaggttgcagtgagccgagatcgcgccattgcactccagcctgggtgacaggatgagacaccgtctcagaaaaaaaaaagagttttttatatgttaatcaatttaattctctgaacaaaagcagcataatgcatttttggagaaactcatttatatttccctttaaacaagtatatgtaaatacctcccagtaacttctgtggagcaaggatcacaaacaccataaaatagcatgttgtcaacactagattcccagttctctgtgtaataaatacttctctgggggaaaaaataaattatgcatctttgaagaagcttccttagatttagcttttaaatgcacatatgtaaacacctcacaataacattttcagaataatgataatatcattcaagaacatgttgttgagactacatttcagagttgtccatgtaataccaaatctgttctctaaaacaaaacagggcacaatacatctctgatgaagtttgcttagcttaccgtttaaacatgtatacataaacaccacttaataagcctgtagcaactcaaatgagaaatattattcaataacatgtttcaacactagactacatagtctttatgtgttaagcaattccattctctgatagaaaacaccataggatgcatctcttaagcagcttggttaaatttacattttaaatgagtatatgtaaataccttacaataacctcttattgtagaaacaaaggtgtgatatatcactcaatagcatgttgttaacactagattacagagtttttagcaattaagcactttcattctctgaaagaaaactgcaaatgagcagctctgaagaaggctgcttagatttgcctcccaaacaagcgtttgtaatcatttcattataagatttagggaacaaatactagaaatatcattcaatagcatgttcccaacactaggttacagagttctgtatttgttaaacagttccaatttctgaaagaaaacagcacaaaatgcctctctaaagaagcttgtgaagatttacctcttaaccgtgtttatgtaaacccatcatcataagccattgtgaacaaaggtaagaactatcattcaatagcattttctccacactagattacagaattctgtatttgttaaacagttccaatttctgaaagaatataccacataatccatctctctttttttttttttttttttttttttgagatgtagtctcactctgttgcccaggctggagtgcagtggcgtgatctctgctcactgcaagctccgcctcccaggttcacgccattctcctgcctcagcctcctgagtagctgcgactacaggcgcccgccaccacgcccggctaatttttttgtatttttagtagagacagggtttcacc[138 bp omitted]tttaaacaagtatatgtaaagttggcataacaagctcttatgaacaaaagtaagatagtgttgctattgaacaatgtttaacaatattaaattctcaacattagattggagttctctgttaaaagttccattttctgaaagaaaacagcaaataatgcatttctgaagaagcttgcttagaggagggaggtggaaccaggtggtaaatggaaccctccagttgctatctccccaacagggacaccaaattcaacaactatctacccaagaaagcaacttcgtaagaatcaaaaaattaaatgagtgacaacagtacctggtttgaacataatataacataaaggcacattgaagagggtaggaaggacaatgttacattgcctacaccactaccaccaccaacaaccccaggcatcacagtatggagaaacaatctgtgtgtttgtgggagacagagtgaaatgagcatggaacttcacattggaaatcagtgcttttctgtcgcaatggagcacaacactggacagaaacccctgatgcccacagagggaacacttaaaccagccccaggccagagaggaatcctccactccaataggaggaacccaagtcccagcttgcttcaccacagcctggctaaaatggcctgggtactgagtaaatttgagtgactgccagcccacagtgactgcatccttggccaagcagatgtgctgcactcatttcagaggctgtgaacttgtggtgtgacccagcataacaccagctacagcagccatgggaatgctcgcataaccccttgcccaactgcaggcagtttgtcatggagagactccttcatcttgggggaaggagagggaagagtaaagaagactgtgccttccaagtgggtactgacagagcaggagcattgccatcttggacaagctcctgattctaatttttattctgatttctaccttggtaaaaaactgcctcagtccaaagggcatcagcctaatggctaaggtcagcacgaccataaaccacaaataacatctccaaccagaaacattccaaactcctccccgaccagagacatgctagccccaagataacccccctccgccaggaagatgccagcctcgagataacccccctctggccggaaagatgtctgccccaagataatttgatgaggaattcaaataactgtcttgaggaagctcaatgaatttcaagataacacaaagaagaaacttagaattctatcaaaaaaagagaaatgaaaataatttttaaaaaatcaaattccagagacaagtttttttgtttgttgttttgttgttgttgttgttgttttctttgagacagagtcccactctgtcacccaggccggagtgcagtggtatgatcccagagactaaaaattcaattagcaaactgaaaaatgcatcagaatgcctccagaattgatcaagcaaaggaataaattattgagctcaaagataggctatttgaaaatacacagagcagaaaataaaagaataaagtatgcttactcttatatttgcccttttaaggctatctagaaaacagccttaaaaggacaaatataagagttattaaccttaaagaggatggagaaagagatttgggtagaaggtttattcaggcaaataacatgtaacttttcaaacctagaaaaagatagtaatatccacatagaagaaggttaaaaaaaaaaagcacacaccaaaaagattcaagctaaataagactccctcaaggcctataataatcaaactctcaaaggtcaaggacaaaaaaaggatcctaaaaacagtaacagaaagaagcaaataacatataaagaagctccaatgtatctggttgtagactgctcagtggaaactgtacaagcccggagagagtggaatgacatatacaaagtcctgagtggaacaacttctaacataaaatactgtatccaacgaagttatccttcaaacaccaaggagaaataaaagcttttccagacaaacaaaagctaaggaaattcatcaatgctagatcaattttacaagaaatgctaaaggtacttcattctgaaagtaaaggatgctaatatgcaacaagaaatcatcagaaagaacaaaacctgctgatgaaagtgagtatacctaatactctaatattgtaattggagagtataaatcactcatgtcacgttgggaggctgaggtgggtgaatcacttgaactcaggagttcaagaccagctggccaacatggcaaaaccccatctttactaaaaatacaaaaagtagctgggtatggtggtgcgtgcctgtaatcccagctactcaggtgcctgaggcacaagatcacttgaatcctggaggtggaggttgcagtgaatcaagatcacaccactgtgctccaacctggatgacaaagccagactctgtctcagaaaaaaaaaaaaatcacttggccaggcgtggtggctcacacatgtaatcccaacactttgggaggccgaagcgggtggatcacaaggtcaggagatcgagaccatcctggctaacacggtgaaaccctgtctctactaaaaatacaaaaaattatccaagcatggtggtggggacctgtagtcccagctactcgggaggctgaggcaggagaatggtgtgaacccgggaggcggagctggcagtgagccgagattgcaccactgcattccagcctgggtgacagagcaagactctgtctcaaaaaaaaaaaaaaaatcactcatatcgttagtgtgaagactaaaagacaaacccatcaaaaataatcataagtaaaacaattgtgaagatacaaaaaatataaaaatagaaacaagaaaaagtcaacaagcagcagtgacaaagttaatttttctttcttttttcttttctatgtgatcagagttgagttgtcatcagtttaaaagaactgatgatgttttttgcaaacctcatggtaatcaccaaggaaaaacctataatagatacacaaaaattaaaaagcaagaaatcaaaatatgctaccagagaatatcacttctacaaaaaggaagaccaggagaaaggaaggactaataaaacaaccagaaaacaagtaacaaaatggcattaataacctatcaataataacattgaatttaaataggctatattctccaataaaaagacgtagagtggctgaatgtattttaaaaacaagactcactatatgttgcctataagaaactcatttcggctgggcacaatggctcacgcctgtaatcccagcacttttgggaggctgaggcaggcagatcacttgagttcaggagttcaagaccaccctggccaacatggtgaaactgcgtctctactaaaaatacaaaaaaattagccatgagtggtgcaggtgcctgtaatcccagctacttgggagactgaggcaggagaatcgcttgaacccaggaagtggaggttgtagtgagccaagaccgtgtcattacactccagcctgggcaatgagaaagaaattctgtcaaaaaaaaaaaaaaaaggaaagaaactcacttcacccataaagatacacacagactgaaaaggaagggatgaaaatagatattccatgcaaatggaaacaaaaaagcaagagtcactgtatttatatcagataaagtttctgatataagacgtttcaagacaaaacagtaaaaaaaaaagacaaaaacggttattatatgaggatgaagtggttaactcagcaagaggatataacaatggtaaacatatatgggcccaacactggagcagccagatgtataaagcaaatattattacagctaaagagagagatagtcctcagtaccataatagctggagacttcaacaacctactttcagcactggacagaacttccaggcagaaaatcaacatagaaacatctgacttaatctgcgctagagaccaaatggatctaacagatatttacagaacatttcatctaacagctgcagaatacacattcttattagcacatggaacattctccagaacagaccataccttaggccacaaaaaaagtctcagaaaatttgaaaaaatcaaaattatatcagttgtcttctgtgaccacaatagaataaaactagaaatcaacaacaagaggaacttgggaaactattcaaatacatagaaattaaataacatgctcctgaataccattgctcaatgaagcaactaagacagaaattttaaagtttcttgaaactgtaaaaaattgaaatacaacgtaccaaaacctatgaagtatatcaaaagcagtactaagaaggaagcttatactaataaatgcctatgttagaagagtaaaggctaggcacagtggctcatgcctgtaatcccagcacttcgggaagccaaagcaggtggattgcttgagctcaggagtttgagacaagcctgagcaacatgatgaaaccccgtttctaccaaaaatccaaaaaaaaaaaaaaaaaaaaaaaaaagctgagtgtggtggcacatgcctagagtcccaactacgcaggaggctgaggtgggaggatggcatgagcttgggaggcagaggttgcagtaagccgagatcacgccactacactccagcctgagtgacagagccagaccctgtctcaaaaaaaaaaaaaaaagagagagagagagtaaaaagacttcagacaaccaaatgatgcaccaccttaaagaattagaaaagcaatagcaaatcaaacctaaaattaagagaagacaataaataataaagatcagagcagaaatcaaattgaaacaaaaaatacaaaagatcacaaaacaaaaagtcggtttttggaaagataaacaaaattgacaaactcttttgacagactaagaaaaaagagaagactcaaataaattaaatcagagagatgacattacaactgatatcactgaaattcaaaatatctttagagactactatgagcaactattatacatgccaaaaaattggaaaaggcagaggaaattgataaattcctagacacataccacctaccaggatttaaacatgaagaaatggaaagcatgaatacaccaataacatacagtgagataggggcagtgctgaaaagtctcccatcaaagaaaagctaagtacctcatggcttcactgctgaatttgccaaatatctaaagaacaactaataccaattctactcaaactaccccaaaaaatataaaagaaggaaatacacctaaactcattctacaagtccagcattatcctgatacaaaaaccagacaaacaaaaaagaaaactacaggccaatatttctgatgaatgtagatacaaaaatcctcagtgaaatactagcatcccaaattcaagaacacattaaaaagatcattcattttgatcaagtgggatgcatccccgggatgcaaagatggttcagcatatgcaaatcaataaacgtggcacaatgcatcaaaagaatgcaggacaaaaaccataaattatttcaatagatgcttttaaacattcaataaaattccacatcctgtcatgagaaaaaccctgaacaaactgtgtataggaagaacataataaatgtcatataaaataaactcacagctagtattatactaaatgggaaaaaaaaccgaaagccttttctctgatctggaacaaaacaaggatactcattttccccacttattcaacatagtactcaaagttttaaccagagcaattagacaacagaaagaaacaaacagcatgaataatggaaagtcaaattgtcattgttagtagatgatgtgaccttatatttaaacaaacctaaagattcttccaaacaactgtcagaattcataaatgaattcagtaaagttccaggatacggccgggcgcggtggctcatgcctgtaatcccagcattttcggaggctgaggtggatggatcactagaggtaaggagtagagaccagccttgccaacatggcgaaaccccgtctctactaaaaattcaaaaattagggtggcgtggtggtacacaccaggtgtggttatgaagtcccccagcacctatggccaggtggggttgtgatggcctccagcacctctggccaggtggggttatgaactcccccagcacctctggccaggtggggttatgatgtccccgagcaccactggccaggtgcggttatgatatcccccagcacctctggccaggtgcagttatgaagtcccccagcacctctggccaggcgcggttatgaagtccccccggcacctatggccaggcgtggttatgaagtccccccggcacctctggccaggcgtggttatgaagtccccccggcacctctggccaggtggggttatgatggccccccccggcacctccggccaggtggggttatgatggcccccccgggacctctggccaggtgtggttatgaagtccccaagcacctctggccaggtggggttatgatgtcccccagcacctctggccaggtgtggttatgatgtcccccagcacctctggccaggtggggttatgatgtcccccagcacctctggccaggtgtggttatgaagtccgcccagcacctctggccaggtgtggttatgaagtcctcctggcacctctggacaggtgtggttatgaagtcctccgggcacctctggccaggtgtgtttatgaagtcctcctggcacctctggccaggtgtggttatgatgtccccccggcacctctgcccaggtgtggttatgatgtcccaccggcacctctggccaggtgtagttatgaagtcccctggcacctctggccaggtggggttatgaagtcccaccggcacctctggccaggtgtggttatgatgtccccccggcacctctggccaggtgtggttatgaagtcccctcccagcacctctggccaggtggggatataatacccacccccagcacctctggccaggtgtggttatgatgtccccccggcacctctggccaggtgtggttatgaagtcctccgggcacctctggccaggtgtggttatgatgtccccccggcacctctggccaggtgtggttatgatgtccccccggcacctctggccaggtgtggttatgatgtccccccagcacctctggccaggtggggttatgaagtacccccggcacctctggccaggtagggttatgaagtcccactggcacctctggccaggtgtggttatgatgtccccccggcaagtctggccaggtgtggttatgaagtccccccaccagcacctctggccaggtggggatataatacccacccccagcacctctggccaggtgaggttatgatgtccccgcagcacctctggccaggtgtggttatgaagtcctcccggcacctctggccaggtggggttatgaagtccccccggcacctctggccaggtgacatttatgaagtcacccccagcacctctgctcaggtggggttatgaagttccccccgccccccagcacctccggccgggtggggttattatggccccccagcatctctggccaggtgggattatgatatcccctagcacctctggccaggtgaggttatgatgtccccccagcacctctggccaggtggggttatgaaatcccccgcagcacctctggccaggtgacatttatgaagtcacccccagcacctctggccaggtggggttaagaagttccccccgccccccagcacctctggccaggtggggttatgatggccccccaggacctccggccagattgggttatgatggccccacagcacctctggccaggtgggattatgataccccccagcacctctggccaggtggggttataatacacccccacagcacctctagccaggtgaggttatgatgtccccccagcacctctggccaggtggggttatgaaatctcccccagcacctatggccagctgtggttatgaaatcccccccagcacctctggccaggtgacatttatgaagtcaccaccagcacctctggccaggtggggttatgaagttccccccgcctcccagcacctccggccaggtggggttatgatgtccccccaacatctctggccaggtgggattatgatatccccctagcacctctggccaggtgaggttaagatgtccccccagcacctctggccaggttaggttatgaaatccccccagcacctctggccaggtgacatttatgaagtcacccccagcacctctggccgggtggggttatgaagttccccccgccccccagcacctccggccagctggggttatgatggccccacagcaccactggctaggtggggttatgatgtccccccagcatctctggccaggtgggattatgataccccccagcacctctggccaggtgaggttatgatatccccccagcacctctggccaggtggggttatgaaatctcccccagcacctctggccaggtgacatttatgaagtcacacccagcacctctggccaggtggggttaagaagttccccccaacccccagcacctccggccagctggggttatgatggccccacagcacctctggccaggtggggttatgatgtccccccagcatctctggccaggtcagattatgataccccccagcacctctggccaggtgaggttatgatgtccccccagcacccctggccaggtggggttatgaaatccccccaagcacctctggccaggtgacatttatgaagtcaaccccagcacctctggccaggtggggttatgatggccccacagcacctctggccaggtggggttatgatggccccccagcatctctggccaggtgggattatgataccccctaccacctctggccaggtgaggttatgatgtccccccagcacctctggccaggtggggttatgaaatctcccccagcacctatggccagctgtggttatgaaatcccccccagcacctctggccaggtgacatttatgaagtcaccaccagcacctctggccaggtggggttatgaatttccccccgcctcccagcacctccggccaggtggggttatgatgtccccccagcatctctggccaggtgggattgtgatatccccctagcgcctctggccaggtgaggttaagatgtccccccagcacctctggccaggttaggttatgaaatccccccagcacctctggccagatgacatttaggaagtcacccccagcacctctggccgggtggggttatgaagttccccccgccccccagcacctccggccagctggggttatgatggccacacagcacctctggccaggtggggttatgatgtccccccagcatctctggccaggtcagattatgataccccccagcacctctggccaggtgaggttatgatgtccccccagcacccctggccaggtggggttatgaaatcccccccagcacctctggccaggtgacatttatgaagtcacctccagcacctctggccgggtggggttatgatggccccacagcacctctggccaggtggagttatgatggccccccagcatctctggccaggtgggattatgataccccctagcacctctggccaggtgaggttatgatgtccccccagcacctctggccaggtggggttatgaaatcccccgaagcacctctggccaggtgacatttatgaagtcacccccagcacctctggccaggtggggttatgaagttccccccgcccctcggcacctccggccaggtggggttatgatgtccccccagcatctctggccaggtgggattatgataccccccagcacctctggccaggtgaagttatgatgtcccctcagcacctctggccaggtggggttatgaagtcctcctggcacctctggccgggtgtggttatgaagtcccccccagcacctctggccaggtggggttatgaaatcccctccagcacctctggccaggtgacatttatgaagttacccccagcacctctggccgggtggggttacgaaattccccctgcccccagcacctccggccagctggggttatgatggccccacagcacctctggccaggtggggttatgatgtacccccagcatctctggccaggtgggattatgataccccccagcacctctggccaggtgaggttatgatgtcccccagcacctctggccaggtggggttatgaagtcctcccggcacctctggccaggtgacatttatgaagtcacccccagcacctctggccaggtggggttatgatggccccacagcaccgctggccaggtggggttatgatggccccccagcatctctggccaggtgtgattatgatatcccctagcacctctggccaggtgaggttatgatgtccccccagcacctctggccaggtggggttatgaaatcccccgcagcacctctggccaggtgacatttatgaagtcacccccagcaactctggccaggtggggttatgaagttccccccgccccccggcacctccggccagctggggttatgatggccccacagcacctctggccaagtgggattatgacccccccagcacctctggccaggtggggttataatacccccccacagcacctctggccaggtgaggttatgatgtccccccagcacctctggccaggtgtggttatgaagtcctcctggcacctctggccaggtgtgattatgaagtcccactagcacctctggccaggtggggttatgaaatctcccccagcacctctggccagctgtggttatgaaatcccccccagcacctctggcctggtgacatttatgaagtcacccccagcacctccggccaggtagggttaggaagttccccccgccccccagcacctccggccaggtggggttatgatgtccccccagcatctctggccaggtgggattatgatatccccctagcacctctggccaggtgaggttatgatgtccccccagcacctctggccaggttgggttatgaaatccccccagcacctctggccaggtgacatttatgaagtcacccccagcacctctggccaggtggggttatgaagttccccccgccccccagcacctctggcaggtggggttatgatgtccccccagcatctctggccaggtgggattatgataccccccagcacctctggccaggtgaagttatgatgtccccccagcacctctggccaggtggggttatgaagtcctcccggcacctctggccaggtgtggttatgaagtcccccgcagcacctctagccaggtggggttatgaaatccccccagcacctctggccaggtgacatttatgaagtcacacccagcacctctggccgggtggggttatgaaattccccctgcccccagcacctccggccagctggggttatgatggccccacagcacctctggccaggtggggttatgatgtccccccagcatctctggccaggtgggattataataccccccagcacctctggccaggtgaggttatgatgtcccccagcacctctggccaggtgtggttatgaagtccgcccagcacctctggccaggtgtggttatgaagtcctcccggcacctctggacaggtggggttatgaagtcctccgggcacctctggccaggtgtggttatgaagtcctctgggcacctctggccaggtgtggttatgttgtcccccggcacctctggccaggtgttgttatgatgtccccccggcacctctggccaggtgtggttatgaagtccccccggcacctctgaccaggtggggttatgaagtcccacaggcacctctggccaagtgtggttatgacgtcccccccagcacctctggccaggtggggatataatacccacccccagcacctctggccaggtgaggttatgatgtccccccggcacctctggccaggtgtggttatgatgtccccccagcatctctggccaggtgggattatgatatccccctagcgcctctggccaggtgaggttaagatatccccccagcacctctggccaggttaggttatgaaatccccccagcacctctggccaggtgacatttatgaagtcacccccagcacctctggccgggtggggttatgaagttccccccgccccccagcacctccggccagctggggttatgatggccccacagcacctctggccaagtggggttatgatgtccccccagcatctctggccaggtcggattatgataccccccagcacctctggccaggtgaggttatgatgtccccctagcacctctggccaggtggggttatgaaatcccccccagcacctctggccaggtgacatttatgaagtcacccccagcacctctggccaggtggggttaagaagctcccccagcccccagcacttccggccagctggggttatgatggccccacagcacctctggccaggtggggttatgatgaccccccagcacctctggccaggtgaggttatgatgtccccccagcacccctggccaggtggggttatgaaatcccccccagcacctctggccaggtgacatttatgaagtcacccccagcacctctggccaggtggggttatgatggccccacagcaccgctggccaggtggggttatgatggccccccagcatctctggccaggtgtgattatgatatcccctagcacctctggccaggtgaggttatgatgtccccccagcacctctggccaggtggggttatgaaatcccccgcagcacctctggccaggtgacatttatgaagtcacccccagcaactctggccaggtggggttatgaagttccccccgccccccggcacctccggccagctggggttatgatggccccacagcacctctggccaagtgggattatgacccccccagcacctctggccaggtggggttataatacccccccacagcacctctggccaggtgaggttatgatgtccccccagcacctctggccaggtgtggttatgaagtcctcctggcacctctggccaggtgtgattatgaagtcccactagcacctctggccaggtggggttatgaaatctcccccagcacctctggccagctgtggttatgaaatcccccccagcacctctggcctggtgacatttatgaagtcacccccagcacctccggccaggtagggttaggaagttccccccgccccccagcacctccggccaggtggggttatgatgtccccccagcatctctggccaggtgggattatgatatccccctagcacctctggccaggtgaggttatgatgtccccccagcacctctggccaggttgggttatgaaatccccccagcacctctggccaggtgacatttatgaagtcacccccagcacctctggccaggtggggttatgaagttccccccgccccccagcacctctggcaggtggggttatgatgtccccccagcatctctggccaggtgggattatgataccccccagcacctctggccaggtgaagttatgatgtccccccagcacctctggccaggtggggttatgaagtcccccaggacctctggccaggtggggttatgaagtcccccccagcacctctggccaggtggggttatgaaatcccctccagcacctctggccaggtgacatttatgaagtcacccctagcacctctgtccgggtagggttatgaaattccccctgcccccagcacctccggccagctggggttatgatggccccacagcacctctggccaggtggggttatgatgtccccccagcatctctggccaggtgggattatgataccccccagcacctctggccaggtgaggttatgatgtcccccagcacctctggccaggtggggttatgaagtcctcccggcacctctggccaggtgtggttatgaagtcccccgcagcacctctggccaggtggggttatgaaatcccccccagcacctctggccaggtgacagttatgaagtcacccccagcacctctggccaggtggggttatgaagttccccccgccccccagcacctccggccaagtggggttatgatggccccagagcacctctggccaggtgggattatgatgtcccccagcacctctggccaggtggggttatgatgtcccccctggcacctctggccaggtggggttatgatgtcccccagcacctctggccaggtggggttatgaagtcccaccggcacctctggccaagtgtggttatgacgtcccccccagcacctctggccaggtggggatataatacccacccccagcacctctggccaggtgaggttatgatgtccccccggcacctctggccaggtgtggttatgatgtccccccggtacctctggccaggtgtggttatgaagtccccccggcacctctggccaggtggggttatgaagtcccaccggcacctctggccaggtgtggttatgatgcccccccggcacctctggccaggtgtggttatgaagtcctcccggcacctctggccaggtggggttatgaagtccccccggcacctctggccaggtggggttatgaaatcccccccagcacctctcgccaggtgacattttgaagtcacccccagcacctctggccaggtggggttaagaagttccccccgccgcccagcacctctggccaggtggggttatgatggcccaccaggacctcctgccagctggggttatgatggccccacagcacctctgtcgaggtaggattatgataccccccagcacctctggccaggtggggttataatacccccccacagcacctctggccaggtgaggttatgatgtccccccagcacctctggccaggtgtggttatgaagtcctcctggcacctctggccaggtgtggttatgaagtccccccagcacctctggccaggtggggttatgaaatctcccccagcacctatggccagctgtggttatgaaatcccccccagcacctctggccaggtgacatttatgaagtcaccaccagcacctctggccaggtggggttatgaagttccccccgccccccagcacctccggccaggtggggttatgatgtccccccagcatctctggccaggtgggattatgatatccccctagcacctctggccaggtgaggttaagatgtccccccagcacctctggccaggttgggttatgaaatccccccagcacctctggccaggtgacatttatgaagtcacccccagcacctctggccgggtggggttatgaagttccccccgctccccagcacctccggccagctggggttatgatggccccacagcacctctggccaagtggggttatgatgtccccccagcatctctggccaggtgggattatgataccccccagcacctctggccaggtgaggttatgatgtccccccagcacctctggccaggtggggttatgaaatcccccccagcacctctggccaggtgacatttatgaagtcacccccagcacctctggccaggtggggttaagaagttccccccgccccccagcacctccggccagctggggttatgatggccccacaacacctctggccaggtggggttatgatgtccccccagcatctctggccaggtcagattatgataccccccagcacctctggccaggtgaggttatgatgtccccccagcacccctggtcaggtggggttatgaaatcccccccagcacctctggccaggtgacatttatgaagtcacccccagcacctctggccaggtggggttacgaagttccccccgccccccagcacctccggccaggtggggttatgatggccccacagcacctctggccaggtggggttatgatggccccccagcatctctggccaggtgggattatgataccccctagcacctctggccaggtgaggttatgatgtccccccagcacctctggccaggtggggttatgaagttccccccgccccccggcacctccggccagctggggttatgatgtccccccagaatctctggccaggtgggattatgatatccccctagcacctctggccaggtgaggttaagatgtccccccagcacctctggccaggttgggttatgatggccccacagcacctctggccaggtgggattatgataccccctagcacctctgagcaggtgaggttatgatgtccccccagcacctctgtccaggtgtggttatgaagtcctcccggcacctctggctaggtgtggttatgaagtccccccagcacctctggctaggtggggttatgaaatctcccccaccacctctggccaggtgacatttatgaagttccccccctcagcacctctggccaggtggggtcatgaagtcccccaagccgcccctgaggaacaggcgaggcaagggccagcaggcactactagcgggtcgggacagctgcttcgctgatgctggttgtgtagcatggatgtgtgtagcgtgactgtgttgtgtggatggggcacggaaatccgcagagaccatcactggagggagaagctgcagggccgggagggttcagcaggtaagcagttcagggttcctggaaaggcgggtcccaatgcatttgctgaccgggcacctaacgggctgctctcaaaatcactgactgtcaccgaggccggccagagacccttatgtatctgattcacgatgacaccagctaactctgagtacagtagaaaacgtaccgtcgggcaaccagaaaatgcgcactccagtccccaccacgggacagcgccaggcagtaccctccacagccggagctcgaactgtcgcgagaatagcggtcggcttggaagtcgcccggcgcgggagcgcgaactctcgcgagaatgccgccagctccggaggcgactgcggcaggagcccgagctctcgcgcgacaggcaccaattcgttagacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcaggtgtggggcacggcgcgcgggcgggttcccggccacagcccggagcccgcgcgtgggtcccgcacagcccggggtcggggcgcgctggggcagggcatggggcggaggcgggcgcggcctcagggagccttcgcaggccctgccaccgcctgctccccgccggccagcgctctcggcgcggtgccctgcgcaccacagggcgtgttacccgggacgcgtcctgatcgtcacggggaaagcgtgaactgggtttcttgccggccggcgcgcgcgcctgcaaccccagcgctctgggaggcccaggcgggactccaggccagcttgggcaacgtagcaactccatgtttataattttttttttttttaaattaaagagattgtattctcactgactcctgctccctggtcagcccagtgtaagatctctcaccctgctctcctttttccaaaacgcgtgtcatgacactgatttaacctgtcattactgtctcctccacttccactccagctagaatgctgcatctctgcacagctcctggcacgtagcacgctgagtcacctaatacaatttctaatgcagtttctcttgtaactaatttttaaagacttacagaatttagatatttacgtaaagtgagatctcctatttttctttatgggagatgtaaattaatacttttagagtcattacccataatgaaattattactaaaaaaatgttaatgttaatattctacctgtttaatttcagtaaaaatcttcttgaataatgaacagtttttcaaaatccgtaatcttagttaccttaatgatcatagccataaagtgtctagttggcttataataggaatacggggctttcagattcttttaaaccatgccaagtttctgaagtaataaactgaattcttaagtgtaacttataaaaataaacaatgtgtgaaataggttatacaatacagaaacttaaatgctgaaatccaagttatttttctactaatatttctaaatgacagtaggcagattgtcatcattttagagctgggagagacgttggaggttactattttcattcacagatttcaggaactaaattataataggtaaagtggtgttccattcacccatttactggcctagaatcatgtgtttttcagtagtgtaattttatttaagtacagattgctcgctttgatactaaaaaatggaaaacattttttgcataggctatgctatgtacatatacattagttgcataggctgtgctgtaattttatgatgctttaaaccat[132 bp omitted]gctaacacggtgaaacccggtctctactaaaagtacaaaaaattagccgggcgtggtggcaggcgcctgtagtcccagctacttgggaggctgaggcaggagaatggcgcgaacccaggaggcggagcttgcactgagcaagctcacttttctctaactgaaaagtagcatctccttctattatgaatgaaggcagcaaaccatagcagtattagcctacctatgactttatcaccagtagaaatcgcatactgttttcacatcagagttgtagatatttgtaaatgttgtttactgttactttaatggtagttaattggacctactgctaaatcttgttatttaatactttcataaataacatttcttgccatatcttaaacttctttaaatatttgacaactgtatctcagtataatgggattcctttgtatttattttttggctttaaaaatgttattcagagaaggggtccttaggcttcaccgggcctcactatggcataaaaaggttgggaccacctgatgtagaatgtgttcagctggacttaggtacaggggcttatgggaagacagaggagccagaggacaaggttgggagggtcaggaagaacctgtgtgctggagaaaggatgcttgcacagtctcggacacggtgattatttgcctgcctgatggtggaggtaacggaggacaaggtacactccattctggaaatgtgtagctgagtacagagcatatgggggatatggagggccatgagatgagttcacttacctgtgtgacagagttggcataagaattgcattttgtctttaatagatttcatcgtttcttggatgtcaacagccacaaaatagaaaaaacaatcgaagggtaagtcagtgtgtatatatacgcatccagaaatatatgtattttcttatagatctttttaagatagctttataatcttttcttatattttagaatttatgaaaaatttgtcattcattctgatctaagcaaagctgctagttggaagagattaacggaggaatttctaaatgcaccacttcccagtataaaggaaataaaggtatgccttcaattatgagatctccactgtgtattttactgtttcctatctgattatcgtcaatttgtttcagttactgtttaaacattctattttagtattatctactggctaacgggatctcttggaaatttacttaaatattgccatcaaaccagatatgcctcagtttgtgatgaaagaaagagcttgtttttaatcattttttcacctcagtcctactaaggaaagagagatcagagattgatacaaatagtagcattgtttgggtatctcaaaactttcaaatggtttctcagcacttggcagtgactgtctgtagatgcttactagatgcctggtatactttcatattgtttgggggattccccaagaccaccttttggcataatgatttgctcaaaggattcacagaacttaaaaaaaaaaagctgttatcctcactgttaatagtttattacagtgaaaggatacagattaaaatcaccaaagggaaaaggtgcttagagcaaagtctaggagaagctaggcacgcatgtccaaatgttccttcctagtggagtcacctggggatgcagttaattctctcagtaacagtatatgacaacatgtgcaaagtattaccctccactccccccagggccactcggctgagccttggtgaccagcatttttattgggggtgggtcacataagcaagcagagcccacatggctgaccttagctgctgagtctgtagccccctagaggtcaaaccaaggatggcaagcgtatggaaacagctgtgggttccctgaacacggtgggaccacattccctagctctgctgtgacacatcttgtgcctacatagttctttccctttctcctgcctgaggaagctcacgttttaatattaaactcaggcactgtctccacacatgctatgtatttcaattctttatagttcctttcttgtctccccctttaaaaggcacattttacaggcatagggctctgtgtctgatttgttcccggacacctagagcacagtggacagtgcatgtttgttgagggaatcagtaaggctgtgcagtcttgtctgcttcactatcccctctgtgtccacagcccccacccacttacacaaggtgggattggttatccttttctcttgctgtgtggcatcttggatgtgtttgttatggcagaggtccccaacccccacatggtggacgagtaccaatatgtgcctgctaggaacagggctccatggcaggaggtgcagtggggtgagtgaggatgactgcctgagctccacctcctgtcagatcagcggtggcattagattctcataggagagcaaaccccattgtgaactgcacatttgagggatctaggttgcatgctccttatgacaatctaatgcctaatgatctgaggtggaacagtttcatccttgaaaccaacccccacccaacagtccatggaaaaattgtcttccacaaaaccagtccctggtgccaaaacggttggggattgctgtgtggtgtagcaataacttcacactttttttcttttttttttttaagactgagtgtcactttgtcacccaggcttggagtgcagtggtgcagtctcgactcattgcaacccccacttcccagattcaagtgattctcctgcctcagcctcccgagtagctgggattacaggtgcccaccaccatgcccagctaattttttgtatttttagtagagacagggtttcaccatgttggccaggctggtcccgaactcttgacctcaagcaatccacctgccttggcctcccaaagtgctgggattacaggcatgagccaccatgccgagcttctttattatccttttaatgtctgtgggatcagtagtgatgacccctctttattttctgattttagtaatgtatgtatactctctttttttttgtggttagtatgtctagagatttattaatgttattaatctcttcagcgaatcagtttttggttttgccatttttattattgttcctgttttcaatgtctttttgtttgtttgtttttttgttttttgagacggaatcttgctctgttgcccaggctggaatgcaatggtgcaatctcagctcactgcagcctcagcctcccaagtaactgggattacaagcgtacaccaccccgcccggctaatttttgtatttttagtagagatgaggtttcgccatgttggccagggtagtgtcgaactcctgacctcaagtgatctgcccaccttggttccaaaagtgctgggattacaggcgtgagccaccccggcctgctctgttgatatattttcaagctcatgccagtctactgggtgagcccatcaaaagcattcttcatttctgacactttatttttcattggaacacttcgattctttgagtttccatctcaccacttatatttctgatctgttcttccttgttatccacatttttcattagcactcttagcatattaatcatagttgttttcaattcccgggctgataattccaacatccctgccatatttgagtctggtttggatgcttgctctgtctcttctgacatactgtcaggtggccagtgttgtctacctggacacctgagcccaggactctggggcttttattgggggcttatctcttaggcataggacctgtgtgactgaccacaattactgaagttccagagccttcaaaggaaagcaggtgttcaccttcagtcacactgtttgcgcaaactatctaaacagactagtacaacatggttcaagatctgagcatacagaacacatttgccagttcagatatttcaagagctcagttaccacaagctggccaaggcttattcatgaaaataagcccttttgggggatgctgaaggctttggcaattcaggcttgctgagttaatgcattcccacacagctaatatcccaatttaaaaatcaatcatataaataagaaaagactggcaatcaaatagaaacttgaacagaggagagtaatacccaataaaggaaaatcagtaattttaagcttatggaaaagtgcctaccatttcataagataagataaatgcaaattaaagcaacactgagagaatgtttttcaccgatctgattaataaaaggtgtgggaaacaggtaattctatgcgtatgtatatttgtattacctgtatggaatatattttggcattatttctcaaaattccaaatgcaaacactctttgacttagtgtttcactttttaggaatttattatacagataaactcttataattatgaaacaacagccaagtgtggtggcccatgcctgtaatcccagtactttgggaggccaaggtgggcggatcatgaggtcaggagttggagaccatcctggccaacatggtgaaaccccatctctactaaaaatacaaaagttacccgggcgtggtggtgcgtacctgtaatcccagctactcgggaggctgagacaggagaatcacttgaaccaggggaggctgaggttgcggtgagctgagattgcactattgcactccagcctgggcgacagagcgaaaatccatctcggggggaaaaaaaatatgaaacaacataagtttgtgatagcaaaagattgggaaaaaatctaaatttcattaataggggactggttaaataaaatatgatacatcttagttaaactatcaggcatgtttaaccttcatgatacatattgccacaggagaataatttttaaccataatgttatactctaaagacatttccgtcgttttagaaataaaaagctgtcatccactcagatcttatacttgttagaaatatagaactcagatttcagatggctttgaggttccttatgtgtatgcatttgagctatgaagaagtttgaaggttaaggattatttaggtataactcatgttttctcaaaccaggaaaaaaattggggacataactgtcatggagttatctttactcaatctggtgtagaaagcatttcccaacctcagagatttatgttcttttttttgttttaaagacagatgcacattattccatactgtcacttcttctgtgtctgtcagactctccttcaaacagcagttatgtggagacaccaagaaataaagaagtgggtatgttactagattccttaacatatgagaagtaaaagagaaattgtttgattacttagttgctaaacactgagttttattgaaacttctaaaaatctgtgaaactaaagtatttctattgctttagatgctatcacaattgtaaaattttatttaaaatgctgtcagccctctatattctcaggttccagacccacagattcaatcaactacagatcaaaaatattcaaaataaataaataataatacaacagtctaaaataatacaatcttttaaaaaactatttacatagcatttacatgatattaggtattataagtaatctagagattatttaaagtatacagcaggatgtatttaggttatgtgcacatactacaccattttctgtcagccttgagcattgcggagggtggtgtacctcctggaaccaattcccctcagatattgagggatgactgtattcgttctaactttacaaactaccttcagctgtagaaagagaacactcacctttgagaatgagttaattaaaatgtaaaatgttttaggatatcaatttattaaatgtttcaatatttttaaatttttatttcctgagtattttgagtcttgttagtcttttttccttagttttgaggttttttttcaaagatagatataataaagccaatgaagttcttctgttacattttagaaaagaaagatgatttcgactggggaaaatacttgatggaagatgaagaaatggacattggtccgtacatggacacaccagtaagtggtagtagttttgctattgaaaattgaaatacacgccaggtgatatagatgattttcatgggtctttccaccctaggtcaacttagctaaaacaggaacactcttcactaagctagagtcatttattatggaagactgattaggatttcgcaccaaatcattagtggtaagaagttaaaaggggccgggcatggtggctcacatctgtaatctcctgctcactttcgagaggcaggaggattgcttgagcctaggaatttgagaccagcctgggcaacatagcgagatcctgtgtctatttttaaaaaataaattctaaaaaagttgtctgggcttggtggctcacaactgtaatcccagcattgtgggaggctgaggtaggcggatcacttgaggccagaggagttcgagagcagcctgggcaacatagtgaaaccccgtcaactaagaatacaaaaaattagctgggtgtggtggtacacgcctgtaatcccagctactcaggaggctcaggcacgagaatctcttgaacacaggaggtggaggttgcaatgagctgagatcgtgctattgcactccaacctggatgacaaagcgagagactctgtctcaaaaaaaaaaaaagaagttaaaaggggtgagtacaagtatcccttaaggacctgtgatcttgggactttttgccacaaaaaataattccattccttattatttcaacattatagaaaaaaagaaaaagtagtaatcatatttccattcctataataggcacttccaagagatttaggaaaaaaaaatttgtttttctgttccatgttgcttcaaagtttttgcttttcttcaaagttttcttagtcttttaatgtaaatagctttaagtgttatactctgtaaagctaaagtgtatctcttttttaaatcagaattggtctgaagaaagtgaagaggaaaatgatcaacagcccttaagcagagaggactctggaattcaggtagacaggacaccgttagaagaacaagatcaaaacagaaaactggatccttgtatcagttggaaaggtattatgtgttatgaggtgctcgcattttctaatagacaaattccctagaaggaaaggcaaactttgagatcagttccatgtaatcaaggtattggctaagctctaccatccttataaaaccaatttttaaaaccattagtaatgttttctatgatgcttaagtagtagtactatagaattaatgttgaattcatacatgtagagtgtaattttgtaatttttttcctatacttctgagaactttctcagctgtaaatgtttccttttttttttttttttttaattggagaaggactgattttgctaagattgtgccactgcactccagctctggcaacagagcgagaccctgtctcaaaaaaaaattaaaataaaaaagtataagggaggatatgcataggttatatgcaaatactatgccattttatatcagggacttgagcacctgcagattttggcgtctgcagcattcctgcaaccagtccccattggatactgagggacagctgcatttattccggactttctaatctgtgcacttggtgtcagtgtgacccagaaacagacagacttttttatttgtgtggctttgtagtattatgtcttaatacatagatggcaagtttcctttcagctacttgggaggctgaggcaggaaaatcacttggctccttttctttttttttggagacaagggtctcactctgtttcccaggctagagtgcagtggcacaatcttagctcactgcaacctctgcctcctggcctcaagcgatcctcccacctcagcctcctgagtagctggaactacaggtgagtgccaccatacccagttaatttttgtattttttgtagacacagggtttcaccatgttgcccaggctagtctcaaactcctagactcaagcaattactccgcctctgcgtcccaaagtgctgggattacagatgtgagccaccatgcccagcccactttgctcttcccccccaccccctttttttgagacggagtctcactctgtcgcccaggctatggtacagtagcatgatctcacctcactgcaaactccatctcccaggttcaaacaattctcctgcctcagtttcccgagtagctggggttacaggcgtgtaccacactcagctaatttttgtatttttagtagagacagggtttcaccatgttggccaggctggtctcaaattcctgacctcaactcgtccacctgcctctgcctcccaacgtgcggggattacagatgtgaatcactgctctttttcaaaattggcttagctatttgtgaacttttattcttctatagacattttggaagcagggtggtaaactttaaagaaaaaaaaggccaggtgcagtggcttacgcctgtaatcgcagcactttgggaggccgagctgggtggatcacttgaggtcaggagttcaagaccagcctgaccaacatggtgaaaccccacgtctactaaaaatacaaaattagctgggcatagtggcgcatgcctgtaatcccagctacctgggaggctgaagcagaagaatcgcttgaacccagcaggtagaggttgcagagagccaagatcacaccattgcactccagcctgggcaacaagagcaaaactttatctcaaaaaaaataaataaataaaaaataatccagctggagtttttattgggattgcagagaatttatagatctaatttggggaggcttgattgccttaacataataatagctacatttatcgtaattttttatcttttactagagtttggaaattttttttaaacatcttgagtgttcatttgttaatttctacatatgttatagtttttatttttgtgaatgttgcctcttttgtttattcctgatgtagaagaaataatattgctttctgtaagttgtccgtatatgcagcatttttactgaattctcataatagtttgttgattcatttggtttcttatatagatgattagtatcatctgcgaatattgatggttttattcttcctgctagttcttatgcctgtatcttctctgtgacatgatcaaatctcttttctggcccagcagcccaaccctctagtccgtagcagaagcaacagctcatgggagtgggcttcctggatgactaggtctcatcctaaggggggttatacctgaaactcctccgttaagtgtgatggttgtttggtatcagttcagggtatgtggcctttatcaaattaagacaatttccttctattactttttttttctagaagtctttaattatgaataaatgttgaatttttattaaatgctactatttatccgtgagataatctcataacttttctcttttatcctaataatgcatcgatagattttctgatgttgaattatccttgaattcttcacctaaacttgcttgatcatgttattttttagtacatttttagatcggattcaattttggatttgctttttttttttttttttttttaagaccgggccctgctctgtcacccaggctggagtgcagtagcgtgatcacagctcactccagcctcaacctcctgggctcaaagtatcctcccacctcagcctcctaagaagctggggcttccagtgcatgccaccacacccagctaagtttgttacttttttgtagagatgaggtctcactatgtttgagaccagcccaggctgggattgcaggtgtgagccaccgagcccaacaggttagctcttttttaatgtaggatttttcatctttattctttgatgaattacatgtatcctgtctttgtctagtttaaagcatcactgttacattagcctcataaaatgttaggtggctttctctttttctgctttttcaaacaacttgtataagatagaggttatctaatccttcaaaatttagcaccagtcctgagacttccgtagtggttgggaaggtcttcagttaccatttcagtttccttaatggttactggacaattaacatataccatttatatctttttatgtatgtggcaattttttttttttttactttctagtcagttacatttaattaaatttagtatgcgtttctatatgtgtggttttattttattttactttgttttttgagatagggtcttactgtgtcacccaggctggagcgtagtggcatgatctcagatcactgcagcctcaacctcttggctcaaccagtcccctctcgtgtcagcctcccgagaacaagcacatgccaccatccctggctaatttttttgtattttttgtggagatggggggtcatactttgttgcccaggctggtcttgaactcctggattcaagtggtcatcccaccctggcttcccaaagggctgggattatatgtgtgagccatagaacccagcagatatatgtggtttaaaataatcatatatacataaatgttaggtagctgttatttttaaaaagccattttcaactatacgtttgaatggagctgtaagtccaggtattgtgacccagtattttgttgttgttaactcaaactgattacatttctttcaagcagatgagccagatgaccgaagctggctggaacatcatgtggtccatcagtactggacagccaggccctcccagtttcctcatagtttacatttgcactctaatttagctgctgtctggtaagaagctaaagttttcatttaatgtgatgatagaagaaactttgatgtttaaacgtttggctttgatttgtgacttaagttcttccctgaaatttaaacttgtttttgttttgacaattcttttttttttggagacagattctcactcttcgttgcccagactgcagtgcagtggtcagatctcagctcactgcagtctagacctcactcaactaattttttattttttattttattttacttttttttgcagggggagacaaagtctcgctctgtcaccctggctggagtgcagtggcgtaatcatggctcactgtaacatctgcctcccgggttccagcaattgtcgtccttcagcctcccaagtagctgagattataggtgcatgccaccatgcccagctaatttttatatttttagcggagatggggttttaccatgttggccaggctggtcttgaactcctgtcctcaagtgatccacctgcctcggcctcccaaagtgctggaattacaggcgtgagccagcacacctggctggtgttgaaaattttagttgaatagtttttaattatttgttattgaaaatcattaaattatagtattatttaattatagtctctgtttccattttttgttgttaatttcagtgtaaatggattggtatatattagggcattatttgatttctgttttggtatacttactgcaaaaatacacatcttgttttccagaaaacaacattacatagttgtaaacatttgcctaaatcagcaataaacgtaacaattgtaattgttctgaaagtgtttctcagagtattctgattgacatgaaaatatagggggcatttaagccatttattatgtatacttgttagttgattgctacttaagttagcactaaattgcagatattctttgagataagttatttacttacttagaaacctttctattgacatttatgtttgctgtctcatagggaccaacacttgtacagcagtgatccattgtatgttccagatgacagggttttggttactgagactcaggttattcgggaaaccctatggtaagaaatgttcatttaattaatagtctttatgagacttgattactgagaagcaaaaacttttattaaaggaaacttttcaagcattttcacatgcaaactagaaaaggtccattaggtgtgaagttcggaccagatttgactgtggagattgagagagtttgatataattacttcattttcattttaaataatttagcatatgatttacttaggttagcccatctcttctttaacacctgagttcaaagcaagatttgctactgattttttttttttttttttgagacggagtctcactctgttgctcaggctggagtgcagtagctctatctcagctcactgcaagcttcacctcctgggttcacgccattctcctgcctcagcctcccgagtagctgggactacaggaacccaccaccaagcccggctaatttttacttttttagtagagacggggtttcacc[140 bp omitted]tgtgcccgtacctggaagccaggaatctaatgcggcacatggtgctgttactactgaaattccaagtcctggtgctctcaccataaagtatgatattgacatgctcgcattcttagaaataggaagatctctttgggtcgtcaagtatataggggagatgctttgacaacatgttttagacttctctaagatgatgttgaaatatcttgagtcttagggtaatcagatgaaaagattgatgtcttccattttcttattatctgacctttttgcccctaattctgaatatttaataaaaatttcctgaggtggggcatggtggttcacacctgtaatcccagtgctgtgggaggccaaggcaggtggatcacttgagctcaggagttcgagaccagcctgggcaacatggtgaaaccccgtatctacaaaaaatgcaaaaattagccaggcatggtgacatgcacctgtagtcccaactgctggagaggctgaggctgcagaatcacttgaacccaggaggttgtggctccagtgagctgtgatcatgctgctgcactccagcctgggtgggtgacaaagtgagtccctgtcaaaaaaaaaaaaaaatgtcctgggcatactgtcatgaatatttttctagacttaaagtacactcgtctttttttaatctcatttcaggttactttcaggagtgaaaaagctctttatatttcagttgatagatgggaaggtaactgtgagaaacaatattatagtaactcatttaacacatgtaagttatttgtatttatggtaatttaagaaataggatttatgtaaactagtaatataattttagaacattttacaatattaaaattgctattgaactcgttcttgcttcctcacatgcaaaaaaaagctaacttaaaaatatttaatatccaaaaagaaaaattgagttgtgcatctttatagtacgtagaggattccttaatattgtttggaacatatttaatttcaatttgcattttctgctttttatttgtcattctgtattgtgaaagttatatactgtaattttgttttgctttaagtacatttacttatgtatgtttttaaaaatataagccataattctctagtctgttgaaattattgttcactttttcctttgtgtataaaattataaatattaatcatattattactttgtcttctactaaacatactgtttaaaacaattgcaaaagaagtattttacagcgagagggaaatgaatttgaatgtttacagaagaccacctttgaataattgcagtttgcttgtgttgtagagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatggtattaaatgttcttcatctttactcatactacacgtaactcataatttgaatgccacttagagtttttattatataagatttgaaagttgcctagcagataagtagttctcgtgaatgcttcttttaaaattattttaaatttatatttttaagccattcatatctctaaaaatcaaaaaactacagaagatttagaatgaaaaatctaaattattcttcctgcaccagtaccccagccagtcagttctcctctccagagacagccaggtccttggcttcttacgcatccttccagaaagagtttcaacatacatgagcagtgcatatacatatacgcatacctagcagtcattacactgctctcttcaaatttttccagtttaaattttgaggataataccatacatatatgaagagcttctgttttcctttttacaaattgagtgtttcatcatatggtcgtgtcatagcccagtccccttaatggatttaggttgttcccaggcttttgctattgccagtagtgctgcagtgataatcacttctacatatccgttatcgtacacaggcagtgagttatctgtagggtaggttctttttttttttttttcatttgagacggagtctcgctctgttacctaggctggagtgcagtggctcaatctctgcttactgcaagctccgcctcccgggttcacgccatcctcctgcctcagcctcccgagtaactgattacaggcacctgccaccatccccagctaatttttgtattttcaatagagacaggctttcaccatgttgaccaccttggcctcccaaaatgctgggattacgggcataagctgggattatactgcatctgaccatgtggggtaggttcttataaatggaattgctgggtcatgtgtgattttcctaagttttgccactttatggggaggtataggtaaatacatttttactgttgtgaaccaagtagatgaatacctgtttcctcacacttcttgccatctgtgtgttaccagacgttttggtcttcaccagtatgacagctgtaaaatggtaacccatgtagcttttttccccttaaatttcattttgaactaccacaaaaaatagtacagagaggccctgtgttcccatgaccttgcttcccccagtggtaaaaccttacatagtgacagtacatggtcaaaactgggaaactgacattgacacagcacattagccaaactgcagacctgacatggtttcaccagtgtcgcaggaacttgctttgaacaggggtgggtgtggtatattcatgtatagtttatcacatgtctagctccacatagccacttccatgttcagatcacagctgtgccatcgcctcccaggagcttgcttgtgcagccctttgtaggcacagcctccctcacccctctctgtaacattagcccattgggaggtgttttgttttacctagtgtaattttaatttgcgttcttttattataagtaaggtcaagtgactttctgtatgttttagaatcactcatcattccttttttatgaactgtcagttcctttatacattatttttctgctgagttgtctttttctctgtgacttgcaggagttcttccttagggaaattaggtccttgtggtatgagattaaaatccaccgtcctccattttgccctgcctgtccataagcctgatgatttgccagcatttatgtcacattttagatgcatgtatttttccttgctgttgagtttgatttattgatatttgcagatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaaccgtaagtgagacttctgcctaaagtgtgtgactccatgctgcacagcagaggagtgatagacagctgatggtagttctttgttgatacttgaatgatgactcgtcagacagttcagagtttttaaattaacttccaaatttaaggctgtaggaaactggcttttcagctctaattgccaagatcctcagaaggatgaggcaaggacaaggcaagctgtgagaagtacctacctgatgtgtatagatatttacaataacgctttcttacataaacactaacatgtaactaacatgacatgagatagctgaagtagacacatccacagaaacaaagtggaatgctggttaccaagggctggggaatggggagctgttgtttaatgggtacagagtttcagttttataacatgaaaaagttctggagatttgtcacaacgatatgaatgtacttaaaacctctgaacttaaaaatgctgagggtcaggcacagtggctcgtgcctgtaatcccaacactttgggaggccgaggcaggaggattgattgagcccaggagtttgagacttgcctgggcaacatagtaagactctgtctttaaaaaattagttaaattaaaattttttaaaatatacagttaagataaattttatgttatatattttatattgtattttaaaaaatacaaatctaggccatgcatagtggctcacgcctgtagtcccagctacatatgagtctgaggtgagaggatcacttgagcccaggaatttgagaccagcccgggcaacatactgagaccctgtctctacaaaaaattttta[132 bp omitted]ctgaggcaggagaattgcttgaacccgggaggatgcagtgagccgagatcgcaccactacactccagcctgggcaacagagcaagactctgtctcaaaaaaggtagccagctctggaggcacatgcctatggtcccaggtactcgagaggctaaggcaggaagatggcttgagtgtggaaggtcaaggctgcagtgagccatgtttgtgccactgcactccagcttgggtaacagagcaagaccctgtctcaaacaatatatagatttaaaaataaaaatctaactagaggctgtaatttagaatgctacagtcttagttgggtatgtacattaggtgtattttctagtttgttggtataactttttttcacaccaatttaataccatatttctttttttcttttttttttttttttttttttgagacgtagtcttgctctgttgccaggctggagtgcagtcgcacgatcttggctcactgcaacctccacctcccaggttcaagtgattcttctgcctcagccccctgagtagctgggactacaggcgcacatcaccatgcccggctaattttttggggtttttttttgttttttgtttgagatggagtctcgccctgtcgcccaggctggagtgcagtgtcatgatcttggctcactgcaacctctgcctcctgggttcaaactattctcctgccttagcctcctgagtacctgggattacaggcgcccaccaccatgcccatctaatttttgtatttttaatagagatggggtttcaccatgttggccaggctggtctcgagctcctgacctcctgatccgcctacctcggccttccaaagtgctgggattacaggcatgagccaccacacccagctgtatttttttttaatagagatggggtttcaccatattggccaggctggtctcaaactcctgcccttgtgatctgcccacctcagcctcccaaagtgctggggttacaggcgtgagccaccatgcccagccaatttcctcatccttaatggatgctttgctagtaataggatttagatagggaaaccttgttcgcttgcctgggctatctcaggatacacctgctgcctctgtgtcactttcactctcaagtttcccagtctggactacaaacaatatgatcatcccatatttaggtgagtttttcttttttcttttttttttctttttgttttgagacagtgtcactctgttgccaggctggagtgtagtggcacgatcttggctcattgcagcctccacctgccagattcaagcaattctcctccctcagcctcccaagtagccaggactacaggcgcgtgtcaccatgcccagctaatttttgtatttttagtagagagggggtttcaccatgttggccaggatggtctcgatttcttacctcaggtgatccgcccacctcggtctcccaaagtgctgggatcacaggcgtgagccaccacgcccggcatttaggtgagtttttcataaggattttatagtgtatgtttttggatttttaatttctttgtgccccaaaaaacatagaaatccgatcacttttttaaaggcatttcagaaatgtttaaacctccttttatcctagtgaccagggaaccctgagagctgaccgtgcacactctctgcctcaggtctccctccttttctctctctgggtggaaacggtgcggccttacctgcagacggtggacgagtggatcgtgcacgggcacctgtgggatggcgccagggagttcatcatccagaggtgagctgcagcagagcacaaggtcactgggggctggcatcaccagtttcctccccatgaaaatcaaatgctttcgttagtttcagacagtactgagaaagcacagttcacatcacagaacttgtcgtcatcataggcaagttctatctcatttttacggaaggcatcagtaataccagctgattagaaatatctttgtccaagttttgtcagtccgcaacttttcttaagcaaattatatttttggatggtagtatatttatggctagctagtacacactgcttcccataaaatgagtttagatgatatcatatggtttcagctatttccattgtaaattatcagtaaagagatacagaaatattacagagtatgcctctaatatatttatttctctgaattatctactgatttcttttaccttagtatattttacaaaacaaggaaaatcttaatccatttatgacaatttcccttcagttaattgatttttctgaatagaatcatataaacaatgtagagctatttgtactcttttagcccaattttaaattatgcggtatatttagatatatggtttctattgatagctatccattgagctcatcaggaaggataactttaagtctttagtgttctggaagggtagcaatatgtatgcaatgctcacataagtgaactgacccttccttcaactcaatctcatatctgtcactgtgttctgattcatcaatctcacatgagaatttttgtgaaaaataggactctgactgttcttctagggtgatgattgaccatcattttattgttaaaagtagtccagttaagaatctttgtagggaaaatgatagagaagtctgcaaattagtttcacagcagatggtaaatggataaacttttattcttcttctaaagaggaccaaattagtcatattttaaataattccaattcaggaaactatttctacttaaattttacttacactattcaaagtatttattcacttttctctttaaactgagatgagattaaaactgtcccattttgcctaaagtttgcttcagtttactaataattaatactatgttttataatgtctggacaacaaactagaacaagtatgctgtttttaagaaagagaaataagagtttaaaattcttttgaatctctttagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagaggtacttgttccgtcttcctgtgtctctcttggtgttgggacacctgaccctactcgctcttgtcatcctgatacctaattattttgtagtttgcaagtcatcaaaccctcttatttcggtggcaattatcgtcatggttgaattagtaaccatgctgctcttgattttttaaaagattgtcttcattgaaaacttttagtgctgtgtttgaaaaggcagtgacgataagttccacatgcattttcctcactctggattccttaggactggaactttaaaaagtaatcccctgccatttcttttcttttattatttttataaattgacataataattgtacatattcatggggtacatagtgatgttttgatacatatatagtgatcagatcaggataattagcacttccatcatctcaaacatttactacttctttatgttggggacattcagtatcctcttctttgctatgtgcaactctataatacattattaactatagtcatcccatagtgatacagagcactagaacttattccttccagctagctatttgtatcctttaacaaatatcttcctctttctcccttccccctacaaaatccagcatctggtatcctgttctactttttactaatacgagatcaacattttttagctaccagatgagtgagaacatgcagtgtttaactttctgttcctggcttatttcacttaatgtccaccatttccatcagtgttgctgcaaacaacaggattcactcttttatcttcaagatatatacatatatatatatatatatctcacaatttttttacccattcatctgttgttgggcacctaggttgattccatgtcttggctgtgtgaatagtgctgcagtaaacatgggggtgcggatgtctctttgatatcctgatttcctttcctttggataaatgcccaccagtgggattgctatatcatatagtagttctatttgtagttttttgaggaaccgccaaactgttctccatggtgtctgtactagtttatgttcccaccaacattgtgtaagagtttccttttctccacatcctcaccagcatttattttttgtcttcgtgataaataaccatcctgactggggtgaaatgatacctcattgtggttttgatttgcattttccctaataattagtgatgctgagcattttttcatctatttcttggccatttgtattacttctttggagaaatgtctgttcagatcatttgccttttttttttttttttcctgagacagagttttactcccatcacccaggctggagtgcagtggtgcaatctgggctcactgcaagctctgcctccctggctcaagtgattctcctgcttcagcctcctgagcagctgggattataggcacccgccaccacacccggctgattttttgtgtttttagtagagacgaggtttcaccatgttggccaggctgatctcgaactcctgacctcaagtgatctgcccgccttggcctcccagagtgctgggattacaggcgtgagccaccgtgcctggcctcattcattgaattctttcactgtaaaatttgtttgttaaacatctgtttctgttgaatttctcattcaaatcattcttttcctgattttgttgagtgtttatttgtactgtcttgtatctcaccgagttctcttgtatctcaccgagtttccttaagattttaattctgaattatttttccggcatttcctatatcattgtagtctcttgctagagaattattggttttcttgggaggtgtcatgtttctttgctttttcatgtttgatgtatttctacattgatttctacacatctggtgggaaagtcaccttttccaattttatggagtacgttttgtaaagagttattcatatgaatgggtcttggagtgtgggttcagtgggatgcattcaccttggttctggacaaatgcagtagtatagtctccatgtactttcttcagttgtaatccactttagtgatgtttgcaagtgcctcagtggcctacagtgagggggtttgtggcaacagtggcacagttggctgggcgtggtggctcacgcctataatcccagcactttcttttttgagacagtcttgctctattacctaggctggagtgcagtggcatgatctcggctcactgcaaactctgcctcctgggttcaagtcattctcttgcctcagtctctcaagtagatgggattacaggcatgtgccaccacgcctggctaatttttgtatttttagtagcgatcgggttttaccatgttggtgaggctgatctcaaactcctagcctcaagcaatccacccgcctcggcctcccaaagtattgggattgcaggcgtgagccatcacgcccagccaatcccagcactttcggaggccaaggcaggtggattacttgaggccaggagtttgagaccagcctggccaacatggtgaaaccctgtctctacccaaaatataaaaattagctagatgtggtggcgcatgcctataatcccagctgcttgggaggctgaggcacaagaatcactggaacccggaaggcggaggtttgcagtgagccaagattataccactgtactccaacctgggcaacaaagcaagactctgtcccaaaacaaaaaacaaacagtagcacagctttgctgggatgggcttgctggactgtttctcagattaggggtacatgcatgtacacagtggtttggccaaggtggggtctggctcagggtttgggaccacaggctgttactctggccaggaacatgagcatgtggttgcttggccagcctataggtttatttgcctgccagcaatggcccaaggggctgtttctcaggcctaggatgtaggcacaaaactggttttctggccaggggctccatgagaacagccctcagggtcatttctcaagccttggacatgagcacaggcttctttgctcgcctgggagtatgtttgctgggggtaacctataaggctgtttcttaggcccaggatgtgggtacaaggctgctttgctagcctgggtgcatgtctgcctgcacagttcaaggggctctttctcagtcctgggacatggtcacatggcttgttggccgtcctaggtatgtatctgccagtggcagcccatgaggctgcttctgaggcccagcatgtgggtggaaggctgcttggctggcatgagggtgtgattactgggggtggtcttcaaggctctttctcaggtttgggatatgggtgccagctggctcagaacatgcccaccaagggcagaccacagggctgtttggcaggcccagtatgcaggcctgtggccgctctgttggcctgtgactcccaggcgctgcctatggggcttcttctccaaccaaagatgccgtgcaaggccgctcaagaagcctaggtacatgcctgccagggcagcctctgaaactgtttctcagaccctgaatgctgacccagggccactgggtaggccacgggcctgtctgcaaggggttgatgctgtggggctgtttctcagttcctgggcaaaggtctgtaactgcttcaccagcctggaggcatgtcagctggtaggaagctcaggggtctgttcccaccctctagagatggcacagcaatttggccagctcaaagatgggtttggtctgttggggctgccagactgttcctctgtctgaaagtgcagtggcaggggctggtttttctgctgtgcaggaccagaatcaccagtcgatcctgggcccaggctccacatagctggggttgtggtgttcagccatccctgtggccttggtggaatgaggatggagccccagtggctggggtgcaggagaggtgcagcagctactggcccagaggagggcgtgctccagaggtggctctggtctgaagatggtgccatgctgcaacagcttggctcaaaggggtgggtggggaaggcacaccttgtgcccctaacccggggcaaggcagctgcgtgaattcccagcagctctccaaactgggctcagagctcgtgggaactgtggaatcctcctgtagtaatgactgtaggtgtttgtgggggctggtgggtttcttctgcttacccttaccctacaatgggaagtccttcttgactccagaccagcctgttctgcgaagctgcagaggctggaagcctccacactgccctcctgggcctccagtcaccaacactgtgtcacattccccctctgcactccagcactcgcccttcaactccagtcggatcttttttttttgagacggagtctttccctgtcgcccaggctggagtgcagcggcgcgatctcggctcactgcgaacttcgcctcctgggttctctcctgcctc[131 bp omitted]cctcggcctcctgaagtgttgggattacaggtgtgagtcaccacccccagcctccagtcggatcttaactgttgattcgttgctttggtcctctcttgctgttgggagaggaacaccagacgtctccaggcagccaccttgctggcgactggagtgcagtggcatgatctcggctcactgcaacttctgcctcacaggttcaagtgatttctcatgcctcagcttcccaagtagctgggactatagatgtgagccactacgcccggctaattttttgtgtttttagtagagatggggtttcaccatgttggccaagctggtcttgaactcctgacctcagctgatccacccgcctcttaaagtgctgggattacaagcgtgagccaccacaaccagcccttctggcatttcttaatgcaatgcagcgtttagcccttgagggccgtgaaccatggctgataagaatttcttatgagcagttcagactcgatcataaatttcaagaaaatgatgcaatttaatatattcaaagttttatgctgtaatcccagcactttgggaggctgaggcaggcagatcacgaggtcaggagatcgataccatcctggtcaacgtggtaaaaccccatctctactaaaaatacaaaaattagctgggcatgatggcatgggcctgtaattccccactactcaggaggctgaggcaagataatcgcttcaaccagggagtcagagattgcagtgagccgagatcatgccactgcactccagcctggtgacagagtgagactccatgtcaaaaaaaaaagttttatcaactgactaaaaaggcttggaagataaagatgtgaccttatttatacatctcaatcatctcaatgttatgttaattatattattgtatctacttgaaataagtagatgcaatacttattttcactttgtggaatatttccttcttatgtagtgagcttcccagggccactgtcagaagtgttttttccaatgagactgcgactcctatcagggttaccatagtgttatgcagtattgtaataaatttcaagtgtgctgattaggatcttactctttttttttttttttttttgagtcaggtttcactcctattgcccaaactggactggagtgcagtggcgtgatctcagcgcattgcaaccttcacctgccagtgctcacgcagttctcgtgcctcagcctcccaagtagcttgggaccacaggcacattccactgcactcagctaatttttttgtagagctgaggtttcaccatgttgcccaggctggtctcaaactcctgagcttaagtgatccacccgcctcagcctcccaaagtgctgggattacaggcatga[136 bp omitted]catggtgaaaccccgtctgtactaaaaaacaaatatataaaattagccgggcgtggtggcacatgcctgtaatcccagctacttgggaggctgaggcaggagaattgtttgaacccgggaggcggaggttgcagtgagccaagatggcgccattgcgctccagcctgggcaacaagagcaaaactccatctcaaaaaatatatattattttgttactatatataaatatatatatttaatatttacatatatttaatatttatatataaatatatagattttgttacttaatatattgttaatgttaatatgattaaacagaatgttacttaatatgattaaacagaacttagttcaccttacatatttctttatgtttcagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggtgagacacacctgcaaggttatcagtaattgaaatggcatcatttgtgcaatgtttgctaactgtttatttctggcaggtagggctaaaaacaaaaactcttgtaggctatcctttcttttttctttttccttttttttttttgtttgtttgagatggagcctcagtctgtcacccaggctggagtgtagtggtgtgatcttggctgactgctgcaacctctgcctcccaggttaagcaattttcctacctcagcctcccagctacctgggactagaggcatgtgccaccatgccccgctaatttttgtattttttgtagagacggggtttcc[131 bp omitted]gttgtgctcacctacttcaggtgtatagtttggattccatgtcgtttgtggaagtctgcagacttggccctgccaccatgtggtacaacttttgtctgtgccctcgggcccctggaaatgtcatcatttacccagaagatgctgaaactctgggccatgagtgggccctggacacccattgagtcagggtccccactggcatataatatgtcctgggcttaagctgcttttaggcacttagtccattagagtaagtcattaatacccacacagttcccggttgtctaatggccagcatttgctgtgtccagccctaatcactagaaagaccagctctagtacctgaccctaagtcagtggcaacttcaagagactggttcactcaaaggatatttttgggagaaagatttttctctttctgtaatagttggtaacttcaagactaaaggtaaaaatggaacttcagggttttgatttaagagagttctgttgacagcagctcataaaaagaagactcacatttttatcttgaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaagattacaggtaaaagagtaatttaattttggaagtagtaaatagttgattgtacttgaagaacagttgagattattttaaaacctatttcaatttttattagagtaggaaatggatatacagtaaacaattttctaagagaaatcaattgaccatcaatattttcttaactatgttttgaaacttaattctttatttctgagaatctttcccaaaagaaatacagaaaaagcttgtagaaaaattacaaagtttgttatcagaatgaaaaacactaaattacttagtgatagatgactagttttttaaactatgcatatccataaatatggcatatacatacccacatatgaactttgtaaagttcataaaaattatggcaattaggccgagcacggtggctcacacctgtaatcccagcactttgggaggct[134 bp omitted]ggggcaggagaatggcgtgaacccaggaggcagagcttgcagtgagctgagatcgggccactgcactccagcctgggcgacagagcaagactccatctcaaaaaaaaaaaaattatggcaattaaaaagcaggagatataatacggtaggaactaggttttcttaacacatagaagagaagacaggaaagaaacattccagatattaaatattaatgatggaaatccaccataaatgatgggatttggatttttttttgttacatttttgtgactgcccaattttctataatgttatagaagataacctttctgatgatgaaaggaaaacctatgctgtttttattattggaacaagtttaagaggtgttaatatttctaattttagtaaatgtagaatgtaaacttgttccactaaaaacaggttacaaaacctgttgttgatccagaatcctgccttacgaatgccagagatcttagtgtcactcattttctctccattcaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacggtaaaatatggacgccacctttatttaaattagtgtaacatgaactatgtgccagtaagtcttctatgaattacacatattattttatcctcactattcctatgagttttactaatattattttacttattagaaaatggaggccaggcacggtggctcacacctgtaatgccagcactttgggaggcagaggcggtggatcacctgaggtcaggagttcgagaccagcctggccaacatggtgaaactctgtctctactaaaaatacaaaaagcatggtggcaggcgcctgtaatcctggctatttgggaggctgaagcaggagaatcgcttgaacctgggaggcagaggttgcagtgagccaagatcatgccactgcactccagcctgggcgacaagaacgagactccatttaaaaaaaaagaaaaaattgaggcagaggctagctatgtgactctcctgctaaacaacaaaagacgttgagatgccaccatatggccagatgcagtggctcatgccagtaatcctagcactttgggaggccaaggtgggaggattgcttgagcttaggagtttgcaaccagcctgggcaacatagtgggacctcgtccctataaaaaaagaaaaaagttgccaccatacgacctgtcagggtctgatggcctccttcacatggctggagtcagtgcttcctctccctgagctcccacacatgaggtttttcagtcctgcctcctagagaatgcccctgacctctcagaactggctcagaactccccaatgacctctgtgtctctcagcctcactcccttccaccaaaacggacttgaccctcaccagggtgacctcagaccaccagcagtgacttccaccactcatccctatgctccccgtgggtgcctcctaaacagatggactaagctttgtcttagaagggagaaagctatttactgtctggctccattttcccagcctcatgtcttgcacacatacacaccatgttctctttcctgtcttccttcgcgtttcagggatttcagaatatttctggtgtctgctagtgctgtcctcccgcccccctgtgacatagtctccagttcatgggcccggcagaggtctgctcattcctacatcccccttgtcttcgtgtgctgcactgggctgggagtccctggagggaagagagattggctttctattgcctgctcagtgcagcacctaacttagtattagtatttggtagatgcctactaagcactgagtgaatgcatacatatcaggccattaagagctaaaaattcttttttttgagacagagtcttgctctgtcacccaggctggagtgcagtggcacaatctcgactcactgcaagctccgcctcccgggttcatgccattttcctgcctcagcctcccgagttgctgggactac[138 bp omitted]aaagagctaaaaattctgactagtgcctgtgtcatggatcagccagttcataatcacacactgccctgtgacatctctgatttggaagttaactccccactttaaaccttcttcatatgcatccaggcatcccctcttagtgcctctgtgactgtggaagaggacatcatttctcaggaaccactgatgggagtattttgaggattaaatgagctaaggacacataatagtgcctggcacttggacattttcatgtccatgttagatgcttgctttcctctgtgagtcacattcaaacctgtctcaggaacttgtggatgaagcactgcacagtgcctctggtgtagaagcagaccccatcccatctcgatggggctctcgaagcagtactctcaccacatgctcggctccgtcgagctgctctgctcgtcctctcctgcccacccccaacctcagcagaggcttcatcttcccagccattgcctgaagtttactgtcttcctcagcttcatcctttttctaattactaccattgttaagtgtctctttaactaaactcattgtttaaaagttttctccctctctgtttctaaatccaaatttctgctctggaatatatgttagaagagatacatttgttggaatgtttgcatttcttttatgaaatgcagtatcttttggggaatattatgtaaatgaaataccaattattttaaaagagcatttttgtgtgacatagtgctttcacaaactaaaactggaatttctttctttagtctatctatatcttttgaaaatgttgacacagctaagaagaagctgcctgttcatatcttagatggtctgaccctcagctacaaggtatatgctgatattccttgtatgaaccgtgttttctgctaacattaaaacatgcaagtaattggttactttctaattttgtttttgtttcataggtcccatggcccgtggacattgttataagtttggaatgtcaaaaaatttataatcaagtgtttcttctcttattgcaaataaagtgggcaaaatatagtctggatgttttactttttggtggtaagatttgttttcagcagataaattgtaattttatttaattttagcccttaataaaagaggttaatgggaaagggaagcatacggggatctggaaaaaaaaaaaaagttggtggttgttgatcattttttatgtgtacacaaatgccaaaatggtgcgtattctagcagtagttttatggacatcaaatgcctgaaagaaagatcaggaagttgtatgtacagttgatctgaaatgcaacaacttgattaggaaaagtgatacaggaaacttttcccactgcaccttccagaggcactgaggttcggttcctgccacccctgccagtgctttctgtggtgccaggaccacatccgtcagtgtttctgccaggcgtcatggtgcagtggggtttgagttgatgctctttctgtccactttgctcttccaatgttttatagaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccagggtttgtgcctctcccatctgcttcagttctatcgtcgtatctatacagttgttcgtagagaattactcatactatgtttataagtaaaaaatacctacagactgtgaaaacgggacatgtagcaaatttgatcataaaataacatggcagtgggaggaatgtttttgtaaatataccggaatatgtgtatccagaggctgttgtccctccagtccagcagcccctggggacaggcacagccacagctcgtcttctggaattgccttcagaatgtgccgcatagtcctttaggtttcaatagtggtgacagctgtccctaaaaaatggctccaatgtttaataacagccaaaatccactacggtgtgtgggaggaagatgcagccaggttatagacttttttcttaaaaacaagaactcactacaaagtaaatgaaattatttttctgatacatctaaaagccagttctaggggaagttctaaaagaagcgttcagaaattggaacaagagcagtattattagaggacagtatgcatttggggtttgaattgttgtttagacctgtttatacctggtctgtgagttctgaaacccaacttgcttgggtgaagtgagccactgaagcctgtgttttggatgggaaggctatggcagaggggctccacgtttcccctgactgcattactgccttcacaaggttggccttcattaagcccctaattgttaagagtaaatgataagagtttaagttttttcttagtttgttttttatttgaggtatacttatactcattttagagaaagatcaatgtatgagaaaaggaacttaagaaacataaattcactgtaattatttgtataaaagtaacacatttacttgattttttttttatcgatgtgtcttatatacagcttaatgtgcttgccccttcctgccaggaagtctgttagtccagagtttggcgttcattcattcactgtgcaagtgggcgtcctacaggattgcccccgccgtcctcttaggatcagaacgccagagtatccagccagcctttgaagaatggtactttatgaaactgtctagatgtgcttattgaaggaagaatttgagaggagtagaagagcttagtaaaaaagatttgtgtgcagcacacaagtcctcaaagaaggctgctgatgaagctttttatctttctcttccaagattctacacagtacagggctggagtttcaacatcaagtcgaggaagccaaggatttagatcaattgattaaaattcactataggtatctgtcaaccatccatgaccggtgtctgctgagagaaaaggtacatgagatgtctcctgcagatgtggccactgctgggcgagtggcgctgtctgcgtgctttggaattttatgatgattaagcttctgtcctgtagaatattctttaaggaagaaccagatgaaatgaggttacaaacaaatgccccaggccggccacaatggctcatgcctgtaatcccagcacattgggaaactgaggcaggcagatcttatgaggccaagagttcaagaccaccctgggcaacatagcaagactctgtctttacaaaaagttaaaaagattagcagacatggtggtgcatacctggaggcccagctacttgggaggctgaggtgggagcattgtttgaggccaggagtttgaggctgcagtgaactatgatctgacaccactgcactccactccagcttgggtaacagagcaagaccttgtctcttaaaaaaaaaaaaaaaaaaaaaaaaaaaaacagaaggaggagtgccctattcgtagaaattgtatctaagagcaacatgagaactatgtgtgatagtcaacactcactctgcgttactcttggattcatttggaaaattgtgtctgcagttgcggagcaatagcatgtccacttcatgtgaatagatagaattcagtaatgttaaaaccattgcaattatttgtcctagtttcattggtgaatttaaatggccatcccaggaaaaggtcttaatagtttgttttgttggtttgactgtactgctaatatcacttgtatcttacattcagtgaatgcatgtgcctggtcccaaatgggcatggttcagagcctagtacccttccatatacacagaaggcagtcactgtggtgatgaactttttctgtgattcatttaaaataggtaaaagtgttggtatcagtgtccaaacctagttacacagtttgtgttctgtgactttggtctgcaggtcagctttgtgaaagaagctatcatgaaggtgttgaacttggctctcatgtttgcagacggttggcaggcaggcctgggcacttggcggtaagtatgtgatttctgcagcatctgcactgtgaccatttcagcttcagcttcccttttttttagagacagggtcttcccagccattcaggaggctgagaggagaggattgcttgaccccaggagttcaagactagcctgggcaacatagcaaaacccagtctttaaaaaaaaaaaaaagtgcaagtattttttgagaagtaaaacatttttaaaaatctgaggtcttctgatttaaacaagcaaacatttttagattatactcatgttatattgtgtacgttttgttaaatttttatcatggacaccttcaaactgaagtggcaaagacagtgttgtgaacaccgtgatggcacctgcttcagctgtgccagtgaggacagctctgtcatgtctgtgcccacctccccagtcacacttgctgaattattttaaatcaaattctggacatcatgctagactattctccaaagttgtattttggatgagctctaaaagatgctgtgttttgagagtgtttgttattcacacacatcacataggcaagtgcactgaatcaggggaagtggcccgggagcagctccctctagcactgccatcctctactgttaactccagtgtacagctcaatattttgttacctgtcctgtttataaagtcagtgcaacagtaattctgctgttacttccatgaaataaaagtgcatgtttggttgactgtacttactccatgtcagtaaggaagtaagaattcatttgagtgctagtataattcgaaatctcccattggctgtactcggaatcaagaaactaaggtagtagatgaagccatagctgcagggatggaaatagaagtcttcctcgctttatattgctggctcaaagtgtgcaaaatatattttgctttttttttttcttttttttttgtctcactttggggtggaggagaaataacactgctgcatatgctttgctgaaattcaactctttcaggttttttttacaaataaatgtgagaaaaatacagggggtgaggaacttaagaagtctatcaaccatcgcagtttatggataagttaattgttcctgattgagacttaaagccgaaaagtgaaaaattgtagaagcaatgtgaaatttgcttgaatgctattagatgatatttttgagcaaatggtgttgtggctgtgttttgaaaggagtctttatctttaaagtatacatttatacttatgaaatattcatgactgtggtgctctgatgtctcctgtttgcttctgaatattgtggtggggctgtggaggtgtaagcttggcatgtggcacctgccatggctgggcagtgggccatggaaaccccttctgaagttctctcttacaaagtgtttgatatttctttaaaaaaaaaaaaaagaaagaaagaaagccgagcacagtggcttacgcctgtaatcccagtgctttgagaggctgaggtgggcggatctcctgaggtcaggagttcgagaccagcctgaccaacatggagaaactccatctctactaaaaatacaaaattagccaggcgtggtggtgcatgcctgtaatcccagctacttgggaggctgaggcaggagaattgctgaacccaggaggcagaggttgtggtgtggtgagccgagatcgctacattgcactccagcctgggcaacaagagcgaaactctgtctaaaaaaaaaaaaggcagccaggctccatggctcacaactgcaatcccagcactttgggaggccagtgggggcagatcagctgaggtcaggagttcgagaccagcctgaccaacatggcgaaaccccatctctacaaaaaatacaaaaattagccagacatggtggtgggcatctgtaatcccagctactcaggaggctgaggcaggagaatcacttgaacccaggaggcggaggttacagtgagccgagatcgtgccactgctctccagcatgggcgacagagcaagactccatctcaaaaagaaaaaaaacctttttaaaaataatttcagattttaagttttatatccttaatgtgttctttatttcaaagagaatgtatgcttgtaaacaataaaaacaagactgtataaaggaaaagggagtatctttggtcctcctagttccagaactagatactatctggaaacagcacagttttatatcctaatgaaacttcctttgaaacactttgacattttttattttaaagtagggtaggacgttatgtgttttattttataatctttagatttaggattttaaataattaaaccaaaatacatttgaaattactccacagatatcttgaagcctacctatatacccgcaatgcacttacttaattgaaatttacttttattcctagaatggaatctatagagaaaatggaatctgattttaaaaactgccatatgtttcttgtaaccattttaaacaaagccgtctgtagaggatcctttccccattgtgagtatatcatgttaaaatatttctacctctgtatttccttgtaactaagtgtatgtgtcattgttttgttactgatcccatgaagaattagaaattctcaccattttcaaaactgaaaagtcccttagcagttgtcccatgctttgaattgctttttaagcattacggtgaggtgagtgtaagcctgaggatcttactttctggtataccatttattacaacagatttctaaaactcctattaaataaagttgatggcagaatagatttctgtcacacttcactatcgtgtagtttttgtaactatttcttttcaaaatctagtctttttaaaaatttttttaggaatttaaagctcctggcctggcgcggtggctcatgcctctaatcccagccctttgggaggttgagtgaatcacttaaggtcaggagttggaagaccagcctggcctacatggcaaaaccctgtctctgctaaaaatacaaaaatgagctaggcatggtggcacatgcctgaaatcccagctacacagcaggctgaggcaggaaaattgcttgaacccgggaggcagaggttgcagtgagctgagattgtaccattgcactccagcctgggtgacagtgggactccgtcttcaaaaaaaattttttttcaacatttaaacctattgttttaaccttatttttattcttcccacagtggaatctctagcgttgtcactcatggctggcatggaacaaagttaaatgtcttcagcgtaataaatatctccgactttgtcatcatacatgtacatttccaccatgtgcagctgaaaagtgaaaatatttttattttggtttatttgtaaaacttgtccacagtcagcctggcacagtcgctcatgcctctaatcccagcacgatgggaggccaagacaggcagatcacttgagcccaggagtttgaggccagcctgggcaacatggtgaaacccggtgtctaccaaaaatacaaaatgtatccagacatggtggtgtgtacctgtagtcccagctactcaggaggcaaagatgggaggattacttgagcccaggaggtcaaggctacagtgagccatgattgcactactgcagtgcaacctgggtgacagagtgagaccctgactcagaaagaaccacttgcccacagtccagacagatggattgtaggtgggttttctggagattagtagatactgtatagagttgtatacataaaattgtgtcagtagtacaaagtgtatataggctgtttactcttacatttcctactgtaagatacagatttatggtactgatacctttaaattatatcatattttgaaaatgtaattactgatattcaaaataaattaaaggacttaaaatcattttattatccttttgctgctgtcctacagtcacagaagctttttatatagagttttacatgttgtcttccctaaaagttgtcttagatgtagctgtcctagaaatgtttatattttggctgggtgtagtttctcaagcttgtaatcctggcactttgaaagactgaggtgagaggattccttgaggccagcagtttaagacctgcctaggcaacatatgagaccccatct[214 bp omitted]gaggcaggagaatcacttgaacccaggaggcagaggttgcggtgagcctagattgtaccactgcactccatcctgggtgacagagcaagactccgaaaaaaaaaaattagccaagcatggtggcacatgcctgtggtcccagctacttgggaggctgaggtgggaggatcgattgagaccgggaggtcaaggctgcagtgaaccatgattgcatcactgcactccagcctggacaacagagcaagaccttgtctccaacaaaaaaaaagaaagaaagaaatgtatatatgttttgttgtgcctgagaagttctacatggaaaatagcttcaactgatagcgataaatgtaaaaggccaacttcacttagggccaactgttggtacatactattgtttggtatttccttgttttttgaaatgtggaggctcactctgttacctaggctgcagtgcagtagcacgatctcggctcactacaacctctgcctcctggattcaagtgattctcctgcctcagcctcccgagtagctgggatctcaggcgtgcaccaccacgcccagctaatttttgtatttttagtagagacagggtttcaccttg[136 bp omitted]ttgaatagaattatgcttactattaaatttttccatattttctttttatagagtgagactatctttaaaaaaaaaaaaggccacacatagtgactcatgcctgcaatcccagcactttgggaagccaaggtgggtggatcatgaggtcaggagttcgagaccagcctgaccaatgtggtgaaaccttgtctctactaaaaatacaaaaattagctgggcgtggtggcacacacctgtaatcctagctactcaggaggctgaggcca[144 bp omitted]caaaatgtggaagttaggactagaaagcttctagaagcaaacatgggaaattaacactacaaacttggggtagacaaagatttcttacataaaatcaaaaaaggggccgagcacggtggctcatgcctgcagtcccagcactttgggaggtcaaggtgggtggatcacctgaggtcaagagttccagaccagcctgaccaatatggggaaaccccgtctctactaaaaatacaaaaatcagccgggcgtggtggcgcacacctgtagtcccagctactcaggaggctgagacaggagaatcgcttgaacctgggaggcagaggttgcagtgagccgagatcacaccactgcactccagcctgggtgacagagcaagactccgtctcaaaaggaaaaaaaaaaaggaattattggtgaattggacatcaccaaaaaacattgctaggaaaatggtaatacaggccacagactgggagagaacatttccccttagcccctttcaggaaccatgtcatgcccagaggcaaccactgttgcccagggtgtccagaagtaactatgttcagagtgtatgaaggcattttaaattagtaagacaagcttttttttttttcattgatgcaaggtcttgctttgttgcccatgctggagcgcattggcacagtcttggctcactgaagcctcaacctccggggagcaagcactcctccctcagcctcctgagtagctgagactacaggtatgcaccaccatatgcggctaatcttttgtgtttttttggaagagttgggttttcagccaggtgcagtggctcatgcctataatcccagcactttggaaggcctaggcagaccgatcacttgaggccaggagtttgagacccgcctggccaacatggtgaaactccatctctactaaaaatacaaaaaatagctgggtgtggtgacagacacctgtagtcccacctactctgggaaggctgaggcatgagaattgcttaaacctgggagttggaagtggcagtgagccaagatcacaccacagcccttcggcctgggtgacagagcaagactctgattcaaaaattaaagaaaataaaaattaaaaagatgaagtcttaactatgttccccggctgatgtgaattcctgggcccaagtagtcctctggcctcagcctcccaaagtgctgggattacaggtgtgcgccattgcacccagcccaagacattttttttaatgagcacaaagaggcaaggaaggcacaaaaatggccaattaaaccgcacgagcaccacagcctctggcatggctaaaataaaaagaccggcatgtcaaataattttcaaggatttagagcaactggaaattacaagatggtacaagcacttggggaaactatatggcattttcttacaaaggttaacatgtatctacccctgagaagcagcagttcacccttaggtatttatccaagaggaatttttaaatgcgtccacgcagagatttgtatctgaatattcataagagctaaaagctagaaacatcctgatgacggtgaagaggtagatggatcaacactgaagtatatgcacgcagtggaatgcagttcagctgtgaaaacacagctcatccacataacgacataagagaattccaggaactttatgtcgaaaaaaaagccagacttaaaaggatccgttattattccatttacatgaagttaatgaactggtaaaactagtctccagtgatagaaattgcaacagtggttgcctctggccatgacatgttacctgaaagggggttgggggaaatttctgggggtgatgggtgtgttctgtgtcttcattggtcccacaggtacatgcatgtgacaaaactcattgaattgtatcaagtgtggggctgggtgtggagcaactgggaatttcttacattactggtggaaatgcagatggtacagccaatttgggtttttttggtttttgttttgtttttttttttttttgagacggagccttgctttgtcacctaggctggattgcagtggtgcgatctcacctggtgtgtgtttgcagatgactttcctagcagcacatcccaggaggtttcttaggttacacaatgtctttaaagctgcaggtggctttgggccaggtgccctcctatgggggaccacgaacaaggtggagccggacaccagtatggtgcttcccaacagaatccaggggtcacttctgtttttataattgaatgagtaaaacagcatctgagtgatcttttaatttgtatttcttttatttattcttttatttttatttttatttatttatttattttagacagattctcgctctgtcccccaggctggagtgcaatggtgtgatctcagctcacctcaacctctgcctcccaggttcaagtgattctcctgccttagtctcctgagtggctgggaccacagacgcacaccatcatgcccaggtaatttttgtatttttaatagagatggggtctcaccgtgttagccaggctgttcttgaactcccgacctcgagtgatccgtccacctgggcctcccaaagtgatgggattacaggcatgagccactgcccccggccttatttttaaaatatagatggggtctcgcta[139 bp omitted]tgttaaacatatctttattaaacatatttttacaatgttaaacaacttatcacccagcaatcccactcctaggtgtttacccaagagaaatgaaatgtatattcacacaaaaacctgtacacaaatgtttatagtggctttacgaataagtgccaaaaactagaaacagtccacatgaccatcaactggtgaatgaataaacagcttcaatttacccaatggaatactgcacagaaaggaaaacatgactttgtaacaacttggatgagtctcaaactgcttgagttttctgaatgaaaagacatctttacactgaatctaagagctgttcctttgctcatgtgtgtggaaaagctaaggccgtgctgcacatcgccctatcctatctgtaaaatggactgggaccaggcacggtggctcacgcctgtaatcccagcattttgggaggcca[133 bp omitted]gctgaggcaggagaatctcttgaacccaggaggcagagttgcagtgagccgagactgcaccattgcactgcagcctgggcaacaagagcaaaacttcatcctaaaaaagaagggaaaaaagaccctattgttggagagattctgtgagacacacccttaatctattcacagagcctttagtgtcactaaagggtactctgaggcaacatttattaatctttttgacatcagaagctcagtggctcacacctgtaatcccagcattttgggaggccgaggcaggcgaatcgcttgagcccaggagttcaagactagcctggccaacgtggtgaaaccgcatctctacaaaaaatacaaaaattagtctgggcacggtggctcacgcctgtaatcccaacactttgggaggccgaggcaggtggatcatctgaggtcaggagttcgagaccagcctggccaacatggtgaaaccccatctctactgaaaatacaagaactagctgggcatggtggtgcatacctgtaatcccagctactcaggaggctgagacaggagaaccgcttgaacccaggaggcggaggttgcagtgagccgagatcgcaccattacactccagcctgggcgacagagcgagactccgtctcatattaaaaaaaaaaaaaaaaaaaaaaaaaaaaaaaacttcgggggctgaggtgggaggattatttgagcccaggaggtcgagggtctagtgagcttgatcgtgccactgcactccagcctgggcggcagagtaagttcatgtctcaaaataaaaaagagtttccagctgggcgcggtggctcacacctgtaatctcagcactttgggaggcagaggcaggcgaatcacgaggtcaggagttcgagaccagcctgaccaacatggtgaaaccctgtctctactaaaaatacaaaagttagccgggcatggtggcgcatgcctgtgatcccagctacttaggaggctgaggcaggggaatcgcttgaagccgggaggtggaggttgcagtgagctgagatcacaccgctacactccagcctgggcgacagagcgagactcaatctcaaaaataaagagtttccaatcacatcctgagcatcgtctctagagcacattttcttggcagtgccatatagtttatccttgctcgatagtcattttcttattttagcatcatttgccgtatggggaggctaaaacatttcaaaaccattaattctgtctccttttttttttaaatctttctctcagttaatgctctcctctcacattttactatacccagcaggaagaaaccaggcagcatcttgaatactttgtttggaaaatctcattagctaggtcacccgtttattatgtatattctgtcctatccatgtaacgtcaggtaacagcagggctaaactttctgctgctacttagtgaaagtcttccttcaatttccaataacaacattcttctcactttcttttaagccctcttcagcaatgtcctcaaagtccaaagtctaagaacagtgtgttcaaagcactttagtgtcatcaacactctcctcaaaccctggtcccagagccatgcccacctgttaggttttgctacagcagcatcctctctctgtaccaaaatctgtatcagtccaagagcagagccattaatatacatgtgtgtgtgtgacacacatatacatacatatatatgtgtgtatatatatattacccatacacccatacctgtggataatcgtggacttgctgcagggctttgctcttacacagttaattgtgtaaactgattcgtcagtttccatagggctgcctgttgtctgcatccgacgctggagcctactgtccacaggaggtttgggagggacctaaacctgcgtcagttcttgctgcttctggccttggtggtgtggaggtgctgcagaagctagggcctctcatcatgaagatgagccagatgcctccttcgggagccacaggatccagagagtcaatgaaagtaaaacttcaggactgtctggatttattacgccagggaggaagttgagccctggagactgtcaggtcgtacgactgcaattcttctcagattcactctcttcctcattgttcttgttctgtaaatgactaagagagaccagagaccagacctccccacttccaatcactggttttgttgtagatgaactgcctcctttgctgtccggtacctaatgtggaccagacggtgctcaagaccctatcactagtacaacctcagtgtggaatgttaaatatgccttgcctggaagaaaaagaccaacttgactaatcagatcatcataactatgcatgaagtcttccacagaaagatgatgaaattttgttacacttccctaacctttgtctaaataagcattcccaaacatctacactttggaacactgacttctgttctttgagatgggtgcttcccaggtggcccatcctcaaactttttgcttgaataaactctctaaactagattctgttccttttgattattttaggttgacaagaagaaggcagtagtggcagtcctggccatggtggtgttaacagtgtaagctgtcagacccacaacacgtgtgagccacaacacagtggcagctccctgcctctccccaagcctccgccagcgcctccctcatggtcttgcagaaacacaggaagaactctagtaaacctgggtcagcttagccagctccacatgctgcaaagccaccacatcaattcat[132 bp omitted]gaaaccccgtctctactaatatagaaaattagccgggtgtggtggtgtgcgcctgtaatcccagctactcaagaggctgaggcagtagaatcacttgagcctgggaggcagaggttgcagtgagctgacatcgcgccactgcactccagcctggtgagcgcgcgagactccgtctcaaaaaaaaaaaaagtaatttattataaggaagtccttatactgttgcctgtggctgctgtaacacattaccataaacctggtggcttaaaacaacagatattcattctcttgaagttctggaggacagaaggccaaaattcaagggagcaatagggccatggccgcgccattctttgcctccccagtttctgggggctgccagcattctatgactgtggctgtgtggctgcttcactcccatccctgcctctgtgttcacactgcctctttctgggtctgttctctgcgtgtctcttgtaagcacactgcttattggatttagggccccttcagataatctaagatgatcccatctcaagaacttagatctgctaagactctttttcttcacataaggtaactgtcttagtctgttaaggctgctataacaaagcagcatagactgggtggctctaaacaggagaaatttattacagttctggaagctgagcgcccaagatcatggcaccacagagttggtgtctggtgagggaatggaggaattttaatccaaaaatgcatgctgtgtttcctgctcggggagagctgtctccctgttctgctggtatttgtttttctacctgttacttctgctttctcacctttccttgctgtgcttttcctgtagtggttggaaggtggatgctcacagatcccaaatgcacgtgaccagttcttggctccagccttggcctgggttccccagaaatacaacctgagacaaagccgtaggtgcctctactctgagatggggtgcagtgcccgtagtgggagtcagagagtgccctagcaggaggaggagagagatggaagaggaggggaagaggagggggaggagtgggagaaggagggggagtgctgatggatatggggccatctcagtaagatggcattgctaagtgtgcctgccccacctctcgggatgtccctagaagccatgtggactgcatcaggaaggaaagagaggaatctgcctgtgagtgcctctcattagtcaaaggtgcagggaatgttaactctgtgcacagctgcatggttcatgtgtgatctcagaggactctgatgcctcctggtgacagggaagccccagggcaggaggtgagagatccaggcgggcaccagggagacgtgtggttgggttcttggttggagtccacatgttttcactgcagaagaaataaaagtcctgaagttaggaggctgtgatgtgagtgagaaagttccaactctaagctcccaaccaaggttcccacagcgagtcaacttgggtcaggtgcccactccagcttgaacaaggtgtggcaagaaataagagatcaggttgtacaaatatagcagctgagatcatgctattgtggaatggagggatcagttaagaaggaattaaagttcctcctggttggccaggcacatgacttgcacctgtaatcccagcactttgggaggccaggtgggaggatccctggaggccaggagttcaaggccaacctggacaacaaagtgagaccctgtctctagataaataaataaatcataaatttaaaaagacagaccaagacaagtatgatttaaggggatatgtatgggtgccaagttaacagggggtgggttgtggtggtctttttattgtgtcaacctagtgaggctgtcccagctgttctatcaaacacacacctcgtgttgctagaaggtatttactggatgtgattaaatttcatatcagttgactttaagtaaaggagatgatcccaggcagtccagctgggccggattcaatgggttagaggacactgaggcagagctccagcttcctgagacaaggcggaatggtagccccaaagctgtctgcttcctaatccctgggccgtgtgactatgttagtttacatggcaagaggagaattaaaattgcagatggaattagggttgctagtccactgacttgagatagagacgttaccctgcattatctggggatgtcgtcacacggctcctaaaggtggaagaggggacagaagcacagtgtcagagaaaggtgtgaggccagggcagcctgagggcagagccagctgagggctttgaggacagaaaaagtcaagggaaggagcaggatccgggaatgtgagtggcctctacaccaatatggagaaatcctgtctgtactaaaaacacaaaaactagctgggcctggtggtgcatgcctgaatcgcttgaaccagggaatcggaggttgcagtgagctgagatcacgccactgcactccagcctggcaacagaacaagactccgtctcaaaaaacaaacaaacaacaaacaacaaaaaaacagattttttttttttttgagacggagtctcgctctgtcgtccaggctggagtgcagtcacgcgatctcggctcactgcaagctctgcctcctaggttcacgccattctcctgcctcagcctcccgagtagctgggactacaggcacccaccaccac[136 bp omitted]caaccggccaaaaaaaccagatattaattatcttcaagttctgggggctggaaggccaaaattcaaggcagcaatagggccttgcctccaccattctttacctgctcagtttcgggggctgccagcattctatgacttgtggctgtgtggctgcttcactcccatctctgcctctgtgttcacactgcctctttttctgggtctgctctcagtgtctcatgtaagcacactgcttattggatttagggccccttcagataatctaagatgatcccatctcaagaacttagatccgctaagactctttcttcatataaggtactgtcttagtccgtcaggactcctataacaaagcaccatagactgggtggctataaacaggagaaatgtattactcatagttctggaagctgagtgcccaacatcaaggcaccacagagtgggtgtctggtgaggtcccactgtctggttctcagtggctgttgtctggctgtgtcttcacatggcagaaaggacaaggctgttctctggggtgtcttttttttttttttttttttttttttttgagatggagtctcgctctgtcacccaggctggagtgtggtggcgcaatctcggctcactgcaaactctgcctcccgggttcatgccattctcccacctc[224 bp omitted]aggactctacttttgtgacctgtcagctcccaaaggccccacctcctaatgccatcatcttggtgatggggtttcaacatagtagtaacagccacaggttccagggatttgacacaggtatttgctgggggatgctttttcagtttaccagagccaaaaatttgtagtaatttgttgtgaccgtgacagaaacctaaaaacaggacagtaactttcttttctttttttttttttttgagatggagttttgctcttgttgcccaggctggagtgcacaatggagtgatcttggctcaccacaacctccgcctcccccattcaagtgattctcctgcctcagcctcccaagtagctggaattgcaggcatgttccaccacgcccggttaatttcttgtatttttagtagagatggggtttctccatg[139 bp omitted]cctagctgagccagcccccatagtgcataagccaattccttgcagtaaatctcctaatatgtatctcctactgattctgcttttctggttgaaccctgactgacataatatgcttgtgtcaatatcagcctgacaaagatgcagaatatttccaagtccccagaagtttcctacacgcctcttttcagtccatcctattccctgcagaccacctcacccaagcaaacgatttaacgatttctgacttccttttctttctttttttttttttgagacagagtctcattctgttgcccaggttggagtgcggtggcgcaatctcagctcactgcagcctccacctcctgggttcaagtgattcttctgcctcagccccctgagtagctaggattacaggcacccaccaccacacccggctaattttttgtatttttagtagagatggggtttcgccatgttggtcaggctggtctcgaactcctgacctcgagtgatccacccgccttggcctcccaaagtgctgggattacaggggtgaaccaccacgcccggccaatttctgacttctgtcaccagtgagtagtggtgctatctgtcatggaagttcatatagatgaaatcccacaatatgtacatggtcttttgtgtgtggaaaattacagaatagttttgaggttcatctattttataatactacttgtatatccattttcttccccttttaaaaacttttttcatcatattgttttccatagtggcaccattttacatgcccactaagagtacacagagttccaatttcatcatatccttgccaatacttgttattttgtttatt[170 bp omitted]caccacacccagctaatttttttgtatttttgatagagacaaggtttcaccgtgttagccaggatggtctcgatctcctgaccttgtgatccgcccatctcggccttccaaagtgctggaattacaggcatgagccaccgtgcccggcctattatttcttttttttgagatggagtctcactctgtcgcccaggctggagtgcagtggcaggatcttggctcactgcaacctccgcctcctgggttcaagcgattctcctgcctcagcctcccaagtagctgtttgttgatagtaggcatcctaatgagtgtgaaatagaaaaacacaagaacaaatccttttgatttgttctttcctttttattgctgagtaatattccattatatgaacagtatttgtttatccattctcctatttgtgcactttgggttgtttctagttttttgcgattataaataagctggtaagaatattcattatacagccaggtgtggtggctcatgcctgtaatcctagcactttgggaggccgaggcaggcggatcacctgaggtcgggagtttgagaccagcctgatcaacatggagaaaccccatctctactaaaaatacaaaattagccaggagtggtggcgcatgcctgtaatcccagctactcggaaggctgaggcaggacaatcgctttaactcgggaggtggaggttgtggtgagcagagatcacgccattgtactccagcctgggcaacaagagtgaaactccatctcaaaaaaaacaaaaaagaaaaaacaaaagactattaattatacaagtttttgtgcagagattaatttgtatttctattaggtaaatacttagaagtagaattaccatcataggagatatatatgttgaattttataaaagacttccaatgtggtttctttctgaagtgtgagttaaagtcttttgccctatttttcctgcattgtcattttattgttgtttgggttctttacatattctggacacaaactctctgtctgttatatgtattgcagtattgtcttgcaatattgtctatgtcttttcactcttttaacattcttttgatgagaagttttaaatttcgatcaaatcaatttatcatttttttcctaaaggtactaaccctacatttttgagaaatcttgccttcctctactctaccgttataaaattattctcttatgttttcttctagaagctttgtatctttagctttcaaatttaggtctatgatccatacacagccagttactttttgtacatggtgttggggaggaagttgagtttcagtttttgtacatcgttatgcagttattctagcaccatttttaaaaaaagtttcttttattttttttttaacacggagtctctctctgttgccaggttggagtgcagtggcatgatctcagctcactgcaacctctgtctcctggattcaagtgattctcctgcctcagcccccggggtagctgggattacaggcactcgccaccacacccagctaattttggtattttcagtagagacagggtttcgccacgttggccaggctggtctcgaactcctgacctcagatgatctgcacgtcttggcctcccaaagtgctgggattacaggtgtgagccactgtgcccagccaaaaaagagttttctttctccatggaagtcctttagcatcttaattgaaaaccaattgaccaaataatgtgtacttaattttcactattctgttccattgctgtatagtagtctcatttctatagataattcttcattggctgtttgcccttaggcccatttccagaggctttaaatggttatttattttattttattttatttcgttctatttttttgagacagggtcatgctctgtcgcccagcctggagtgcagtggcacgatgtcagctcactacaacctccaactctcgggttcaagtgattctcctgcctcagcctcagtggtagctgggaccacaggcaccgcctactatgcccagctaatttttgtattttgtagagagggggttt[133 bp omitted]atactcacctattttcagactatggttgaccatgagtaactggaactcagaggagggggactactagtacagtataatgagatattttgagagagagacgaactacatcacttttattatagtataccactacaattgttctatttttattattgttaatgtcttactgtgtctaatttatttatttatttatttttagatggaatctcactctgtgagtctcactctatcgcccaggctggagtgcagtggcacaatctcagctcactgcaacctctgcctccagagctcaagcaatccgcccaccttgacctcccaaaatgctgggattaccgacctgtgtgtactttataaattaaactttatcataggcctgcatatatagaaaaatatatagtctatacagtgtagagtgtgctactatctgtcctttcagacatccaccaggggtcttgaagcttatcccccagaagatgaggtgggaactactgtaaataattttgaccctttgaaatctgatgagacttgttttacttcctaacatatggtatattttgtgaatgttacgtgtttatttgaaaactttaattcctgtcagtaacagcttgaagtcttcagtacaaagcgtctgaacatctttcattccgtacaatgcattctgtattctgttttgtggaggtgccatttaggtataatacgttaattacttaaaaaaaattttgtatctttacttctttttgtgtctgcctgtcctatcaattactaatagagagaagttcaaatctctatgagtgtgtattcgcctatttcttcttttgattctatccatctttgtctaaatatttcaaaacttatttgatgtatatatgcactaaaagttattttttcttccttttcttttgagacggagtttcactcttgttgcccaagctagagtgcaatggcacgaccttggctcactgtaacctccgcctcccgggttcaagtgattctcctgcctcaacctcccaagtagctgggattactgcaaccttcgcctcccaggttgaagcgattctcctgcctcaacctcccgagtagctgggattacaggcatgtgccaccagacctggctaattttttgtatttttggtagaaacagggtatgttagccaggctggtctcgaactcctgacctcagatgacctgcccgcctcagcctcccaaagtgttggaattacaggcgtgagccaccatgcccggcctattttttcatacttaattgacccatttatttttatcaaatgtcctttttatcactgatagtgccccttgagttgaattctactttgatattaatataatcactccacctttctgattagcatgtccttttgcatctttttaatttcagcctctttgtgtccttatatttaaattatgtctttttttttttttttttttgagaccaggtttcactcttgttgcttaggctggagttcaatggcgcaatctcagctaactgcaacctctgcctcccgggttcaagcgattctcctgcctcagtctcctgagtagctgggattataggcatgtgccaccacacccagctaattttgtatttttagtaaagacggggttttgccatgtgggtcaggctcgtcttgaactcctgacctcagttgatccacccgcgttggcctccgaaagtgctgggattaacaggcatgagtcactgtgcccggccaaaattatgtcttcttaaaacagaatatatttgggtctcgtttttaatccaatgtgacaatttctgtgttttaatccatttacagttagtaaacggattacatgtttagtccatttacattcaatgtgattactaatgtggttgaagtctaactgcttgctctttgtctttgccttatgtgctttttgctccttccttcctgctttcttttggatcaagcatatttttgtattctattttatctcttttcttggatttttagctgtattattttttattaattgctctagggattacaatattttattattttaagacggagtcttgctctgtcgcccaggccggagtgcagcgacacgatcttggctcactgcaacctccacttcctgggttcaagcgattctcctgcctcggcctcccgagtagctgggattacaagcccacaccaccatgcccgactaatttttgtatttttagtagagacggggtcttcaccatgttggccagtgtggtctcgaacgcctgacctcaggtgatccgcccgcctcggactcccaaaatgctgcgattacaggcgtgagccactgcgctcggccgggattacaatattttaaattatcacagtataacttgaatttgggttctatcatgtcatctacaatgtaaaaacctttggaatctaattttgagactccaccctaggcacagaaaaggagtaatctgctgatttgaaaatgtgtggactgggaaccagaatgttatccaaagcccctgttttgcaggaatgtgagaaagtgatatccgaatattgagtcaactggtagattgtctcaatccgctggtcaggattcatttgctgctttttgccttaccgcagagcacaagcgggggtaaccaaaccttcataatctagagaccagactagaatatctgatgcccatccttactgttctccgtaagaaccaggggtcgcggatgaatggggagtgaggttgctgcggctgagcggggcgtttagggcagttttcctaaacacgcctgtgaccagctgactccactcagcgtttccgtgtgaggtatgtttcttcaccggcctttcaagattgttttttggcacgagctcaaatcaggttttcttccgtccgccgttcccgcaggtctgcgcacggatttgtccctggttcccgcaggcaatggggccgcaggggccggccgggggggtccccagcgggctctgcgcgccgacctgcagctgggacccgcgcctggaaccctcccgacgagcgcaggtgagcgcctcctgccaagtggggcggcgccacacgggcgtcctgggtgtccccctgagctccttccgcagctcaggccaacccccgccctgacccggtggagccccgggacagggtgcggaccccgttccttcgcgctccgaaccggacggacccgcaggaggaccccacgcccgctccgctccgaccccgccgtcccgcgcaggctgcggtgacccaggccggcaggtagccaggggctctctgcctgggaggacaccttcggcggctggcgtggggaaaggggccgcccggccggggatgccccgccaggaggagggagcggccggggccgcggccgggagggaggagcgccgggaggaagaggccgagccgggagagcccccgccccgggaggaaggggaggaggccgagtgtttcctggcgcattcccggccagcccgagtgactcactcggccaaggaaactcccagggcccgcccaggacccccaagccgccgcggacgcaggtgaggaaccccgctcgcccgcgcctgccctgcggcctccgcggggtccgggtccccctcggaacctgggccggccagggcggcggcggggccgggacggacccccccctcccccccaaccccggcggcgcggcctccccggcggcgcggcctccgggatcgtcctggtccccgcgtcccccaggtcccggccccgggctcccgcgcctcccgggctccaggtccccgcactccctgcactggcttcccggtccctgcgcccccggcctttcggcctcggccccgagctccccgcccccgcgttcaccgcctcgcgcccccggatcccggattccgcgccccggcacatggcacagctccagtggcgaaggaataccttagtgtttgacgtttttgttggaaagtaaggagcaggcagattgttaatgttgcactaaggtcgcgcagcaagatctgaacccgtttttgtttcgtgcccctgtgaggagcggagggagcctggtccgcggagccattccgggcattcttggagagaggagttttgggctttgttaaggaggcgcgatcgttacggaggcagcactgtttcgcacaagcatctgaattgtgtattttaaggctgaaatgcgtgagcttaatttgcagcacattgtgggtgtgacaagaagggtgcaagaataatcgggaaacggggttgatggaacgtgttttaagctgagaggggcgtctggacggtgtcagctccgctattaagtccagtcagggagcggctgctgattgagcccagcgccgcgtggtcgccgctggggactgaggctcgggagcgtttgttttctggcggcggagggcaccgtggctgcgccgggagcggtggtgtttcttgcagtcgtccgtcggactccggaatgaggcgtggtcggagccgcggtgatgcctggtgcagtgcgcacattgctatgcttgacagcttggcggcagagtcccggccaggccgggacccgcgggggccccacgcatgctgccttttccctgcgggtggccagcggttttccaagtgatgtctagatctgcaggcacggagcctggaagaacgagtcacgctgtgagtgggcgcgggccgtagcaggtgtgcactcgtagggccagtagggatatagtgccggtgccctcactgcgaccgaggcgccctggagtcgtggcggaggacgtttcctgcgttaagacaggtgtctgtgctgcgctcaaagaaaatgtaccccctaagtttgtgtgtgtgtttaaatttattttaaacttttagtaagattcactttttggtgttcagttcagtgagctgtagcaggtgcatggactgtagtgacttccaccgcagtcaggatactcaggaaggcagcctctctcctccccgctcttgcagccgcctgtctgttcctcagtcctcctgctttgcccattccagaatgtcacatgtgggcttggagtctggcttgtttcgcttagcataaggcgttggagattcagctatgctctggtttgtccctgaagagtaaagatacaagggtctgaaaagtgtggctctcggatacagcctgagagagagactaaaatgataaagtgatgagaaaaattacaaaactatagttcattaaaaacattaaacagcatagaaccgtgtatactaaaagtgaaattccctcggtacttctaagtagtataatagtcttttctgtgcataagtaattttttaaataacatagtgagatcatattgcatatattatcgtcatacatttttcacttaatgatgtttggttacttaaagatcttagcaatctttacatgttgatatatatagtctgtacacacagatttccctcaatcttttaaataaccgtatagtattccttttttttttttttttttttttttttttttgtgacagagtcttaactctgtggcccagactggagtgcagtgacgcaaactcggctcgccacaacctatgcctcctgggttcaggtggttctcccacctcagccccctgagtagctgggattacaggcacgcaccaccacacccggctaatttttgtctttttagtagagacggggttttgccatgttgcccaggctggtcttgaactcctgacctcaagtgatctgcccgcctcagcctcccaaagtgctggtattacaggcatgagccactgtgcccggccaaatcactatagtattctgtagtgtggatgtttcataattttatcagcctcctgttgattgacattatagttatttactgtttttcaccactacagtcaatgcttgtgtctgtatctttgtgcacatactcaagtttataatgctaaaggtgactttgggtttaaataatagctaacatctccctccctcctttgttttcttttcttttatgttatgttattttattttattttttgtgagacagggttttgctcttgttgcccaggctggagtgcaatggtgtgatctcggctcactgcaacttccacctcctgggttcaagcaattctcctgccccagccttccgagtagctgggattacaggcgcctgccaccacacccagctaatttttgtatttttagtagagacagggttttgccatgttggccaggctggtctcaaactcctgacctcaggtgatccacccacctcggcctcccaacgtgctgggattacaggcgtgaaccaccgcgcccacccaaaacatattttatagtgtgaagttttaactaacatgtccaagctattctcattgtttttcctattaaaatttagccaacccttagaggccattgataaagcatggattaattacactgacataatttaaaaaccttattttagccagtgcaatagtatcagacaaagaaagaaaaggcatacaaattggaaagggaaaattgtccctatttgctgacaacatgattatctacatagaaaatccagggaatctatgaaaaagctactagaactaattaatgaggttagcaaggtcacaagatacaaagtcaacacacagaaggcgaccttatttttcttttttttttttgagacagagtttcattcttgttgcccaggctagagtgcaatggtgcgatctcggcccaccgcaacctctgcctcccgggttcaagcgattctcctgcctcagcctcccgagtagctgggattacaggcatgtgccaccatgtctggctaattttgtgtttttagtagagatggggtttctccgtgttggtcaggctggtctggaactcccaacctcaggtgatccgcctgcctcggcctcccaaagtgctaggattataggcgtgagccaccgggcccggcctggcgaccttatttctgcatacagcagtgccccttatccatggggagatacatgcaaagtcaacactatacaagctgaccttatttctgtttacaacagtccttgttatccatggacgatacgttccaatggaagcctgaaacctgagataagacagaaccctccgtgtactgtggtttttttccctatacatctatgcctatgataaagcttaatttacaaattaggcgcagtaagagattaccaacaataactgttcataatatagaataattatatactgaataaaagttatataaatgtgttctctctttcaaaatatctttttgtatgcactcacctatttttggagggcagttgactgtaggcagctataactggggaaacagaaattgcagataatgaaactacaggtaagtggggact[142 bp omitted]cctgtctctactaaaaatacaaaaattagttgggcatggtggcgtgcgcctgtagtcccagctactcaggaggctgaagcaggagaatcgcctgaacccgggaggcggaggttgtggtgagccgagatcgcgccactgcagtccagcctgggcaacagagcgagactccgtctcaaaaaaaaaaaaagaaaattaaatttaaaaacacaacatttcgtttgcttcaaaggaatcaaatacttaggtatacattgaataagacttacaggatctgtatgctgaagatgagagaaatcaaagatcatttaagtaaatgggggaacataccatggtcagtggttggaacactcaacatagtaaagacatcagttctcttcatattgatctataaatttaacccaattccaatttaaaaatattagcatgctttaaaaacaaaaattttaaacaaaaattttgtttattgaggtataatatacctactttataaaattcacctacttttaagtatacgtttggctggcctgtgaacgagggggttagggattccaaccccctgtgcagttgaaaatccgagtgtaactttttttgagatggagtttcgctcttattgcccaggatagagtgcaatggcacgatcttggcacactgcaacctctgcctcctgggtttaagccattctcctgcctcagcctcccaagtagcttggattacaggcatgcgccaccactcccactaattttgtatttttagtagagagggggtttcactgtgttggtcaggctgatctcgacctcctgacctcaggtgatctgcccgcctctgcctctgcctcccagagtgctgggattacaggcgttagccaccgagcctggccttta[131 bp omitted]ccaccatgcctggctaattttatatttttagtagagatgggatttcaccatgttggccaggctggacaagtataacttttgacttctcaaaagttaaaactacgtgacttcccaaaagttaaaactacgaatagcctgctattgaccagaaaccttactgataacataaacagttgattaacagagattttgtaagttatatgtattacatactgtgttctcataataaagtaagctagagaaaagaaaatgttgttaagaaaatcatgaggaagaggaaataaactgactactcatcacgtggaagtggatcatcagaaaggtctccatcctcaaaaagctcacagtgagcaggccaaggaggaggaagtggatgggttggttttgctgtcttgggggtggcaaaggcagaagtggagggaggtggaaggaggggctagagaggcaggcatacaccgtgtaacttttactggaaaaagtctgcaaataagtggacccgcatggttcaaacacgtgttgtttcagggacaactatacaataatttttagaagatttctggagctgtgcaacaaccatcaccataatccagtttttgtttgtttgttttgagacagggtctcactctgtcacccaggctggagtgcagtggtgtgatctcagcttactgcaacctccgcctcctgggttccagtgattctcatgcctcagcttcccaagtacctgggattacaggaggtgccaccaagcctgactaatttttttgcatttttagtagaggaaggggtttcaccgtgttggccaggctggtctcgaactcctggcctcaagtgattcatctgcctcggcctcccagtactgggattataggcatgagccatcgtgtccggcctgtttttgtttttttaattttaattattttttaaatggagatggggtatcactatgttgcccaggctggtcttgaacttctgggctggagcaatcctcctttcctcctgaaagtgctaggattacagatgtgagccaccaggcccggccttgctcatctgttgatggacagttaggttgattccatgtcttggctgttgtgaaaggtgctgcaataaacatggggtacagcgatctcttggacatacggatttcatttcttttagatatatacccaacagtggtgttgctgggtcatatggtagttctatttttaatattttgaggaacccccggcactgttttctacaatggctatactgatttacatctccaccaacagtgtacaagggtttccctttctccacaccctggacaacacttgttatcttttgcctttttgacaagagccagtctgacaggtgtgaggtgatagctcattgtggttttgatttggattccctgatgattagcgatgttgagcattttttcatacacctgttggccacttgtacaccttcttttgagaaatatccattcagatcttttacaattgagttgtttgaattctttgtatattttcattattaatcccttattagttatatggtttgcagatattttcctgcattctgtagattgtcactttgttgattgattcctttgctgtgcagaacatttttagtttgatgtaatcccatttgtctattttttcttttgtggcctttgcttttgaggctttatttcctcaaaataagccaggcacagaaagacaagtactgcacgatctcactcacatgtggaatctgaaaacgctgatgccacagaagaacagagcagaatggtggttaccagaggctggggtggctggcggaaggggagagaggaagatgttggtcaaaggatacacatttacagttagatacaagggggaaagtccagaataggcaaatatacagagacagagagtagacaggtgattgcctggggccagaaagcaggggagagaggatcagtgaagaacgggtagaaaaagtgagaataactgctaatggttagggagtttcttctcccttttttttttttttttttttttttgacaaggtctcgttctgtcacccaggctggaatgcagtggggcaatcatggcttactgcagccttgcccttttgggcttaagcaattctcccacctcagcctctccagtacctggcactacaggtgtgcaccatcatgcctggctaaattttggttggttgttgttttgtttttttgagacggagtctcactctgtcgcccaggttggagagcagtggcgcgatcttggctcactgcaacctctgtctcccaggttcaaacgattctcctgtctcagcctcctgagtagctgggattacaggtgtgcaccaccatgcccggctaatttttgtatttttagtggaggcagggtttcaccatgttggccaggctagtctcaaactccttacctcaagtgatcctcctgcctcagcctcccaaagtgttgggattacaggtgtgagccaccgcctaatttttgtgtttttttgtagaaataaggtttcaccatgttgctcagactggtctcaaactcctgagctcaggtgatccccctgcctgggcttcgcagggattataggctaagccaccgcacctggccacatttaagtctttaattcatttcgggttgatttttgtctatgttgagaagccaaggtctgatattatttttctgtatgtgtgtatctagttttctcaacaccgtttattgaagaacctatccttttctcattgtgtgttcttggcacctttgttaaaaatcagttggctgcaaatgcatgcatttatttccaggctctattctgttccattggtttatgtgtctgtgtttatgacaatagtgtgctgtttgggttactatatctctgtagttttttttgttttgttttgtttttgagacggagtctcactctgtcacccaggctggagtgcaatggcgcaatcttggatcactgcaacctccgcctcccgggttcaagcgattctcctgcctcagcctcctgagtagctggggattacaggcgtgcgccaccacacccagctaatttttttgtttttagcagagacggtgtttcaccatgttggccaggctggtctcgaactcctgccctcaggtgatccgcccacctcagcctcccaaagtgctgggattacaggcgggagccaccatgcccagcctctgtagtatattctgaagtcaggtagtgtgatgcctccagccttgttcttttgctcaggatagcttttgctattccaagtcttttgtggttccacacaaattttaggatttctttttctatttgcatgaagaatatggtaggtattttgatagagactgcattgaatctgtagattgcattgaatctgtagattgctttgaatctgtagattgcattgaacctgtagattgcattgaatttgtagattgctttgggtactatctattgtttatttattttttgagatgagttacctaggctgttacccaggctggagttcagtggtgcagtcatggctcactgcagctttgatatcctgggctcaagcgatcctcccacttcagcctcctgagtgtctgggactacaggtgtgagccaccacgtgcagctactttttattttatttcttttctttttcttttttctttttttttttgagacagagttttggtcttgttgctcaggctagagtgcaatggcgcaatcttggctcaccgcaacctctgcctcccgtgttcaagcagttctcctgcctcagcctcaagctactcaagctgggattacaggcgcccactaccacgcctggctaattttgtatttttagcagagatagggtttctgcatggtggtcaggctggtctggaactcctgacctcaagcgatctgcctgccttggcctcccaaagtgctgggattacaggcatgagccatcacgcccagccttattttattttttagtagagacaaggtctagctgtgttgcccaggctagtcttgaactcttgagctcaagtgatcctcccacctcatcctcacaaagtgttgggattacagatgtgagcaacagcacctggtctattaattctgttgttgccagtgtttttggtgtcatatccaagaaatcattgccaaatctgatgtcatgaagcatttctcctgttttcttctaagagttttatagttttagatccgatgtttaggcgttgatctgttttgaattaacttttcttttttgtgtgtgtgtttggttttttttcgagacagatccttgctctgtcgcccaggctggagtgcggtggcgcaatctcggctcactgcaagctccgcctcccgggttcaagcgattctcctgcctcagcctctctaggagctgggattacaggcccccgccaccacacccagctaattttttgtatttttagtagagacgggatttcaccgtgttagccaggatggtctcgatctcttgaccttgtgatctgcccgactcggcctcccaaagtgctgggattacaggagtgagccaccacgccaggccaaattaacttttctgtatattatataaggtaatggtccaacataattcatgtatgtgtggatattcagttttcctaacacaatttgttgaaaagactattctttttccattgaatgatcttgacatcattgttgaaaattgtttggccacatatgtgaaggtttatgtctgggttctttgttctgtttaattggccagtatgcctttctttatgccagtgccacactgtttcaattactgtagctttatggtaagttttgaaataaaaaggagtgaagtctccaactttgttcatctttttcaagattgctttggctattctgggtccttggagattcctatgaattttaaaatgggttatttttgcaaaaacaaagtgctgttggaattttcaaagggattgcattgagtctttagaaggctttggattgtattgtcatcttaacaatattatgtcttccaatccattaacaaagatgtctttccatttgtttgtatttaatttctttcagcagtgttttatattttttagtgtgtaagtctttcacctccttgattatatttttttaaattgaaacttgtatttagccattttgagactaatatcttgaataagtaaaattcatttacactacattcttcatcttttggatgctgttgtacatggaattaatttccttttgggattgttcattgctaaaatatagaaatgcaactgatttttacatgttgcttttgtatcctgcaacttccctgaattcgtttattagctctaactaataattattatggaatctttgggatttactacatataaaatcatgtcatccagagtttcatgtgttatgaggcacagagggactacctttttatcataatgtttgtagtaatttttgtccgcaggtctgttttgtctaatacttgtctaatgttagtattgccacttccctctcttttggttactctttgcatggtatgtccttttgcgttcttttagtttcaccgtacttgtatttttatatttaaaatttgtttctagtggatagcatatagttggttcatgttttctgtttactctgtaaatctctgccttttgatttgagtatcttgttcatttacatttaatgcaaatatgtatgtagtgggatttacatctgtcattttgttatttgttctctttatgtcttatatccagagagctgatggccacagcagctccggcctgatttctaataggagggttatctaatagaaggatttcagagcattccagggacaagatttgcatttgtatgaatttttttgtgttaaaagcctcttagaacatggtctcaagaaattagggatgtgtttttcaccatcgtgttggtttaagcctgatgtgcatctgtgctattcagcacaagctcactgggcatttgttttcctggtcgctccccctccaactttattacgactgcatttccttcacgcacagcccatgccgtgggctgtggcttggccctccatgggggcagaggtgatgtctgttgaactgtggctcccaggttttttagatgggaataagacagatgtacagtgatagccgctgtgaccttgtcatgccctgttctttgctttccccttcacattcacatttgcatcacaggggagggggaaaaaagcccaaaacactctgaaagcagtgggtttcatcttgaaacctgattccatagccaaaatttgatgctcagagcctgtgtggtcactccttgcagtcatgttttcctggccaggacagtggggatgagtgttgatttgtccttgaagatactcacagaaggagatgtgcttgctctgaagaaccacatagccccacagctgaagtggtgaagttctgcattacatttgaatccctgtccaaagctcaacttctcaagctgttcctagaaggaccagtctccacgaaaccagtgagccttaacaccacctggactcatggctcagtggggccagctgcccccagagatcattgaataactgtatgtgttaaattgagtagacttgtgcatatgaacaaaaacttcactgactcttgagaggtagccttgttcctgtcaaggagaccacagggataaggttttcatatgcacaagttgtgttttcttgtttgtcgtgatgacagggtgtggaggtggtagaggtgatgtattagtcagggttctccagagaaacagaagcagcaggatacgtgtggatgtgcgtctagagagatttattttaaggatctgactcacaattgtagaggctggcaagtccagcgtttgcaaggcaggcccataggctaaagacccggggaaaagctgatgttgaaggcagcctgaaggcaagattccctctttcttaggagaggtcagtcttttttctttcaaggcctgcactggttggatgaggcccacccaaattatggagggtaatttgtttcattcagagtctactggtatagatgttaatctcatctaaaaagtactttcatagcaatgtttagattggagttggaccaaaaactgggtaccatggcctggccaagttgacacataaaagcaaccatcacagggattgatttttattttgtatttaaataatttgcgttttatttttatttatttatttattttttgagatggagtctcgctgtgtcgcccaagctggagtgcagtggcgctatcttggctcactgcaacctccacctccctggttcaagcgattctcctgcctcagcctcttgagtagctgggattacaggcgtgtgccaccacgcctggctaatttttgtgtttttagtagagacggggtttcaccatattggtcaggctgttctcaaactcctgacctcaagtgatctgcctgtgtcagcctcccagagtgctgacttcttttctttttgagatggggtctcactgtgtagcccaggctggtcatgaactcctgggctcaagtgatcctcccacctcaacctcccaaagtgctgggattacaggagccaccatgcccggccttcttgtatttcagtcacacatttcaggctgacctcactggtcacatggaattgactgtgacctgtgatgggcacctgagaagcctctggagctcttggttgccctgattctatcccaggcccaggtggagggcagatgtgctgtgttgtagctgcgggctgtggtggggtgctatgttgtagctgcgggctgtggtggggccgggccctggaagtgtgtgtgaagacacaggccggcacatgtcttcccacacactgtgagcaggaaaggttcaggtgccccgagttcttcctcttcacatatgtcggccgcactcctgtagacttagccaagactacatggtggaaagtgcgattggaactctgtgcttcaggaactttgtgatttcatttagtgagatctgggagcgtgctctgaagtcacctgtcctgagcccctcagccagcagggcttagtcgggccccgtccaggccattgtcacttttgaggaagactctccaagatttataaacaggtggtgggtgacctgcccattgtagtccataacctgttgctgccagcagctcctgggaaggggcgataggagagcactgcctccttgtcccgtgtcccaaccgatgctagagccagtgcttcaggtattcaggtacctcaggttgcttggaaaagtttaaataaattatgcttacttattaagtattctcttttcatcttttatcagctttttttattggctcccctgcagaaaaaaaaaaaggcagaggtgattttgggaactgcggcgtcccctcggcatctctgaacatgcgccaccgtctgtgtgttcatcaacgtaaagctgtctgttctggctgttgctgtctcatacagtgtgtgcaccagatgctagcgagtcttacacagatgctgtcgagatgtaggaggcagcgttgctgtgtctgctgctcatcgtggggtctttccacatgctgccaagcgggttccctttctccacaaacttggagcgagggtctcggtgggctgtcatgggtgcagactcttagttgagaaatcttcaggatggcattgcctttctgcagcctgttgttggccacaactcaggtccttcttcatccccggcaggaacaaacccctcctaagcttttgtgtatttatctgctaaggctgccaaaacacagtaccagcgactgggtggcctcaccacagacatagtatttgctcacagttctggaggctggacatccaagatcacagtgtgggcaggttggttccctctgtggcctgtctccttggcttgcagatggccgtcctctccctgcgtccttgcgtggtcttctctctgtgtgcatctgtgtcctaatcttgtcttttttttttttttttgagacggagttttgcttttgttgcccaggctggagtgcagtggcgtgatctgggcccaccgcaacctctgcctcccgggttcgagcgattctcctgcctcagccttctgagtagctgggatttcagtgtgtagctgggattacaggcccacgccaccacgcctggctaattttgtatttttttttttagtagagacggggtttctccatgttggtcaggctggtctcgaactcctgacctcaggtgatccacccgcctcggcctcccaaagtgttgggattacaggtgtgatccactgcacccgacctaatctccttgtcttataaggacccagtcctattggatgagggcccaccctgatggattcattttaacttaattatctctgtaaagaacggaagcattctgaggtcctgggggttaaggcttcaacacacgaattttgagagcacacagttcagcccataacagtttgttttgttaaaacgtgggctcttcattatcgcctttgatcccctgggccaagcccttgttgatggggcgcccctgaactctcagagccatggactcctgctgctctggggacaccagggcagcgggaaggggctggggcctggtgtgtccgctactagggaagcctaattcgttatccctgttagataaaaatacaggtgctctagtatttgcttctgtcattccaaggaatcacagtcatgcatcacttaccaacagggatatgttctgagaaatgcattgttaggcacttttgtcattgtgtgggcatcataaagggcacttacacacacccagatggtactgcctgctgcacgcctaggctccacgctagagcctgttgctcccaggccacacgcctgtgcagtgtgttactgcagtgaacactgtggttaagagtatttgtgtatccaagtttacgtaaacatagaaatggtacagtgacaccatctcagctcaccacaacctctgccttccaggttcaagcaattctcctgcctcagcctcccaagtagctgggattacaggcgtacgccaccacacctggctaatttttgtatttttagtagagacgaggtttcaccacgttggctgggctggtctcgaactcctgacctcaggtgatccgcctgccttggcctctcaaagtgttgggactataggcgtgagccaccacacccagacagtaatttaggatgtttttaagtaattttaagtttagagtatttttacgtaaaatctagcactttttggttacctgtatgttgatatgtttattaatatatgtgtacacacacacacacacacacacacacacacacacaatggaatactattcagcctttaaaaagaaggaaatcctgtcatttgtgacaaggataaacctggaagacattacgcttagtaaaataagccaggcccagaaagacagatactgcatgacctgatttctatgtggaatctagaaaatttgagctcatagaagcagagagtagaatgagggtcgctgcaaataacccatctgggcaggcagacggggctggggttggcatccatctcctgccgtttctcggctctgtgaatttggacaaatcactttctctggccctcaatttcgccgtctctaaagaaggggttgaatgagctcagacagcccaaggcttcacgaagtgcaagcggctgagatgtgctggtgttgaaggtgattgaggacagggtggggtccctttttcccagagggaacatggagccctgtgtctcaggtgcccgtggcatcttcgccggctgcacttggttcccgactccccggggagctgccgggcaggggaaactgccctgctggcctggggcaccgtggccgaggtcagccaaaggccaagacctgccttcttgctggggctggaggctgcttcctgccttccaggctgcggagtctgctggcagggctgccgggtgtgtgtgtgtgtgtgtgtgtgtgtgtgtgtgtgtgtgtgtgtgtgtgtgtgtgagtgatgaggttgcggagtctgctggtggggccgccagttgtgtgtgtgtgtgtgtgtgtgtgtgtgtgtgtgtgtgtggtgaggaggagtggactcactctgcatgggggtggggtagggttcacatattttaagctcatcatctggctgggaaagtagctgctcttgctccagaaagggaaaaaaaaaaaaaaagtatgtgaagtgatacatatgcgtaatagctcgatttaaccattccacaaggtacacatatatgtaaacctctgattgtatgcagtaaatatatacaatttttatttgtcaacaataccttaatttatataaaaacatgtgaatccatagtttctgtctcataataaattagtttggcccatccacaaaaaacaaaacccagctcttttgcaatgatctgaagcattctgattataacactgatgtttattcccggggctgactgggcctggaaggtcctttctacaagccgtcctcatgaaggcatggtgtccaggcatctctcacaactgggggttaaaagctttctgcccaggagtgcgtgactctgggcaaaaccttcctctaggcagacgcgggcatgttgtggccgtgctctggctggtgagatgggttcagcctgcgatacgtgccagcgtccagcctgcccggggccataggagtgaggggcgaccaaaacacacttccgcttgaagagtcggggcaagtctgtttgagacatttcccattcctttcccttatgttcacaaaaagttttcagggggatatttcattctttcttatgttatgttatgttatgttatgttatgttatgttatgttatgttatgttatgttatgttatttttgaaacagagttttgctcttgttgcccaggctggagtgcaatggcacagtcttggctcactgcaacctccacctcctggattgaagcgattctcctgcctcagcctcttgagtagctgggactacaggcatctgccaccacgcccatctaattctgtatttttagtagggacggggtttctccatattggtcaggctgacctcaggtgatcgcccgcctctgcctcccaaagtgctgagattacaggtgtgagccaccgcgtctggcctttcttactcattttaaataacttcaaacttatacaaaacattgcaaaaataaaaataggacaaagaacacaattcaaacacttctctctccacttgaggccctttacctctagacacatcagtgtctatttcctaagaatgaggatgttctcttgtgtgccacaggacacttgtccactactggccctgtttagaaaatgcttgccgagccctgtgctggagcatgtgttgcccaggtattcatgtgtaagaatgttcctcagaggtcatgacagccaagtgtctgcaaatggcattggttctgagcagcaggagacaggacatgtagcctggtttgttggttgggtggaatagcacgcacacgtcaacatggtgcttcaggagcaccgcctggcagcgtgcatgcgtctcgtaatagcagtgggcacagtatgaataggtcaggtgactatatatagatgatatcccttttataacaactcaactgaaaggtgctttttaagaatatagatgagctatggccgggcgtggtggctcacgtctgtaatctcagcactttgggaggccgaggctggtggatcacctgaggtcgggagttcgagaccagcttgaccaacatggagaaatcctgtctctactaaaaaaaaataacaaaatttagccgggcatggtggcgcacacctgtaatcccagctactcgggaggcttaggcacgagaatagcttgaaccagggaggcggaggtggtggtgagctgagattgtaccattgtattccagcgtgggcaacaagagcaaaactccgtctcaagaaaaaaaaaaagaaaaaaaagaagaatatagatgagatacagtttatgcagaagaaagcaggggatcgatgcctgggggtgcagagcaggggctcactgtggatcacaagcaggactctgcctttcggtgtgggcagtgagttcgcacgtctttgacatcattaaacattactaattatggtgagagcaggtcagagtccaagaattattatgtatctgagtcccagttttaaaaatcctactaccaatcagtttgctgaaatttttattgatctcaagattacttttaaatgaattatctgagattacctatagtagtgctgccttgacactgtttctcacctgagcagctgtttggcttcccatagtggccacagcaatttgcagaaactggggctatgattagaaactgcttccttccctgggcctgggctggcagacttcttcctccttggtaaatttagaagtgaaacaggaaattccaaagggaaaagctaatatgataaaaagttaaaacttagtttcaaagaaaatagtaagtgaaatgaaaaagaaagtagcttgacctggaaaaagttttgtagcaattctcacaaagctttaatatctttaacgttgttagtatagtaagtccatctgtcagttgctgaggaaaataccaagattccaaggattttaaaaaaacaaacaggcaaacaacccaagctggcaagttacaaatgaagaaaaacaggcagggggaagtggctcgttcctgtaatttcagcatctttgggaggctgaggctggaggatctcttgagcttaggagttcaagaccagcctgtgcaacaaggcaagactctgtctctacaaaaaatcaaaaaaattagccagacgtggtggtgcacacctgtagtcccagctacctggggggctgaggtgggaggatcacttgagcctgagaagttgaggctgcagtaagctgttatcacaccactgcacttcagcctggttgacagtgagaccctgtctcaaaaaagaagaaaaacaaactggttaatgcatagaaatatgtttcatctcagtgataatacaagaaatgaaaattaaggccaggcacagtggctcatgcctgcaatctcagcgctttggaaggcca[132 bp omitted]ctgaggcaggagaatcacttgaagacaggaggcggaggttgcagtgagtcgagatcatgccacttgcactccagcctgggtgacagtgagactccatcttaaaaataaataaaatataaataaataaataaataaataaatgaaatacaaattaaaagaacattcagattaaattataaaaacagaagtgacccctggattctgttgggaagcgccatgctactgtccggctccaccttgttcgtgggcccccgtaggagggcacctggcccaaagccacctgcagctttagagacattgtgtgacctaagaaacctcctgggatgtgctgctaggaaagtcatctgcaaacacactccaggcttttccgcccagatgtggtattgtcaggcttgtctcatgcctaagcaggaggagggcgggccgccctgaagcaggctgcggttcatgcatgggccagtggtgtttccttcacatgttctggatgtgcaggtgttgctgtaatggtggaaaagatttatatgacctcagtgaaagagctgctttctgcttttgttcctttgatggacagctaaatggcctggatacctttcccacagttttcgtgaagacccggagctttaagatcaggattctggtttacctgagaagctccccgttaggtccctgctcggttcacagtcactggggatgttctgtggcaccgcctgcttatggagctcctgtctctgcaggacgtctccggcaaggtgcctgggacatcccagagcacgagcccgctgaaatggggcacccgaaggcacagaccaccccactgcgtgggacctgtgaggtgtcttggtgcatgtggaggaagctggtgaggttgatgctggtgtttccagcccaagtgtcttgacagcaggacccttgatagagattggcgagtgaggtgtagtgtaggtggtagctaaggtcatgggcttgacctcaggctggaggcagtaggggatcccaggagacactctgcccacgggctgggcacagtggtggagcccgggagacactcggcccacaggccaggcgcagtaggggagcctgcagctcctcgtgggtgcacttggtgcaggagaagggctgggctgctactgggctatgccagaccctggcagggccaggccacatccaggccagccacgtggggattcggggattcaggtccttacaggggagggagagacaggaaaagaacaggcacatcaggaggtgtggatgctgggtgaagatgatctggtggctgccgtgtagcctttggtcatcaacctgcaccctcctgggccctgagaggagaacctgagaggctggtggggagggggagcacggggctcgatcgcccgtggcgcctgttcctcagccgggcgccgcaggacccagcagatacacggtctgttgggcacagtgataaggtgggggacaaggtgggtggcagccagttccctttccttcaagccgcaggaatcagagcaggctgagagcccccagccagaatggccagcggtggaattgctttgtcaagcgcccgaggtcatgcttggtgcccagccgagcccatggcctcctgagcaggcgggactgcccggccatgcgggccacgccactgaggcacgtgaggcaagccacggggctgcggcagctccctgtccctctgggctcagtgtcggcatctgtgaatggggacccccactcttctcctgagcgtgggagcgccccctctgtggtgtgactgtcctcccggagaccgccatggtgggtctgccctaacagaaagagtaggtggagcgggaaacgctgtcttcttccctttgtgccttttaaacatgcactggattcgggtgaaagatgaaggaatggccgtcgtcgaggagcactccttaattgtttatgctgtctgtgtgttgcccaggtgcacacaggtgggaaagaaacagcccctcccaccagcctgatccctacccaacccaggcatctgccaggtgggctgatggagcttccccgagctcatctgtgtgcctggtagcccagccctgggctgaggtgcatgttctcattgtcctgagggccccacctggggcagtgggactggtggatggcacagcgggtcctccatggcccaggggtgtgggagatggagggaggcccttgggtgttctatgagcgattgagactttattctgtggaatactgggccccatctctgccttttattaattattttagcatccgaatagtttttttcatacaaatttgacagataaagacagaactgctctcccttgccctcctggggcactctggggtttcatggcgcatggtttgaaaaccacagctgtaggcagagagagccagtgaaagcgtgagcaggagagtgacaggaagagaagcagaggtgagtgcaggtttggcggtgcctgggggatcagagggaagcctgggggagggcgatgttaggaggttgtgagaccacttggtcttgggagacccctcccagaggcagcctgaccctggccgaaggggctgcagccccaaggtggggggcggaggccatgtggcgtggagacgtgctctctttcagggttccttggcacactgttttagatgtcagcacctcattgtgattttcaaacttgatttctgtttctctgttgatgaggctgttcttttgagctggttttgagtggccgcttttgaggatggaatttgaagtttttgtgcattaaagaaagcagattacctcacacctgtaatcccagcacttggagaggccgaggcaggcagatcacctgaggtcaggagttcaaaaccagcctgaccaacatggtgaaaccccgtctctattagaaatacaaaaattagccaggtgtggtggcgggtgcctgtaatcccagctacttgagaggctgaggcaggaaaattgcttgaacctgggaggcagaggttgcagtgagccgagattgcgccagcccgggtgacaagaacgagactccatttcaaaaaaaaaaaaaaagcaaattacttcagtaataaagctagtctagaagatgttatattggtttttaactatgcactgtttgccttgctggtcatgacagcctgtttctgtgctgcagccgtgcggtcaggccgtttaacctggggaaaaccagctgcagccatgctggcgcggtcccctgcttccaaatacagaagagcacattctttctacacctgggagagaaagggacagcaaagtatgcttttcttcttcagatgatttattttatgcctattttacatgaacagcttgcacaaaaatattggaagtttctacttttctgggaagtgccatcattttgcatatagaagaggaagaaaatcagctcatgccttgtgcacgtttgcagaaacatttcatagtttgtctttgtttgattatgctgtttagctggacaagtggaatgcttacaagttgtaacattttttgttttttgagatggagtcttgctctgtcgcccaggctggagtgcagtgacacgatctcggctcactgcaagctccgcctcctgggttcacgccattctcctgcctcagcctccctagtagctggcactacaggcgcccgccaccatgcctggctaattttttgtatttttagtagaggtggggtt[132 bp omitted]tttcaccgtgttagccaggattgtctagatctcctgacctcgtgatccgcctgcctcggcctcccagagtgctgggattacaggcgtgagccaccgtgcccggccacaagttgtaaaatttttaaatgactggtttagaaatgctgggaagaccctctttctagcaaagcatctctccacctgtctcagtgcgggctgcagtggcgggagttagcgtcggcgtgccgcctgccacagcactgccgcctgcgtggcaccgacgccttcgcttctgcattttctggattgtggcttctccacattttgcaaccttggtgttgagctgtcttggcagtttctattttaacacctaaagagatgactgttcggtccctgtgaaaagctccctcttgacctagggtggaaagagaagtaaatacatctcaaaagtttatcctctaatgtggtaaaatacaaggtccctccgtggccaggggctggctggagcgggcagtgcacgttgtccctgtgtgtgcagccaccattctgctgtgtgctcgctggcatcttgggagcctgggcccggccagagtggccgcatgcacactgctgtctcggggcggcagtggggccgtggggccatctggatggtgtggccacccgttccccctttaccagcccccacccttcctggccacctgccccgagcctcccctgagatgccccgtctccagagcccctgacttgtttgactcctttgttttgtctggtgtccaaggccggtttcccacggggcctgtgttctcccagggatgctggcttattgaagacacacacactcacacacatacacactcacacatacaaactttttttttccttttcccttttaatctcttggcaccacctctgcttccaggttaaagttagtcttggctgctttaatttccatttgtttttgcagcctagtagtgtcttttttcattttcaagactgttgagttatgccaggactcagggttatgacctactgactgagctgcctgctgagcacgagagacatctctttcttcccagccacctgccctcatgctgctcagacaca[136 bp omitted]gtttcccaagtagctgggattacaggcacctaccaccatgcccagctgatttttgtatttttagtagaggaagtatttcgccatgttagccaggctggtctcaaactcctgacctcaagcctcggtctcccaaagtgctgggattagagaagtgagccactgtgcccagccccaaatcacatttaaaaaaaattctgttgattcactgttctttgttttgaagcatgtgatgattgtgaggttttacaaaaatcaccctcccatctcctgggatgtctgctgtgtggagaagtgaggtccagggtctctctgggaactgggttccccaagggcagcatggggaggcactggctgatgccctgagcccgtgagcttgcagggggagtgtggcgagggctggccacatctagatgggttaaagaccaggagcctgggcggatctgcccgttttctagttggtggaagcactggtgcatgcctcctttgcctttgccccttggcctgctgtctccaactttctccagcatcttcagggctctgctggggccagcagggtccttgaccctgctcccctgcctccccagcccctgctgcctgcccacgccggggcaactctgtctgtggctccagctccatgctgcctctgtcctgcccctcaggcctaaatcggtctccagcacctcactcgcacttggaaagtggccatctgtacctctgtgcctctggccttgaccccctgggtgggcacccggcactgggtcagggcggttctcaaccttgctctgtggctgtgggccctggggcagctggcgaccccatccagcctccctccactcatttgccaatgtgtcagggtggcctccaccttaaggcagctgtgaggaccacttcttgagactgcatctgtgtggatctgaggctgaggggcagccagtgacatgtggaagaaaggaggtggacccatggagcccccagcatgccctgtaggcactgcccttcaagtgggtggcactgggaacctttgcctcctgcccaccgtgggtcccttgaagcccatctggggttccacgatccagcaggtgagtgaggtgtgcagcatgatgtgagctcagacacggagccagtctgccaccgcccggtggatgttgctcactctgtaaactgccctgcagctgcctagagcagaggtgcatcccgacccatgagacactcagagattgacccgggactctgaggacatcactggaagagcagccaagtatgatgatgtcctcctttgaaatctttatttttaaaaactcttaaatttacaaaataaacgaactgatggcttattaaaacagcagttcccctaccatatttaaattcatttttatatcttgacaagctataggatttggaatcaaacatgagggttgagaactgctgctgatagaaaatcagtcagggaaggaaaaaacatctctttatgttgttcaatgacataaaccgagggtgggcatgttatttttgggtcggttcgccgcctggggaggccgggggcacaggcagctggaactgtggcatggtagcgccttgtgaccgagctcatgcaggtctggctggcttgttttgttcccagcagtgtgctctttctgcatggagcacgtattattttcatgatcagcaaaataccagctcgtgtgggttcttacctggcagacagcgcagggaatctgcgtcccacctgggtgactccgtcctacctgttcttggctctgtgttcatttgccagggctaccattaacaaaacaccacagatcaggcaggaatttctttctctcagttctggagctgggagtctgagatcagggggccagcagggttggcctctcttgtgaatggccaccttctctctgtgtcctctcgtggtcttccctctgtgcctggtcacgcattgccctgctctgatcaggccccaagcagtggacatcaatgtacctgtccacacgagctgaaggagcagagacagaaatgcgatcctattgtttttgtttttgtttttgtttttttgagacagtcttcgctctgtcacccaggctggagtgcagtggcgcgatcttggctcactgcaagctccgcctcccgggttcacgccattttcctgcctcagcctcccgagtagctgggactacaggcgcccgccaccacgcctggctaatttttttgtatttttaa[155 bp omitted]accggcagaacagtttgtatgccgttccaaatacgtgactttaattatgctgttggatatttgcactgtggcagccacttataaaggctggtcagatacaactgaggctccattccaagggcagtggacactggctttgcagtgaccaggccagacctggtgctgctgcctgggaatgggggcttcttagacacagaaggagactagaggctgtgctggatgctggtgctgggggaaaatccctgtgggacgtggcattcatgggaggacaaaaggagggccggaaaaaatcccagggtgcaggcggctggagtcacgcattgcctttgttctctagcagtggggtgcagggtccgctggtggcagttagagacggagcaaagtaaatgcacttgaaagagctttgggaggtggaactgtgaggagtcagagaacaagatgggatgagacatgagctctgatgtgcctgtgtggagtggacaccgccagggcccccacgctggctctgtaggtggcacccaggccagaccctgcacccacgctgccagggctgagaccttggagacttggatttagagctgattactccaagtccgcctaacagggtgaggcagaagctgtgcagattcgcatctatggaagatgcacggacggagagcccttggaagcgggccgggcccaggccgtgtgcgtgcggtgacagctgcttggcatcacacaccaaggcggatgtgggagggctgcctatgatcatgaaaaacctgaaatatgaaaatgtgaagaataggagagaacagcagtttgccacagcagggccctggccagcactccgcacggtgctctgatgacttgagaaattttgtggaagctgggagaaagaaagagcttacaaagcagtttgtatgacagtatcttgtttttgtaagggacagtgggatgattgatgataggttttctttttccttttccatgttttctgattaatcagcatcaaacattgctatttttgattgtagtaaaatatgcatgcataacataaactttacccccatgtttaccttttttttttttttttgagatggagtctcacctcactctgtcgctggggttggagtgcagtggtgcgatctcagctcactgcaacctccgcctcctgggttcaagtgattctcctgcctcagcctcctgagtagctgggattacaggcacctgtcactatgcccagctaattttttgtatttttagtagagatggcgtttcaccatattgtccaggctggtctcgaactcctgacctcgtgattcgcccgcctcggcctcctgaagtgccaggattataggctggagccaccgcgtcctcccccatcttcaccattttaagtgtacagctcagtggcgttaagtacatttcaccttattctgcaaccaccaccactgtccagctagagcgtttcatctttccaagccgaaactctgtatccactaaacaccaactccccagcccagcacgcagcccctgtcaccactgttctcctttctgtctctgagtttgaccactttaggtaatttatatgagtggaatcatgcggcgttttttcttttgtgactggcgtatttcacttagcctaaggtcgttaaggttcaaccatgttgtaacttgtcagaatttcctttcttttaaggctaacattccactgaccacataaatactgttatttttatacaaagaaagaagtctgcaagcactggcttggaacaagctgcgcatctggcgtttttccatgggttcaacaagctgcgttatctggtgtttttccgtgggttcaacaagctgcgcatctggcgtttttccgtgggttcgacatcagtggtccctgctgtggatcacagctgacgcacgagcagttctcccccgagcctgtctgtggcgcccctccccaccttcctccaccatggggtcatcttggcctctcctgggcagaggccggggaggaaggcgagtccctgtgggtgctgcgcggggtcaggggctgttgccatgtgggatctgtggcttcccagggtgctcggtccgacctgtcttcttgttgacccgcgtggggcccgggcatgactggacacgcccccaggcctctcctggcactatctgggttcaggccgcagaaagggcagactgcgggactctgggctggagtcgcaggacacgggcagcccctatggggccgaagcacgtcctcaggcagcctggcccctccgagcggcatcaccctgaggtgcctgcgtggacaccaagggcaggccccccatgctggctctgcaggcagcgctggggctggaccctgcacccacccggccggggctgccctgcactgctcctttctgaggtgtgtggaacaggaagctgtgatgtggagggaagtggacgagagtttctgctacatgtagatttctagtgaggaacatgcagcagtgaccggctgcggtcgggggcgttcccttacgtgtcggggaggtccaggtggctggcggtgcggccggtgcctctgttctccctcatttccagtcagttcctgagaaaatgggtggcgtctccagccgccattggggattggcctgcaattgtttccatgtatctgtggaaccggcccaacaccccgcgtggatgcctgagcctggagactgtactgaaccctgcgtagtctatgtttttccgtacttgcataccagtgacgaactttaattggtaaattaggcacggtaagagattacaataataatagaacagttgtaacaatatactgtcataaaagttatgtgaacgtggtctctctctctctctcttgccctttggtgcccgccgtgagatggcggtgagatgggcggcgcaggcattgcaatgcagccttaggccgctgctgaccttgaccagcctggccataccgctgcagtcccatgctggcgacccagccggctactgtgtggctcacaggcgggtcgcacatacagcttggacacgctggacaaggggatggtttgtgtcctgggtgggaggagcaggacggtctgagagtttatcatcctactcagaacagcgcacagtttaaaacttacggagtgtttgtgaatggagttttccgtttaatatttttggagtgcagttgacctctggtcattgaaatcgtggaaagtgaaactgagattcgggggtggctatggcatttcttcttccagctctgtcagcttttgcctagtgtaacgtgaaggaagctttttggccgggtgcattcacattgagggttgttctggctccttggggagctgaccccttccttctctctctctgatgagttccttgctcggaggctggctgggtctggtgctgacaaagccaccccagcttccttttggccagcgcttgcctggttcacctttttccccttttgctttcgacttacctacctgtatcagtatatttgaagtaagtttcttgtagatggcatatggttgggttaggattttatttatctgttctgacaacctcttctaattggtgtttttagattattatgatagtgtaattatcaatgtgtttcgattcaggtctaccattttattatctgacttctgttagatcactatctttatcattgctctatttccttttaggtttttaaaaacatagtattctgttttaatttattctaaattatatgttatctattttgctttggatagcttttttaaaaagtatgttaatttttctttttttaaaagaggcaggatttcactgtgttgcccagacaggccttgaactcctggactcaagtgatcctcccttctcagcctcccaagtagctgggactgcagcgcctggctgtacagctttcttcggtggttgctctaaggatttcgaagtccatgcttattaacatttcatattctgctgaggatctgaaaagtctgctttttactacttctagtgggacatagaaatcttaccccatccaggtttcccctcccccttttagattacagttgtcttgtttatatgatttatacaattatatacctagaaatattttataatttacttgttatgtatttgtgtaatttacatttatgtacactgaaaggcccattagacagtactttgatttttgcttttaaccgccaagcactttggaagagctgtggggtcgttgtgtgtcctgcgccctcgccgcttagcctgcctactgcctctgctttgtggttcgtagcccatgcctccttccacctcccttcctgtcagcctgtaccgctggccagcatgctctttgttttcctcctctgcccacgtcctggcttcaccttccttcctggaagacacgttcccatcttgagggaggatcccaagttggcacctccccgctttaggcttaggcgcattgtgcccgccttccggcccgcctggtccccgctttaggcttaggcacattgtgcccgccctccggcctgcctggtccccggggggaatccgcggccctcccactgttgctctgtgctctgctgagcgtcatttctcctgctgttttcaagatctgttttcctttatctttagtgttcagcagtttgaccgtgatgtgtctgggtgtggatttcttgtttgtcttgtttgggatccatagagcttcttgaatctgtagacaaaagactttctccaaatttagggtgttttctgtcatttttttcagctgtttttcatcactgcttggtttccccttttccttttgcactctcatggcacagatgttagaccttctctcttgtcctgaagatccccaaaattttttcaatctttttttctctctggtattcagattagaaaacttaacattgctctatcttcaagttcactgaatctttcctgaggtttttttttttttttacatttcagtagtgtgtcttttagttttgaaatttccatttggttcttctttatatcttgttttgtttgccttttgctgatttccattttttcattcagtttgggagtgttacaatcgttagagcatttcatagcacagtagttgctttaaagtcgggtggataattgcagcacctgtgttattttggcatctgttgattctcttttcctgtaggagcccatacgttcctcgttctttgtgtgctgagtaatctgggctgtaagtggatggttggatgttatgatatgagatctgggtcttgttaaaatcctaggaggatgttgatatttttattttagaaagcaaacaccctgaggagacttgggctgtggttctgacttgccttcagtgggtggcagctccatgtcaattctggcttcacagcctcctgcactgccacttggacctgccccctgtgtgccgctggtggctgtctggctgtggtctcagggtttggggtgtgaagaggatcagatccacacccctgcagcttgaggatgggcttgaagctcatgagcaattttgtcggctggctcttctgagctgcttcctctccacactgccactggggcttcctgggtccctggagagcttcccttctccaccctcagccagtgcagtgggactgactacccgttccactgtgcacctccatgcctgcgccagtgctggaggagggatttggggctccttctgttcagtgtctcctccaggccacctgctgctctttccttcatagaatgtggctcagctgcccctggtcccatcccagggcagagctcctcctgagtacccttgagactggagcagattcagcagaaggcagattgccccctctccctggagctggctctgaaggtgtgtttagacgatgtctgccttcatttctgcacctctgctccagctgcggtgtggcactttctgtcccctgcggcagccccatactccttgcaatctcagcctgtctgtgcagctagacagctggtgttgggcggcagggcgctcgtcttttccatgtcaggccctagtgtgtttggaggcaccacctgggaggtggctgcatttagggaggctctgctgggcagatgtggcattggagaggtgctgcccctccagcactttgagggggtcgtcagaccctcgagagagtcctcagcaccagcaactcaggacggcggcccccatggtgggaaggatggcaggaaccatgtgccccatactgtgaccctcctggaggccaggagagcctgttctcagcgagtgtggaaggataagctgcacagggcctcccagcctgctggcccacgtgccctgagagagacacgcaactcccaaggactgatcatgcccctgtcagccatgtccggtgccctcgggagagcgggaaggggttagaggcctgggtacccaacctcgaagcttgttgggtgtcccctccttctcctcacagaacaggggtccttatgtgttgttccagcccaggatggcggcccaggtgactctggaggacgcgctgtccaacgtggacctcctggaggagctgcccctgcccgaccagcagccctgcatcgagcccccgccatcctcgctgctctaccaggtgggtgcccagcagctgcagggcgtacagcctgtgctccgaccccacatgatgtttttctcttcctttccttcagccaaatttcaacactaactttgaagacagaaatgcatttgttactggcatcgcaagatacattgaacaagccaccgtccactctagcatggtaatgttgcggtgtgtctttgtttctctctgcagagaagggcgtgtttgaaggacagatgtatactttttggtattatcccaatagactatgcagtgaggaaaaagagaagaaaatgaatgaaatgccttatatttttaagacagtctttgcttttcttagtgtaaaaacaatacatgctggttctgaaaattcaatgtctctggcccagagaaaacctttgtcagcgtttcaagggtgcacctgccctgttaatgctcattccctctccagatctgcacccacacacaccaggtatgtgcccatatgagatttagatttataaatgaattgcattgttattatagttctgctttttttttgagacagagtcttgctctgccacccaggctggagtacagtggcgcgatcttggttcactgcaacctccgcctcccaggttcaagcagttcttgtgcctcagcctcccgagtagctgggactactggcgcccaccactacgcccagctaatttgtgcatttttagtagagacagggtttcaccatgttggtcgggctggtctcgaattcctgacctcaagtgatctgcccaccttagcctcccaaagtgctgggattacaggcatgagccaccacacctagctagttctgcattttaatggtctcatcaacaggttttctttctttcttttttttttttgagatggtctcactcaggttgcccaggctagagtgcagtggtgtgattagggctcactgcagcctcaacctcccgggttcaagcaatcctcccacctctgcctcctgagtagctgggactacaggcacacaccaccatgcccatctacttttttgtgttttttgtagaggcgaggtctcaccatgttgcccaggttggtcttgaattcctggactcaaggaatccgcctgcccagcctcccaaagtactgggattacagcctgagccactgcacctggacaagaatattttcatgccatgaaaatgtgctagagaaagcaatccttaatggctacgtaaaccattttgtaaatgtccacaattcaactatttttgcgcattgacttcctcttttatgtcgtgtaataaaaaaatgctgtaggctgggcgcagtggcccacgcctgtaatcccagcattttgggaggccaaagtgggcggatcacctagggtcaggagttcgagaccagcctggccaacatggtgaaaccctgtctctacaaaaaaaaaaaaatacaaaaattaaccaggcatggtggtgcgcacacctgtaatcccagctactcaggaggctgaggcaagagaattgcttgaacccgggaggcagaggttgcagtgagctgagatcgtgccactgcactccagcctgggggacagagcaagactcgtctcaaaaaaaaaaaaaaatactgtgatgaacgtctcactaaataaaggctagatttaagagcatctatttgattttttccaaaggaaacgatgttaaagagtggaaagcaaaagcagttttacagcagtgatgacagtcctcttcccatggactctctacctagattttaagtgctgtgggcgtgctcctaacttttcctcctgcacacccggggctggcagccctgcctctagtcctctctgggaccgggaggccctgtgagccagtgaggaggccatggggatcctgtgtgtgctcacaccgggcagggcgtctgccctgagcccttcctctgtgttcctaactgcaggtctcatggccagcaggttgttgagggctgggtggagccaaggtgtaacgcctgtggcacccctcagagatgcctgcgtgtcactgacacccctctcgcctgcagaagccatggggtgttttgggtggtcattgtggcccccagcgccgcacctcagtgtcactagcttctggcagccgtctcttggcacacaggccacagtgcttaggatagtttgtggcgctttgtctggattttagcaactggcatctgcttttcatgctagttcccccgcctgcctttgatttgccctgtgttccattgcagaacgagatgctggaggagggccaagaatatgctgtcatgctgtacacctggaggagctgctcccgggccatcccacaggtgccacgctcgcctggctcttcccctccagccacaccctgccaggcccctgccacaccacacccctgcccctgccatgcctggcccactctcctcccagttctcaccccacagcagggcgggatcactagctctagaagcccagcggctgcttctggctggatcaaagcctcttatgtcatccttgttcctttattcccaggtgaaatgtaacgagcagcctaacagagtggaaatctacgagaaaaccgtggaggttctggagcctgaggtcacaaaactgatgaatttcatgtacttccaggtaaaatggcaaataatctggggggggtgtaacaccgaggggtgggttgctgaccccttcctacccatcactgtcactgtgaacaccctgaacagagtgcctgcaaattaaagcaaccagtttctgagacaaaagggaccaagcctttgacagtctaaagttcctcatgccctttcggaatcaacgctccttttgtggttcacttctcttctctgagagtgattttatgtttccttcatggagcct[135 bp omitted]acctctgcctcccaggttcaagcgattctcctgcctcagcttcctgagtagctgggattacaggtgcccgccaccacgcccagctaatttttgtatttttagtggagacagggtttcaccatgttggccaagctggttttgaactcctgacctcagatgatctgcccatcttggcctcccaaaatgctgagattacaggtgtgagccaccacgcctggccaatttgtacttttgttttcgtctgctctttcaggtattttcttgctgttagcctcaccctgactgtccattcctggtggtcctcgccctggccttggttaggcaagaagtagccacatggaaggggcttgctgctttttaaagaagtattttggaaacatccagattttttatgatgatgtccttcagcaaagggaggagatggaactaactgggagatgaatttttgttttaccttgaaagttaccaagaggaaaaaaatctctcccagttttcacttctgaaagttagaacatctgaattttacaggcgttttattggagcattttgctcagtaattttgctggaataatcagcaagattttgttactttagtgatgtagttggtaaagtgcaagtcaagtaatgatggtgcagagcaggcagtgggagctgctttcaggaaggggtctggttgcccacattgtaaacacttcggcctggagcctcactgggcagatcgtttctcatcgaggagcagtgactgcaggtgcttgaaggagggacatgggcttggctcctcactgacctgcagctttctgccctcctgcttcctctgcacagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagaggtgagcacccacctcgcgcactgcgggccctcccgagagcacccagctcagtggcctgccttgtgcacagcaggtgtgcgtctttgtttgctgaagtcgtcacttctggtaggcagcagctacgtctcagtgtcagggctgtgtgagcacctgcttcgagggataaggtgaggggagccagcagataagtgcatatcgtggctttgcacagctagagcaggctcttcgtgccctggctgtcctcagatgtcacagaggaccttcgagcccctgggaagacagacatgcacaagatgtaggcctagctcacagagcacaggcatctggctcagggagcatcttggcaagggggcaggtggcctctgcagcctaccttgggcgttggggctgcagtcctcggtgccggtcactcgccagcgggggtccccagcacatgagcaccatcccagcaatgtgcagacgtggcccgtgcacagtcacagggtgtctcgtggtcacactgcgcttccagatcctctccctggtggttttctttctggatgtagagagcttctggagaagctagcctctggagaggctggcaagacgagcggaagaggcaggcatggcccagtgtgtgcttctggagcagtgtggggcagtgggtggccgatgggcatttggtgacactcggcgcgctgccgaccggcgttcggtgacacttggcacgctgccgaccggcgtttggtgacacttggcacgctgtctcctgatgctcttgctctgcttcatctgtgctcagtgcttttgaagacatgttttgctggaatgagatgctaatttcaatttcctctgctaagtaaggcatcttagctctaaaattaaattcgaagagaccttactttgcatctgaatatgctctagttatgttgcattttaaatcatacaactgttgctatgtctttattttaaaaacccacttgggacaaaatgaggcagcagtaggagtcaagctaggtcaggcagaattttaagcctcattcatgtgaaataatgcagtgttccatttatcacctaaaatcatcagctctgcacagaagtctagatcttcagaactagagaaaggtctctggagttgacctgtgagcccctcttggggcagaagtctgaagggtccctgtttgataacagcatctgtgggaatctagcatcgagactcactggtcggagtgggctcctggtcccagccgcccaatccagtagctgtgtgattttaagcagccttctcagccgccgttttggctttgtcagggaaatgggggaggtggttttcaatatttaaaagtatttaaaagttgtgtgtgtgtgttgttgttttttttttccttttagcactagcacctttattctaaagcctagtctgtaaaacagtttacagatggggctgctgtgtgcaaagctgggggaaggagggtttcccctctagcgtcttcaccacctccaggttcccctgagcaccaaagagtgggcctggggcagttccgtagctcttactgctgcctcttcctctgacctctatctgggacccctgttggttaaccttcccagaccatcacccccacccctcccaagacccccaccacacacacacgcatctagctcttttggcacctgctcgtggctactagtataacctcttttaagtgtcaatgccaagataactcatatggttatggtgaggcttgaggaaaatagaaaacagtatccttgaccctttccttagtctccccacccgccacctcagcagctactcaaatcaataaagcaaacatggccaggtgcgatggctcacacctgtaatcccagcaccttgagaggctgaggcagaaggatcacttgagcccaggaatttgagaccagtctgggtaacatagcaagaccccatctctaaaaaaacaagagcaaaaaaaactagctgggtgtggtggcatgcacctgtggtcccagctacttgggacgctgaggttggagaatcacttgagcccaggaggtagaggctgcagtgagctgtgattgtaccactgtattccagcctgggtgacagagtgagaccctgtgtctatttaaaaaaaaaggaaacatggttttttctttttgagacagagtctcactggcccaggctggagtgcggtggcacgatcttggctcactgcaacctctgcgtctcctggattcaagcaattctcctgtctcagcctcccgagtagttgggattacaggtgtgagccaccacaccgggctaatttttatatttttagtagagatggggtttcaccatgttggccaggctggtgttgaacgcctgactcaagtgatttgcctgcctccttctcccaaaatgctgggattactggcatgagccaccatgccccgccctggaaacatgtttaaaaaggcaaggaatgttactgtatcagttaatattacgtttaactgtatgcaattatttaaagcccagataaataacagtggctttaaaaagattgcagtttatttctctgtctcctgaaaagtcctgaattgggtggtctgcagctgatcgaggctctacgggacccagggctcctgtggtcctgcggctccgcttcaggtgttgcctcctggtcctaaatggttgcttaagctccagctgtcatttctccattccagtcagcaggcagaaagtggggaaagatgggctccatgcttcctcatgagtaaactttgagtgcttgtcagtatcttgcattatatctcatggcctagtccttggtcacttggccacagctagctgcagggtgggcgaggcacacggaatgtgtggggctccctggaatgtgtgttccacagaaatgcagggctcgttcctaaggaggaaggggaggaagtgaatgttggtgtaggttatcagcctttgccttggtaactcttaaaactaaacccccaaggttctgggttgcacagacctatccttatgtgggccgtttccactgaactttcttgcgggacagtcctagatgatcagaatcctcacacccccaccttcaccctgccctgccagacctcgcaggcttagcatggccttgcagtattgtattgttgggcctcacgtacgggtgtagctacaaattggtggcaggccagggctctgtctcaggaccttggacaccagtggtccctgaggtggcctggggaggtgtggtccagagggttcccagcagagaacctcagcagtgctggccggcttcatggcagggcttgtgggagtcacggagatggcagtggcccttctcagactcggggtccaggagccctgtgccccctagatgaggtgggcgtccaccagtatagggcagagaccagtgtgcagggaccctgcagggagccgtcagctgtgaccagccgggtggagagctgtcccagcctgtgcaagacacgtctaagttggcagaagactgacctggagtgcagggccagagacgcctgaaaaggctgaaatcataggtggcttctgagattgacccacatttctgcagatgactgtaggggaaagggatcccactcgaaccaggcttttttttttttttttttttttttaaatgtggcacgttggtgcattttgggatgaattctttttgttttcaaagggccgctcagtttttacgtaaaatggcagatccacagtccatccaggaatcgcagaatctgtccatgttcctggccaatcataacaagatcacacaggtaaggctggtgtttgcacactcaggttgatgggccaagcagccggccgggcgccgggcccatgcatgagtctcttgctctgtgtttcagtctctgcagcagcagctcgaagtgatttctggctacgaagagctcctggcagatattgtgaatctgtgtgtggattactacgagaacaggatgtatttgacgcccagtgagaaacacatgcttctcaaagtacgtgtgtggggacgctagcccgtggcactgccgagggacagccttactcttgtcaataggctgtgctttatctagaatccttttgacagctgtgtcttatttgcatgctgtcatgtgtgaacagcgtcctgcccttgcacacagcctgcacaacaggctctcaacacaccccatgagtgtgtcacacactgaccctgggagaaggtgctggccaggaggtccgggtcaaggattctcagctttttttttttttttttttttttttaagctgcttttcgttttattctcaaggcagggtgttgctcttgcccaggctggagtgcagtggcacaatcacagcccaatatagcctcaacctcctgggctcaagtgatcctcccacctcagcctcctaagtagctgggactacaggtgcacgccaccatgcctcgctaatttttaaattttttgtagagagagaatcttgccatgttgtacaggctgttctcaaactcctgggctcaagggaccctcctgcctcagcctcccaaagctctgtgaatacaagcttgagccactgccctttttattttttttttatttttgagacagggctttgctctttcacccaggctccagtgcaatggtgcggacacagctcactatagccttgacctccttggctcaagtgatctttctgcctcaggctcctgagtaactgggaccacaggcacttgcaccaatgcccagctaagtttttgaatttttgtagatatgagatctcactttgttgccctggctgaccttgaactcctgggctcaagcaatcttcttgccttgtcccccgcaaagtgctaggattacaggcataagccaccatgccccgccagctttgtgacagaagttatccaagattctacttgtcaagcatgtgattcctaggactttgataccttgtgtcacataattaaagtagccttttgttggttcaccatattctttattattctgttcaaattaggaagctttccatctgtgtttctcatgggaaagatgggcggcagttcggctgttccctttgctctcttctccacctctgcagggtggccttgggggaccctttgctgggtgtcccaccagcccagcccccagactcctcctgagcaggggagcactgtccacggagtgctttgtgacagcagaaacgttgtgtctgcaccggctggtgtgggagccctggccatgagcccctgcggagcactggagcatgcaggtggctagtccacgttaagaatttttagtttgtgactgggcacggtggctcatgcctgtaatcccagcactttgggagttgaggtgggtggatcacttgaggtcaggagttttacaccagcctgaccaacatggtgaaaccccatctctactaaaaatacaaaaaaaattagccaggcgtggtggtcatgggcgcctgtaatcccagctacttgggaggctgaggcaggagaatcgcttgaacctgggaggcagaggttgcagtgagctgagatggcaccactgcactccagcccgggtgacagagccagactccatctcaaaaaaaaaaaacaaaaaaagaatttttagtttgcatacaccgaaacttaactggttacatgtggctgcatattggacattacttttaatggcaaaaaaaacgcaattacttttgcaccagcttagtagctctagaatatccctaccgcttgggttaggctaggggagaggatttgttttttccgcttttagcgactgacctggaagcccagccccgctttgtatcccagtttcactgaggataaaatgatgcatttcaagcaccagacaagcagcctaaagatagatctttgtgatctatttcaaattgtgccttcaaagtcatcagctgtaacagtgtaagtccttatgggtagtgaaattctcagttctgagctttgtcgcatcattcattttgtggcttttcaggtcatgggatttggtctgtacctgatggatgggagtgtcagtaacatctataagttggatgccaagaaaagaataaacttatccaaaatcgacaagtacttcaaggtgagttacatgtttttagatcaatgtttttattgatttgtgtgcactttgaattttggggaagtgagcccctgtgtgactgtgatctatatcaggaaacgctggggctgggtggagtctggggcatgcacgttctcccgtctgcagaggtgaccgcgctttctctttccttttgccctgtgctggttttgcctgggtggagctttatacagatggaattgtgctatttgtactcttctgcgtccagctgctgtcaccagcctcttgtttgtgaggtgcatcctggaggaagcccgtagctacagcttgtagctttcggttgtggtgtagttttctatctgatgactacaccgtaacttatccgttccaatgttggcgggctctcggatgttcccaagttttggcgcgtccaaacagtgcagctctggtcgactgtcctctgttgggtgcatacccaggagagggaccgggggtcacaggcctgatctgttttcagtgtcagtagttacctgcagcctgatgacgctccagcacagctgtcctgatctccgttcccatcagcagtgagagaatgcgccgctggtgccacatcagtacttagcactgcctttttggggtggggggatatcctgaggatgcgtacagcattgagattgtattggctagtgtttcattgtattggctagtgtttcgttcatgtttccctaatggctttccatgttattagcgtgttcccttcgtgatgtgccacttcaagtgttttgctcttttttccctattgatttacagttctttatatattctggatacatgtcctttgttggacacaagtgagtttttttgtttgtttgttttgttttgtttttgagacaggccctcgctctgtcatccaggctggagtgtagcaggccttggtgatttctcccaccccagcctctcaagtagctgggactacaggtgcttaccatcatgcttggctagtttttaaacttttagtagcaacgagatctccctatgttgcccaggctggtctcgaactcctggcctcaagcagtcctccagccctggcctctcaaagtgccaagattacaggcctgagccactgcacctggccttacattttaatatacatgtattctcccctaagaggcctaccctttcactttttcccagctttatcaaggtgtaattgacaagtaaaaattgtatgtttatggtatatgatgtgatgttttgatacacatacacattgtgaaatgatgaattcaagctaatttaacatgtccattacctaacacaccattttttttattttgtgatgagaacacttaagatctactcttttagcatattttaagcattcaatgcattgttattaaccatagctactgtgccatagatgaggtcttcagaacttaactatgctgcggaattgaaactttatacgctttgaccagtatattcccttcctcctcctgcctccagtagccttttcgcgttctcgatggtgtcatttgctgaacagaagtttgtcattttcatgtagtctcatatatgaatcttttcattaatgtccacctaaataaatctttgcagccatccagctcatgagacgtttctgctgtgttagcttctagaagcattctgtctcctttttcacctagatctaatccccctggagctgacttctgcgcgtggtaggaggtaggggtttcgtgtccttggatctttcccagtatggcttcccagttgggcctgcccatttattgcaaagcccattgttctgcagtgctgctaaggtcatgaatctgtctgtggctctgtccaggttctctgtcctgtccacaagcctccatccctgctccagggccacactgccttaattgttggagctttctaacaagactcctaatctggaagggtgtgtcttccagttttgtccttcaggatagtctcagatatcatcccttcacctttggagatgcacgttagaattgatttcctgatttatacacactatccccccaaaaccattttttttcttctggaatattgactgggattgattatagatctattttgagagaatggacatttaaaaaatttgaagccttcctaggcacaaacatgatcatttctccatttactgagaactttttctagaattttcggggtagtacttttgtttagaggtcttgcacattttttgttagatttactgatgcatttttttttggatgctgttgcaaagtatttctctttaagtttttgtattc[175 bp omitted]ggtggcagttgcctgtagtcccagctcctcgggaggctgaggcaggagaatctcttgaaccctggaggtagaggttgcagtg[183 bp omitted]cagtgaatcccatctctactaaaaatacaaaaaattagctgggtgtggtggcgggcgcctgtagtcccagctactcgggagcctgaggc[169 bp omitted]catggtaggttaattttaacatttgaatagtttttatagatgttggtttttaaattgtattttgttcctctcaaagcgaatgtagaagttacttatagttttttttttgtaatgaatcatttgcagaggtagcattcaagccgaagtaattattagcattagtcagtttccttgtgcttatgtatttggtgactaaatatacataatgactctatttttttgttctttgaatacagcaactccaggtggttccgctatttggggacatgcaaatagaactggcaagatatatcaagaccagcgcccactacgaggaaaataaatctcggtaggaggagaggaaagctgcctggtttgagctttcggcagtgtcctcattgtgcggttttcaaacatcctgcttatttgtctagagataacactgttaacattctcagcctggaattaaatgtccagtattgcagcctttgccac[181 bp omitted]ggcgtggtggtgggcgcctgtagtcccagctacttgggaggctgaggtaggagaatggcatgaacctgggaggcggagcttgcagtgagcagagatcgcgccactgcactccaacctgggcgacagagcaagactccgtctcaaaaaaaaaaaaagaaagaaaaatacaattgaaattttaatttccttacgacagccacgtttgaaatgttcaatagttagtggctactgtgttggacagcacagatacagaacactttcatcatcctagggattcctattggacagtgctgggtgatagtctttatgtt[132 bp omitted]tgagaccttgactgtatgaaaaaatacaaaaattagccgggcatggtggcacacgcctgtagtcccagctactcaggaggctgaggtgggaggatcacttgagtagtctaggaggtggaggttgcagtgaaccaagattgcaccactgcagtccagcctgggcaagagagcaagaccctacctcaaagaaaaaaagaagagactgacagtgtgtcagatgtgacatctgcagacaatgtggccctaaatcctaaactgtgtaccatcttactctgtgaagaactataaagatcctcagcacagttccagatgctggcaggcactcctccccactgcagactctacagagccatctgagcctcaggggaggctttcattgacttttgccaagcactgtgcccgtagccaacctgcagtcaccattcagccatgattttgacaaacgaagttgcatctcagtctcaggggtcaagaaaccttttcagtaaaggacacataacaagtattttaggctttacaggccacaggtggtctccttcggatatgcttctgtgttgtttttttaaacaaccctttaaaaacataaaagccatttgtgtggctctggtgccaaacaggcgtcctgagctgccccagtgctgtggcctgccggcgcctccgcaggtaacgcgggtgctttctctctgcacagatggacgtgcacatcctccggcagcagccctcagtacaacatctgcgagcagatgatccagatccgcgaggaccacatgcgcttcatttcggagctggcgcgctacagcaacagcgaggtgcgccccgcgacctggagctgcacaggcacccgagggtcgcctgtgtgtgtttgcacccaaatcttaggtttaattgctttgaaaaacagtttactaccagatacgatcatatgtcacataatgacagggacaggttctgacaaatgtgtcattaggcagtttcatcattgtgggaacgtcatcgtgtcctcatgctagcctggatggtacagcctgtggcacagctaggctgcagggtacagcggatggctcctaggccacacacctatggagcacgttgctgtgctgaagactctggatagttgtaacacaatggtatgtatttgtgtatctaaacatatctaaacatagaaaaggtacagtgaaaagatggtattataatcttatgggaccaccgttgtatatgctgtcattgaccaaatgtggtgcatgactgtacttcaaaagcacccattataattgacaaggcagtgaaactagtgttctctctgttcagctgtacaaaaagcttttttttttttttttttttttttcagaaaaacattatagggatcccaagagaaaggacagagatgagataattaattgattaagtggcatttcctagtctagtactgtgattccaagcaactcgaaagatggttggagagaagggaggacactgggaaaggaaagggtgattctgacctggggcccctgtaagcctagaagggaagaagtcctgaggccagaggtgagcaggagcctctgggtggctgtcagaagacgtcccaggggcattgggtccatgtgtccaggaggtgggcctggagttgggtgcagagaacaggtgctttctctttagttccttccagctttgcagctgggtttgccatgttgtcattttggccactcccattctcctcactcacccaggttgactccgagccagcactgctggcatgtctgtgctgcaaattgctggcagggactgcgggttttagggcatatacgcaggctgctttgctgaactggttagtccctcaagggtctcaggaggaccattaaccttagcggggacaactctgtggatgttggccccacccactgcaggacgatgagcaccctgtcccccaccccccatggttaccagtcatcatcatgtaaccaaactgactgacaacccagtagtccaggtatgttggggcacctgctgcttctaacacagacccctggcaagcgtttgggcatgtcagacaaggaggctgtcctgggtgagtcagtgagtgagtggcgagcgagtgggaggcctaggacagtactgtgcactgctgtggcctttatgaacactgtgtgcttaggctgtgctaaattttttaaaaggctttttctttctttaataacgaattagccttagcttactgtaacttttttactttataaactttttacttttaaaaagagctttttggcttttgtaacaacactttgcttaaaacacaaacacactctatacctgtgcaaaaatattttttctttatctccttattctgtaaattatttttctaccaaaaagtttttgtttttttccttttgagctttttcgttaaaaatgaagacccaaacacacacattagcctaggcctacacggggtcaggatcatcaggacatcactaggcagtaggaatttttccactacgttaagattttatgggagcaccatcatgtgtgtggtcttgttgactggagcatccttaggtggcatctgactgtaattgtttctctggcattgtctaaggtaacaaatcagtttttttcggagtacagtttttttttttttttttttttttgggtgagacggagtcttgctgtgtcgcccaggctggagtgcagtggtgcaatctcggctcactgcaagccaaggttcacaccattctccttcctcagcctcccgagtagctgggactacaggcacccaccactacgcccggctaatttttgtgtgtgtgtttttttgtgtttttttttgtgtgtgttttttgtgtgtttttttagtagagac[131 bp omitted]taggtttgttgattttcttttttctgaaagctgaacatcctggtgaatgacgccagcataatttgatttatgtcattatgtcataatctagtcttttttttgtttgtttttgaggtggagtcttgctctgttgcccaggctggagtgcagtggcgcgatctcggctcactgcaagctccgcctcccaggttcacgccattctcctgcctcagccttctgagtagctgggactacaggcgcccgccaccacgcccggctaatttttttgtatttttagtagagatggggtttc[186 bp omitted]cttccacctcccggattcaagcaattctcctgcctc[134 bp omitted]gcctcccagagttttgggattacaggcatgagccattgcacccggtcataatctagtcttaaaagagcaatgccagcactactaattacagtgactagaaattgttttatgatttgttttgcaggtgattttgcccttgagcttcttactcagggtacttttttttttttttttgagatggagtttcgctcttgttgcccaggctggatggcgtgtgatggcgggatcttggctcactgcaatcttcgcctcctgggttctagcaattctcctgcctcagcttcccgagtagctgagattacaggcatgcagcaccacgcccagctacttttttatatttttggtagagatggggtttcactatgttggccaggctgatctcgaactcctgacctcaggcaatccacctgccccggcctcccaaagtgctgggattacagcatgagccatcgcaccgggcccctcactcagaggattttaagtcacaccgtggtgtttagagctgctcagggtcctctcagtggtcatgctgtgagctccatgcaggttcccgccattgtttcattttgcttttgacttctaggcattgcatttccgatctcatttaattctgtgtcctaaatatataaaatatttgtgtggttctaatatcacatctataaaaaggtatattcaaagaagcctgccttctccacggtgccccttcctccccataggtcacatgtttaaatttagggggtggttatttgatagaagcaaacccacgtgacttgtgtgttgcccttccccggcctagtggaagtgcgccaagcccacgcgtgtaacagccccgcgcccagcccgcggtcccccaggcggtggctgtggcagcggcctgtcccttgctctgtgctctgcagcacgcccttggccgccattttcccgggaggagggtccagcacccacagcatttcttattttctttttatttat[139 bp omitted]cctcagcctctgaagtagctgggactacaggtgcccgccaccatgcccagctaatttttttgtatttttcagtagagacggggtttcaccgttttaggatggtctggatctcccgaccttgtgatccgcccgccttggcctcctgcatttcttattttcacacgtgtgactttggggtggattctcatggtggatcccgggatggggggagctgggtgggggcgctggtttctcacggggccgtgcccgccttgtgcaggtggtcacgggctcgggccgccaggaggcccagaagacggacgcggagtaccgcaagctcttcgacctggcgctgcagggcctgcagctgttgtcgcagtggagcgcgcacgtgatggaagtggtaggccccgtccccgaccccagccccgctccaaagctgcctcgggcactttattcacattaacttttggtctttgggctttttatctttggccctagaaagacgagaatatctatcagtagatatgtttccaaggtgattttaagtacatctcatttatgtgtgtaataaatgaagggcctcctttttaaaaaaaatcttgatagaattaaatttgtaccattgtgattttctttaagtcgttctttttttgagatagtctcaccctgtcgcttaggctggagtgcggtggtgcaaacataagtccctacagccttgactccccaccccaagcgatccttctgcctcagcctcccaagttgctgggaccacaggtgtgcaccacggctcccggctaattttttttttttttttttttttttgagacggagtttcgctcttgttgcccaggctggagtgcaatggcgtgatctcggctcactgcaacctctgcctcctgggttcaagcgattctcctgcctcagcctcctgagttagctgggattacaggcgcccaccaccacttctggctaatttttttgtgtttttagtagagatggtatttcaccatgttggccacactggtcttgaactcctgacctcaggtgaactacccgcctcagtctcccaaagtgctaggattacaggcttgagccaccgcacctggcctagttttttgttttttggttttttttgtacagacagtctcgccgtgtgggc[131 bp omitted]tatttacttgtattgatgcataataggggtacatagtttcaggatacatgtgataatttaatacagtcatacagtttgcaaagatctaattggtgtgcttgggatgtccatcgccataaatatttgtccttatgccagaaaaattcgagttcttccctatctattctgaaatgtaccataaattattttaattaatagtcaccctaactgatctatctaacactgtcttatttctaatatcagactgtacatttgtacccattaatgtcgcttcacgccctgcatttttaagataacattttctctttggagctccagccatcaatgtcttttgttgaacattagtaaattatttctggtgccatataaagatttggatacctgtaagcaatgaaagattttcccttttgtgatttattttgatcacataaaaattatcaaattggaagagtacatggtcatttgaaaggcaaaatctttatttacttacttattattttattttttgtagagatgaggcctcactatattgctcaggctgatcttgaactcttgggctcaagtgatcctcctgcctcaacctcccaagtgctggggtcataggcatgagccactgtgcctggcccagaatcctttttaaaatgatgatgaaatgccagagtcttagatactcagcactcactatccaggccattttgccgggtagattttttaaacgagaggttacagggccagggtcttttgcccatctgtggagatggacggtgtgtgcgccctcatgtgtgactttcagaatgcagcaaaggtttgaaggctggcctggctttggccaccatcgtgtgagtcagaccagaagccaggcgttttgcatgcaatatggaacacctctgctctttcggccaccacagtattcctggaagcttgtgcaccccaccgacaagtactccaacaaggactgccccgacagcgctgaagagtacgagcgtgccacgcgctacaactacaccagcgaggagaagtttgccctagtggaggtgaggatgctcggccgctcgctcttcctcatgtcgctctagcttcacaccatcttctctgtcaaaagcaaaaacatgaacaaaactgcctgtttactcattgcttctgtgtgggcacccctttccatctggcagagtagtcagagtagaacgcattagagaaacagtggttgtcggtcctgggtctgcactgaagctccctgggtgcgaatctggactcctggacctgcgtctggatggagagcagtgtcgggtgcggggaagggaggtgaaagagatgtggcccctgctgagagagaagagctgtcttgctctcctgtgaggcaggcgctgcactcccctcgtgagcctttccatgggcagctcttcattccagcatcaactggtatcttttctttcatagctgtgcttttcctgtgctgtttgagaaatctttgcatactctcaggtcgtgaaggtattctgcattgctttctggatacttcactctgctttcacactgagatgcgaaattcacctgaaattcatttttgaaacaattccgtccaaccctcacgctgccacctttgtagctggtcacgtgacaatgcatgtgtggctgtgtttctgctctgctctaacccagtgtcagttgctgtcggtatcccagcaccactctgtagctttgtagtcatctaccgtgtatgagaaagcacgtctttctgtctcctagacttccttggctattcttccccactgtagtttcatattcattttagaatcagcttttcccatcccacagtgaggattttaatcaggatatgaacaatcctatggatcatgacaggagaattgacagaagtctcatacagttggccctcagtgttcttgggttccacctccatgaaccaaccttgggtcaaaaatgttcagaaagaaaaaataacactacaacagtgaaaagtaataaaaatgttaaaaaccactgttttggcctcagcctcctggactcaagcaatcctcccacctcagcctccccattagctgaaactataggtgcatgccaccacacctggctaatttttatatttttggtagagatggggtgtcaccaagttgcccgggttcgtctcaaactcctgagctcaagcaatccacccgcctcagcctccgaaagtgctgggattgcaggtgtgagccactgcgcccagccaaaattttctgattttttgacataaggtttttcatagtaaattctcatcttattttggtagaagcttttttttcacataaccatacagttcacccatttgaagtgtaaaagtcaatgctttcagcacattcacagagttgtacagtcacaatcaaatttagaacaaatataaatgccagcccattatcagccacccttcattcttccctccctcaaccgtatgcagccaccactctgctttctgaccctgtagatttgcctgctctgggcatttcatatgagtagatcataccatatgtggccctttgtgactggctttcacaaagcataattttcacttagcataattttccttttatttttcttaagatggagccttgctctgtcacccaggctagagggcagtggcgtgatctcagcttactgcaacttctccctcccgggttcaagcaattcttgtgcctcagtctccagagtagctgggattacaggcacccaccaccacgcccggctaatttttgtatttatagtagagacaaggtttcaccatgttggccgggctggtctcaaactcctgacctcaggtaatccgcctgccttgggcttccaaagtgccaggattacaggcgtgagctaccgtgccaggccacttagcataattttcaagattcacacaggtatcactgttttgttctgtttattgctgaataatattgcattacatggatatgttacattgtatttatccatccatcagatgatagacatttgggttatttctaccttttcactactatgaagttgctgagaacttctttttcttgtttttttttttttttttttttttggagacaaggtctcactctgtcacccaactggagtgcagtggcaggattatggcttattgcagcctcaatcttctgggctcagacaatcctccctccccagcctcccaagtagctaggaccacaggcacaaaccaccatgcctgactaatttttaaattttttgtagagatggggtctcactgtgttgcctagtctggtcttgaactcctgagctcaagtgatcctcctgctttgacttcccaaagcactgggattagaggtgagccaccatgcccagcctctatgagctttcatgtgcgggtttttgtgtagatgctggttttcatttcttttgattgtatagctagaaatgcaattactggatcataacagcacatttagcttttgaggaactaccagatagtggcagcaccatttctccttcttaccagcagtaagtgagggctccagtttccccacatccacaccaaacttgttattgtatgtctttttgattctagctatcctagtgggtgtgaggtggtatctcatttcattgcgcttttgatttgcggttttctaacaactaaggatgttaaacgtcttcttatgtgcttgttggccatttgtgtgcattatttggagaaatgtctcttcagatcctttgcccatttttaattaggttatcttttttattattgagttgtaacagttccttatacattctaaatatcagttccttacagccataggattttcagtatcttctcccattctatgattgtccttttagtttcttaatggagtcttttgagacacaaagtgtttgaattttgattatgtttgatttatctgtttttctttcgttgcttatgcttttggtgtcatatataagaaatcattgtgtaacccaggtcatgatgatttactcctgtgtttccttctaaaagtcttttttttttttcttttttgagacagagtcttgctctgtcacccaggctggagtgcagtggcatgatctcagctcactgcaacttctgcctcccaggttcaagcaattctcctgcttcagcctcccaagtagctgggattacaggtgtgcgccaccacacccagctaatttttgcatttttagtagagacagggtttcaccatgttggccaggctggtcctgaacccctcacctcaggtgatctacccgcctttgcctcccaaagtggtaggattacaggcatgagccgccacgcccagcctcttctaaaagttttatagttttagctcctaacttaaacctaatttaaatatatgatccattttgagtggatttttatacagcgtttgacaaggttgtgtgaggggccctccagaccaccctccatccccctgactggctgggaggactcacagggcttggtagttgttgcactgaaggttatgactccttgcagccaaaagacagagtcagatcagcaaagggaaaaggcacaggagtggagtccagagaagacaggtgtaaacttccagctgtgcctgctagtggaattgcacgggacgtgcttatttctcccagcgatgatgtgtgacagcacacacaaattgtggctcaccagggcagctccccagagccttggggtcctgggtttttactgggggccagtcacgtggctgaccttggctactcagactctaggtcctcaaaacacacacaggaggtcactattagtcaccttgttagcagagactgatcagactggtacagcagtaggcccggggccccaggcacacaaaaacataatctctaggcaggacactcccaaggttcagagctggttcctgggatgacttcagccagtcctgaagatgggcctttcttggggatgtgcggagtttcattctccccagcctgctgagttaaccctttcctgcacaagggtccaccttgattctctcgcatgtgcagatacagttgtcagtactatttgttgaaaagatgatctttccccatcaaattgttttggtaccctgttgaaaatcaattgtaagttaacttctggactcttaatcctatcccattgacctctgtctatcctatgacagtattttttcataatctcttaatctgtctat[136 bp omitted]tcacctcccgggttcaagctacttctggccaatttttgtatttttagtagatacagggtttcaccaatgt[132 bp omitted]aagcatttgtcagttttactgtttatttactgaacagctttgtctttgttgatcacccttgattatacacttgttttctgtttcattgttacatttatttatttatttatttatttatttatttatttttgagacagagtctcgctgtgtcacctaggctggagtgtagtgacgccatctcagctcactgcaacctccacctcccagtttcaagcagttctcctgcctt[134 bp omitted]gcctcccaaaatactgggattacaggcatgagccactgcgcccgggtgcttttagttatttttcttcgattttgggggggtttattttgctgttttctataaattagtgatgaatgtttgataagtattatgatttttatcctttttagttttctaatgcgtgcatctaaagctctcagtttgctgttaacttgccttttccttcttcctgtaagtgtgaatatgtaggattgttatgttcacttaaatgggtttttcctcgtttggttttttaaatagaacttttcttttttgttgattggaaaaacaatataaaatcatcagttttccaaagtaagcatgctgaaaacacaagcatggcattaggaaggcacagtgcctgcggcgccatcacagagatggcgctgagcagctgggtgcgttttcttccagactttttcctttctaaaattttcattattttaattgcatatagaccatgagtcttacatgaaagcagtctatttggaaattctttacgttatagaaggatgaattaaaagcagactgtcaacttttccacctgaaaatttcatgaaaaagaaaagcaccaaaatcatataagccatgtttcaagtacttgtcagacacgtcttcatttacccatgaatcaggctgtttataaagccataatgaggaactcaaaaggtgtgaataaaaccagaaagtgatagagggagactgtgtgaagccttggggaaacacatttgtgttcttgctaagtgaacttcaaaccaacagatttaataaaagtaggaagatgcctagccaagcatggtagtgcatgcttatagaactagttacccaggaggctgaggcaggaggatcgattgaccctgggagttcaaggctgcagtgagctatgatcatgccactgcactccagtctgggcaacagagtgagaccctgtctcaaaaaaaaaaaaaaaaaaaaaaagctgccttaattttgaatctgtcaaatacttaatttcaaaaggttttttttgtttgtttgttttttgtttttttttattactgtggactgaagaccattttcagatgttgaagtagggtttttgttttgttttgttttgagacagggtctcgctctgtcacccaggctggagagcagtggcatagtcatggctcactgcagcctcgaactcctaggctcaagtgatcctcctggcttagcctcccgagtagctgggactataggctcatgccaccacacctggctaatttttaaattttttgtagagatggggtctggccattttgttcgggctgatcttgaactctggtctcaagtgattctcccgcctcagcctcccaaagtgccaggattatgggtgtgagccactgtgcctggccaaagaagggttgttaagattttcccaaatgtattagtcttaggtacagcgttctagttaaaagataaaaagaagtgaattatgtttcactggtgctattaaatgttccactttggtgtcttatatgtcagacatccacacggcagggtggacttggggtaagtgtgtcttgctctgcctcacttgctgctttcagagagatttctaggcctcacatagctatcatgaagttggctgtagaaatatttataaacggcaaaagccgtaagaaagctcatgcaattgtaaaggtcatacttggtttgtgaccttcaattgtttattcagaaagtaataaagcacactgtcatgacaaaattactgtctggaaacagggaaataatgagccctggcaccatttttctgtcccaggaattcctttggaagctctttgtcatgtaattatgttccatcagagtcttccaggctttttctgtgaatggtagttcactgcgcctttgttgtgaacaatatgggatttggactacaacctcttgtaacttctttttctagtaatatcatgcctgctttcctgagtctttttcttctttcctatttgaattccatcacaggagggtgtgctggggtggatgcatgtgtgtttcgagtcagatgcatccctgtcctccaggtgctcatggtctgatggggagtcagatgcgggcacagttccattgactatggctttggagaagacgttttggggcagggcagctgcagggcacgaacgcgggagggcgtaaggtgctgtgggcgaggaggagcagcccccggcatgtgccaggcagaggaggcttggtgccatccctaagaagggccgtccctgttgctgtgtcccccgcaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagaggtcagccttccccacgccctgtgcccgctgtgcccacacgtcctcggatgaacttggattcaaacaacaggagcgttaaattctcaaaaatgatttcaatatatttatcttcaaccttcagatgccctcttggtgaattacctctaaaagtaatgcatgggtccaattattaacccaaacaatggacagtaagtcagctgccgagtgtctagggagtctgaggaccccgggacaaggtgcatttatcccaggctcgcggtgcctgtggttcatgcatggtgccttatgggggtctctgcacggtggagccctgttggtgatgaggctgtgttccaaaccagtcgagagacatggccaggctctggtcatgtgggtgacttcacattcctgttggttactggggacagccagctgcgggcaggcggggcccagctctgctccgtgcggaggctgtgttctgccctctccctgcccacagcatgactcagagccacctcactgctgccctgggctaacagatgcgaactggagctcagggcagtcttctgggggtagtaatactctccagaaggcagactcctttttaactttcctgttgagctggtccattaccacatccctccatggcccccagagtaatttgtattttcatgggggctgttctgagagccttgtagttgggtgaggagatggtgtgattgtgaggctggaggtctcggcctctgggccttgctgatcacttggtggggtgttcagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcaggttctcgtcccttgagccccgcctgcaccctctccctggggggacccaccctgagctgtgagcgggtggggctggtgaggcccgggttaaatgaggtcctcgctgcctgctcaggcagagaaagtggcgcctgtggtttctgctgctcctctgtttcccacccaagtgagttgggagcgtgaggagacgtgccttgattgtcagatgtgtcatgtgcactaaaaaggagtctgactccatttcaactcccatcccaaaaatgtgggcacaagtccacgtgtctgtattcattctgtgtttcttgatgggtgtttgaatgtctgtataatttttacgttgggtctgcaaatgactgtagatggggcgtgggaaactgtgaggtgctgcttgcgtgtgtcatggtcctaagctgcccactgtcctctctcctggtgtgttcaggcctccccgaggtgcttctcacgactttcacacccggtttaatccacaccgctgcgtctgtcctccgtcctggggctggtcttctccctcatctctgccggaggcttttaatctcttctgccactcttctggaaagtcaccagcaatgcacgctgctggctctgcaggagggtcagggggacggccctcggcctgtgcgtggtgccagccaccctccctgcctccctctgcgtgcgtcccgtgtccctgcctggggtgtgtgtgtcgagtgactaacgtctctctcctgcctctccctcctgtctgtccgtgtctagctctacctggtgcgcaccatggccgagtccttgggctctgccgagctgctcaggcagctcaagtctctgggcatggagaggctcttgcatgcggttaacacgtttctgaggcagtcgtgcacctacctaccccttttaacctttggtggtaagacatcatttgtttctcttgacgtttatggcacggaggcgaactgctccgctacaagttgttctttccccaaagcagcagcaacgtggccgcgtagacaggcacccggacccctcggggagctggtgcggggccctcccgaccagggcgtagcggagcagtccttctctcatgggctttttgagtttggcataactaatgtaccatgtatattttctcccccacaaatgtttccttggataatccagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtggtaagagatactgctgagcagcatccggcctggcatgtcctaacaccactaacaccgtctagaatgcttccgcccgcctgaccaccccctaccccgtcccttggtgcacccagacggtgactcgtcctgccctctgtggcggtggctgtacgtccctggcctgagctcgctccacagggcgtggtccctacaagggtataaactgaggagcccgggctggccctgagacatgaacagaaaatcttttcaacccatgcggggttggaaacaggcgaatgtaatctggtgcctgagttgagacacaggcattgataaatactagaaatggcccttgcagaccatgacgtggggggaaggtggcgggtgccctgtgccaggcaagcccatcctgggtgacacccggccaccttgaccggccaccggtgggtgcgctctctgccctccgtgtgtctgtcccgtgttctcatcaagtcctccgttgtccacctcttgctcagaacaggatccctgctgtcttggctggggtgctgcgaggtattggaggaaatagtaccacttttgctgttaactccatgaaaggatggagttcgagtgtgggctcttttaatctgtctcatttttgcgttagacagacctccctgagtgtgcctctaatgctgcagcctggacattggtttttatcctaagtgaaagtgaagaagtcctgtttttttgttttgttttttgttgagacgaagtcttgctctgtcacccaggctagagtacagtggggcgatctcagctcactgcaagctccgcctcccaggttcaagagattctcctccctcagcctcccaagtagctgggattataggtgctcaccactgcgcctggctaatttttgtatttttagta[132 bp omitted]tctccttttgagaagaacatttttaggtaagacacagtggctcatacctgttaatcctaacactttgggaagccaaggcaggagaatcacttgaattcgggagtttgagaccagcctgggcaacatggcgagacccccatctctataaaaaatacaaaatcagttggtggcacgtgcctgtgttctcagctacttgggaggctgaggcaggaggatcgcttgagcccaggagttgaaggctgcagtaagctatgatcgcgccactcacctccagcctgggtgacagagtgagatagactctgtctcaaaaaaaaaaaaaagacactttccccctggatcccactgaagggctcacagggttgatgaggtggctttacctgcagctatgcccagctggtcctgtccctagtgcaaggccccggtgacccctccccactcatgtccatgctgcatggcttggggctgagcgaggaggagcaggcacccagcacacagcccttgtgtcatctctgctaaaggtttttttttgcttgcgggagataacatggagttgtttgaaccctcccagaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtgcgtgtcctgcgggcctgtctccagcctttgtgtgtggtgaccgggggtcctcagaggaggtggcggagaggccgggactgtttttagtattgtatttgaaatcaagtttctgggcctgggcaaaatagcaagaccccagtctctacaaaaatgagaaaacttagcctggtgtggtggctgatgcgggaggattgctttaccacagaaatttgtggctgcattgagctatggattgcaccactgcattccagcctggccacgtagcaagaccctgtctccaaataaaaaaaaaaaaaagagaaatcatgtttcctggggtaaagctttagagattaatacaagtaactaaccagtttcttggtgtcagactggaattgagagctcaggcactagaaccagtcacgttcctactttgcatgggtgctggctgggacccggggactcagcctggaccagggagatggatgaacctggaccttccccaggccttcgtagtgcaggccctgtgaggtggccatgcccgtgagctgccttgcgggagccctgtggcctggccttttgtgtgacacagcctctgacccagatgaagtggggaaaggaagtattgattgaacagctttgttctggggatcaggactgtggacctagatggaagggcagtctttcaaaatataaagttcatggaagggaaagtgtttggaaaagggtgtgtctcatggtgagcgactggggagccgcccagccggtctgtcttctgagcaccgtgagtgggaagcccctgagttccttgtgcgtcagtcctcacacatcccttgtggtgcccaggagatggtaagggcagtcaccttccactctctgtggctgtggcatggccatgccatttgtgtgggcagagcctctgatggctcgttgcacagcattggggtggcgtgaggagctggaaccagcttggaggcctccttcaggcatgggcctccttgcccctggccatggcctttgtccagatatgaggtagtgggagacgggccttcaaccatgggccatgctggacatgctcctggtgagctgtgggatccaggaccttcacctttgttcttttttttttttttttttttttaatg[133 bp omitted]gcaacctatgcctcccgggttcaagcaattctccggcctcagcatcccaagtagctgggactacaggcacccaccaccacgcccggctaatttttgtatttttagtagagatgagtttca[132 bp omitted]tttttttttttccccccaacagagacaaggtcttgctctattgcccaggctggagtgcagtggtgcaaagacagctcactgcagcttcaacctcccaggctcaggtgatcctcctgcctcagcctcctgagtagctgggactacaggcatgcgccaccacacctggctaattgttttgtgtttcatggagacggggtcttgctatgttgtccaacctggtctcaaactcctggcctcatgttatcttcctgcctcatccacctaaagtgctggagttcattctctatcattttttttggacagggtctcactctgtcacacaggctagagtgtagtggcacgatctcagctcactgcagcctcaacctctcaggctcaagtgatccttctacctcagcctcccaagtagctgggactcaggcgtgcgccaccacgcccagatagttttttgtagttttgttagagacagtattgccgtattgcccaggctggtcttgaactcctcacctcaatcaagtgatctgcccacctcagccccacaaagtgctgggattacaggcatgaaccaccaagcctggtccttggagttcattctggaaataagaaaataattttcttttgttaaaaatcctatgtacttgtagtgaaatattttaaagtctgctaagtgagaagatgcaggcaggtggaggcccttgtccgtgtgtggccttcagtgagcgtctgctgtccccaagcatcctcgcagcctggtgggtgtggcggccgcctcaggcgcagccaccacgtgctttcacaggaggactggtgtttgaagtgaaagttgtttttccttacgtgagaggtggaaaatggagttgagtttctgaggtggggcgaggctgtcggagctgcgagtgagtggcagaggctgctggtcacactgctgctgtcctctgcaggtacgtgctctactccctggacctgtacaatgacagcgcccactacgcgctcaccaggttcaacaagcagttcctgtacgacgaaattgaggccgaggtgaggcccctgcagctccatttctgttcatttccttcaattaaatctcctttctctttttgttttctcccaagtattcaactttctttaaaatataagacagtataaaccacgaagcaagcatgtgggagcaagcccttcctctgtggatatgcttccacgatgagtgcaggatgcgctttttcacttgaccgtgtgtcactgcggtgtctgtgtcctcatctatttttggttatgagcatgatctttgatgttcaactgaagcaactcctgttttatttctctatttttttggttttggattttataaatagcactctgctgcactccctggcatgttttttatttgcatcgcatgacttctataggacaaattcccacaggtggaattctcaggttagtgtatgcacatttaaggagatgaaccttattctacacatcatctcctctgccttctcacaaagaccacctgaaaatggtgcttcagggagatgtcacaggtccccggccctgcaggatgggaggagggcagagacgcccttcttggccctgtctgctgggcagatgggtcctgggtcccacttgccacgaagcacaggtattctcctcacagttccaggagatagtgcgaatcccatctgcaagtaagggtcttttgagggtacctcctgaccaatctcacacccagaacagccgctttgctccagggaaggccctcggtggtgcctcctggagtgcacagtaggcggagctgccccagggcaggaacccacctgcaatgcacagtagctcctcgtggtcactgcacacagtgaagagagccttgttgattctctcttgcatttcagagaataggaatatttttctccctcagtaagattggttctagcctagttttctgtggcagtgtggtagtcactcctggccacactgcagtttatttagtgtgctgttgttggacagtaagattattgctagtttctttagtttatttttcttttttgaggtggagtcttgctctgtcgccgaggctggagtgcagtggtgtgagttcaagcgattcttgtgcttagcctcccgagtagccaggaccacgggcacgtgccaccacaccaggctaatggtggtgggcacctataatcccagctactcaggaggctgaggcaggagaatcacttgaggcagagattgcagtgagccaagatcgcactactgcgctccagcctgggcaacagagcaagactccgtctcaaaaaaataaaagagcctcagttagttgccttaacgaaacattttgtttttcaccttgttatttgatcttgctttagggaatcaaactgtaacgtgtgctttctttttcttcaggtgaatctatgttttgaccaatttgtttacaagctagcagaccagatatttgcctattataaggttatggcaggaaggtgagtatctggtgtgtgattttgatacaaaacgtttcataatttgatctgacattcccattacaatttatggcgtatgaaaaactttctgtcttccttctacactagtttgcttcttgataaacggttacgatcagaatgcaagaatcagggagccacgatccacctcccgccgtctaaccgctacgagacgctgctgaagcagaggcatgtgcaggtgagctggggccgggctgtggtggggacgtagagtgtgcattgaaaagactgggttttcggctgggtgcggtggctcacgcctgtaatcccaacactgggaggccaaggtgggcggatcacctgaggttaggagttcaagaccagcctggccaacatagcaaaaccccatctctactaaaaatacaaaaattagctgggcgtgctggtgggttcctgtagtcccagccgctctgggatgctgaggcaagagaatcgcctgaacctgggaagtggagcttgcagtgagctgagattgcaccactgcactccagcctgggtgacagagtgagcaagactccgtctcaaaaaaaagaaaaaaaaaatgattgagatttcttatagctagctaggtttagatatcagcatgccttgtgactgtgaacgtccttataaattgttaggcattgaaagacacaccgtttctattgggtcacctcacacacagggaacacctgcagcattctgtatctgccctgcggctcctgggggcaggcatagcccggaggggtcagcccttctccaggagcccaaaagccagagcttaaaaagaatgaaggtgagaagcactcatcagctcagagtatcagagaaaactttctcctggccagcaggaagaatttaaagatatacagtgcttattttttacagcttttaaaaaaagattcacattgcatgcctgtattaaaacatctcatgtaccccataaatatgtacacttactgcgtacccacaaacattaaaaaaagaaaaaaaattaaaaattaaaagtgatgttacattacacacacaaaactagttagtaaaatatggaaaactaaaaaaaattgcatttaattctactctctatacacgaataatcatcatgcacatttttggacattttcaccagggctttgtcatatttttatgtagttagaacaacactgaagtatggatatgttcctagtaggccaaaatagagatggagtaattttatttatcgtcataacacctgtaaaaagacacacacaggctgccatgtatgtggggagatgggtcttgaacgtggttgtaaagggtgtcgttattgacagaccagcttctccagggtctctggtgaggcgtttgttgttttcgagctgctcatgtccactctttacctgccatccttccctgtgtacgccagctcctcggcagatcaatagacctcaatcgtctgatcacccagcgcgtctcagcagccatgtataagtccctagaactggcgattggacgatttgaaagtgaagatttgacctccatagttgtaagtaatttcactttgccctattgataaattggactaagggtaggtccagttcttgtatagatgataaaagagatgcactcatcgggcgtggcctataccaagcctcttgtatagataataaaagagatgcactcactgggcgtggcctataccaagcctcttgtatagataataaaagagatgcactcatcgggcgtggcctataccaagcctacactcagtgttcacaatgctaaattgacttaacaaacacataaccccaatcttgaaaaaatcgccaactatggcaaaaggtagcacaccacttaataacgtgtttacattttagtatgaacgagctaggagataaaaatgtttaactttggctggcacggtggctcatgcctgtaatcccagcactttgggaggcctgcgggggtggatcatttgaggtcaggagtttgagaccagcctggccaacatagtgaaaccccatctccactaaaactacaaaaattaggcgggcgtggtggcaggcacctgtagtccga[188 bp omitted]ctaattcttctacccctacatttcgcttggctgtctgaattcatctcatctccaggtaaggtctaatccttctcctgttatctggaccttcaggtttcccagtgaggatgtgtgttcggggccaacgttccccgctcaccctctttgggcgctcacccatttttcggctgtctcacggagcctacagaggcaagccgcttccttcagagggtctttggattctctgctttcctggtatgttcctgtggtatttcttgaagcaaaaatttgcagtgtgagtcttcacacactgctgtgttcgtctgaatgggagctgccagttagtcctaccttctgtctgccatttttccctgtgtctctatcacaatttgaacacaggaagaggcaagactaaggaacaggaaaacagaggttaaaaacatctgaactggggaacagagaaaaataaaaatgaatgagacagaaaagagcataagaaatgtagaaaacagtggaaagacctaacgtgtaactggagtgttagaggagatgagagagagagtggtgtcacggaagacttgtctgaagagaagatggcagaaagaccttaacgtggacagaagacaccggcctgccactcaggtgtgccacccaactacacatgctggagccagggccggagccacagggggacctcagtgagcgggcccccgaaccacagctctgtggatcacctgaccaccccccaactctgaccctcggcctgtggtgcctttgaatctttaggatttaatcagagctagtaggcagtaagcctgaatgggctggttgtcttcccttctccagtgcgtggtcattggtgcatggccacacgtccgtttccactgtgggagcagggggagggtttacagtgtgcattttctaacaaaatgcacaaggtcctttctccccttcacccaaggagctctgggtctgagaactggttgaggagccatgaatttcttttatgatgattcaagttaggctggtattggtcggcctagggcttttccctttatccagatcaatgagacttccgaaggccgatcgtttgtgccagccctggggataccacagtcctttagtcaacactggcacccctgtgccaacgctggcacccctgtgagtcaggcaatttgagtacacatgagttgtgctgcccgccacctggcaccattggagtcaaggagcccaggctggtggcctacagagaataatttagacagagctcttcaaagatgcctgagatgagaacaggtttcagggagctaaaacagtaggccctgctgactctggaattgaataaatcaaaattccctcctaagacaaagctgcccatgggagaagctgctgggaatagcatgtaagctggtaagggttaggatcatggcggaggggagcatgagaggcaggtctcagaaggcttgagccagtgctgttactcttggccctgaccaacccctcttcctcttcagaagcatgagagagcttatttcacttccagtcgagccacaggtaaagatcatggtccaatcccctttagacgtattacactaaaaaagaaaatgtaagtgcacagcagtgtccctacagacagtggaggcacgtcagacagacacccacggaccatggaaactgtaacttcatctttcacagtgagctaaaagaaatgaagaaagtagtagttgctggccggg[175 bp omitted]gaggcaggagaatggcgtgaacccgggaggcggaggttgcagtgagccgagattgtgccactgcactccagcctgggcaacagagcgagactccgtctcaaaaaaaaaaaaaaaaaaaaatagtagttgctgtgaaagaataatataaatgagaatttttagaaatccagaaataggctgggcacggtggctcacacctgtaatcccagcacttttggaggctgaggtgggtggattgcctgaggtcaggagttcaagaccaggctggccaacgtggtgaaaccccatctctactaaaaatacaaaaaattagccgggcgtggtggcacatgcctgtaatctcagctacttgggaggctggggcaggagaattgcttgaacccaggaggcagaggttgcagtgagccaagattgtaccattgcactccagcctaggcaacagagcaagactctgtctcaaagaaaaaaaaaaataaatcgagaaataaggttattggaaaaaagaaagttttgaaaagagaaaaggccgggcacagtggctcatgcctgtaatcccagcactttgggagactgaggcaggcagatcacgaggtcaggagatcaagaccatcctggctaacatggtgaaaccccgtctctactaaaaataaaaaaattagccgggtgtggtggcgggcacctgtagtcccagcttactcgggaggctgaggcaggagaatggcaggaacccgggagacagaggttgcagtgagccgagatcgttccactgtactacagcctgggtgacagagcgagactccgtctcaaaacaaaaacaaaaaaaaaaacagaaataagaatgaaggctgggc[136 bp omitted]atggtggcacacgcttgtagtcccagctactcgggatgctgaggcaggggaatcgcttgaacccaggagtttttgaggctctgtctcaaaaaaaaaaaaaaggaatgaaaagagggaacatttttaaaatcaaaaagaaattaaagcagaaaaaggatttgagaggaaatgatgttctcagatgatcatcatcatggatgatgaagattcagtgtacctgtcatacagcttcctcaagaagaaaaccaaagcaacggaacagggccgactggcatctatttcaagaaaatattgataaaatagaagacaccttgaaagtgtctattaaaagcatacatcatgtatttggtaaaaccgacccaagcttgtcaacacttagaaatactgcatcttaggctggttgaagattagaaaaaataataataatacatttaaaaacggtattgcagtgaaagttttggactttccaggtgaggaagaagtccttgggctgtctgagcagggcaggcagggaaggaaaatccgattgtcctcagaccttcaccagagccaaggaaaggaactgtgaatcgagggtttggtcgccagccaaattgatcttctgagaataaaggctgcagacagatggtaatgaacgtgccagggctccagaggattgttcattcctggagaacagaccttggctggcagacactgggcgctggcgggcacagtgcgtgtccctgtgagcatctctgcacttcagagcagggccctgcgtattcatccttagagtcaaacaggctgggactcagagacagacctgtggcggcctttttctacgagcgtaatttggtacaggccatggtgtttctgttggcattggccaaatatgattttgagtaaaatcattggtcgaggctttgatcgaggccattactgtccaatagaaatagaacacaagtcagatccgtaatttgaaattttcccatagtctcattagaaaaggaaataggtgaagttatttttaataacatacttaatccactgtatccccatattaattcaccacgtcattcctatggcagtatagttgaggtgggtatttgctagtctgttttgtcctactcagtctttgaaatctggtgtctcatgtagtgcgcctcaggtgggagcagctgtgctccggccccggctgccacatcggacagtgcagcctgggcgagctccagagcagcgcacgtgagggcttgcaaggcctgtgggaacaagtgcacctgccctgccacccacacgtgcctttcagtgacttcaggcacctcagagaaagctggctcagctccaacgcccagggagatgcagccgccggctgggttatactgcagggcagggccggggctcagcgggcacatggggggaagggtggcagtagcaggccacacgtgcacgctgccccacagggtgctggacagcaggggtaggtggcgtggaggtgactgcagtggagaaaggcatgacccagtgggggtgactgaaaaggtggggtgccaagaagcaagctcatgtcacctgtcagagcctacgctcactgggggctgcctccgtgcagccctgccagggactgtgaggcctgggtgggatcagaggccactcggcgcctccttcctgcctggaccagctctgtcacccacccctgtctttggtgccacaggagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtgagcgtgcccgccacacaggcgcccacaggcgaggcgctcagggacccatgtccccgcaggcttcctccatgtcaccaggtccctgtctccctgctcttgctgctccccatcacttctcacatgaagagcacgcaggccctccagtgtcttctgtgtgcacaggcagcctcgggtctaccctcgggtggatggtcatggctttgcacgtggggcttgcgtggggctgcatctcctggctttctgtttgcctgatggtggaagtggggtgagtctgcttcttatgcttccgtgctggcatgttggagtgtggggaagccaccctcccacccaccgcccatggacagcatgaagtgatgtgattggtggtgaaacggtggatgctggcagtatcctgaggttcagcctcatagtagggcctgagtcctgggacagccctgccctgggctccgcacaccgggtggcggtcattctggctgaggttccttctctgctcactgagctcagcatctatacagtgtcagcgcgtgccagggacatgtctgtgtcacccaccatgccttcccatagacaccaacagcctggggggatgaccagggcaccaagcaaggtgcctggccactgagctccatccagacgtagaggagtgcaggtgtgtgcacatgcgagtgttaggagcacttttacaaataagtgcttgtgcttgcctctgatctccgcgtcccacccacatgtggctgaattcttactgacttgtaggcccagagttttgtgtctcaggagacaggatgccgagctctgatgagagctctgatgagagagaggagaggcgcagctgccccacggcccagtcctgcctgctgtggctgtcgtctgttcaggacccctgggtgcaggaccgcgtttcctgtggggccgtgggtcaggcccaggtgtgttgcatcactgaggccattctccagggtcatggccacgcgctctgggctgcaggtggcagcacctggcttggcttttcagctcagggggcctccaggccgggctgggagtggtccatggaaaccaaaccgtgaagaccaccgtctctgtttaactcacctttatggtgtccattttcctcaacatttttaaaagatgtttatgcttggaattaattgcaaaaatattcttacacaagtaatatatcaaaattatagaaaaatgggaaatcatggatacataggagagaaaaatgagtgaactccccagaggtttccttggtaaaaatgtatttgtcctctaaagtgaggcatgggcggccctcggcctctccatcccgagtctgcacccctgcagtaccacatacatcacagcagcagggaggggatggccaggcgcctccttccccacaccccgggaggtgacgtgaacacttctgtgtgcagatcagcacggtgcacccagtgccatgcgtgcagctgctcagagccatctgctggggccttacacccaggtagctgcactcgtccccactgtgggcggcaggaggcccctggacccatgggggaccctggacacaggcaggctggttccatcttatctggaaaccaatttcatgtgtgtcacctgtttccccaagagacccagagctgctgcctcgggccatacctgttgggcagaggtcagcatgcagtgacctcagcctcctggtgcctggggacacttgaggtgtgattcacagggaaccctagcttgtcacaggggcattttctgcagaagagctccggtttactcagcaacctccaccttccgtgagtgttggtagaagccattgtgtctgcatttcccacaagtctttggtggaatcaggagagctgtgttatctgggaaaggcattttaaaacaggattttgcgtatccaagttctgtgtcgaatcctgagaagacacataaaccatgctacccggaattttagtcccatgcctgagggttttctgagagctacatggcacaagccaggactttgctcgttgcctggcctaacttccggttagtgagctacgtgtggtggctctaggaggtgacctaggtggtctgcgactggaatttaacctgtacagtgggtaaatgtgtgacagtgctgcagctctggaaagaagctggcagaagggtatttcctcagtccagagttaggcctcttttccagaagaccatagatggagggcgtgtcctcagcggggcgcacctggagcccaaggcggcaactgtcccctcactgctcatggtgacttctgtccctggggtgaggtggtggctgccaggtgttcccactgtcatgttaccatttttctgtttaaaagttataatttgtagggagataatttgagatgatgtaaacaaactccctcattaaaatttgtcccggtcgttttaacatctgtcgacgattcctgtccgaatcagttatcttcacactggtggttgaacagcagtgagttgtttttttggtttttttttttgtttttttgtgacagagtcttactctgttgcccaggctggagtgcagtggtgtgatcttggctcattgcagcctctgccttccgagttcaagcgattctcctgcctcagcctccggagtagctgggattacagatgcatgccaccatgcctggctaatttttataattttaatagagacagggtttcactatgttggccaggctgatctcaaactcctgacctgagatgatctgcccgcctcggctacccaaagtgctgggattacaggtatgagccaccgtgcccagctgagttttaactccttcattccctctgcaggtactagctggaattctgctgtacgtggtagcatttgtttattatttgcttatttgtactaaggattatccattactgtggagttttgaggctggggtgggtgcggtttgggcagtgggagctgcctgcttggtttcagtctcctggggccgtctccaccat[136 bp omitted]ctgtctctactaaaacaatacaaaaaaattagctgggtgtggtggcgggcgcctgcagtcccagctacttgggaggctgaggcaggagaatggcgtgaacccgggcagcggaggttgcagtgagccgagattgcaccactgcactccaccctgggcgacagagtgagactccgtctcaaaaaaaaaaaaaaaaagaacagaaatttattctcttacggttctggagtccagaagtctggaatcaaggtgtcagcaggaccacgccccctctgagacactgggtagagctgttacttctggcggtgacctcagttctgggtgttcttggcttgcagtggcatcactccagtctcctctctgtcttcacttgccactgtccctgtgtgtctctgtctcttctcttctcgcaaggacttcagtcatattgggtcaaggacctaccctgctactccagtatgaccttgtcttagccagacacatatgtggtgaccctctttccagcagacttcacattctgaggtactaggagtgaggattgaacatatctttttcgacggagtctcgttctgccacccaggctggagtgcagttgtacagtctcggctcactgcaacctccagtaggttcaagcgattctcctgccacagcctcctgagcagctgggattacaggtgcctgccaccatgcccggctaatttttgtatttttagtagaaatggggtttcaccatgttagccaggctggtcttgaattcccaacctcaggtgatccacctgcctcagccttccaaagtgctgggattacacgcatgagccactgcacctggacgaacatactgttttcagagacagtacaacccatagcccacatgtgcatgtgtattagtccattttcacactgccgataaagacatacctgaggctgggcgatttacaaaagaaagaggtttaatggacttatggttctacatagctggcgaggcctcacaatcatggcggaaggtgagagggatgtctcacatggcagcagacgagagagagcttgtgcagggaaactcaccttttaaaaccatgagatgtcatgagactcactcacaatcatgaaaaaagcatgggaaagacctgcccccattattcagttacctcctaacgagtcccactcatgagacgtgggaattatgggagttataattcaagatgagatttgggtggggacacagccaaaccatatcaatgtgcatgtttatttctatatagttacctacgtattaaaactataagtttatactgatatttccaattccatttcagcactgcagagttcattctagtcttctctctttccctttttctgacttcattaaacactgaggatccttgcttcattattcttagtatattactcatttgctcatttccaaaaaaacacagaaagtagtttcagaattgctaatcctggctgggtgcagtggctcacacctgtaatcctagcactttgagaggccaaggcaggaagatctcttgagtccaggagttcaagaccagcctaggcaacataaggagacctcgtctctacaaatttttttttttttttagacagagtctcatgctgtcacccaggctggagtgcagtggcacagtctcggctcactgcaacctctgcctcccggattcaagcaattcccctgcct[135 bp omitted]gcctcccaaagtgctgggattacaggcatgagccaccgtgcctggtctacaaaaaggtttttaaaattagctgggtatggtagcacacccctgtagtctcagctacttggaaggctgacatgggaggatcacttgagcctggggaggtctaggctgtagtgagctgtgatcatgccgctgcacgcccgcctgagtgacaaagcaagaccttgtctcaaaataagaaagaattgctcatttttaccaccgtaaaacacaaacctgccaactctagttcaatatttgttatcaaatttttatctttagattgagaatatatagtaaaatattatgtttaaaattcattagccgagcatggtggcacacatctgtagtcccagctactcaggaggcccaggcaggagaattgcttgaacccaggacatggaggttgcagtgagctgagattgtgccactgcactcccctgggtgacagagtgagactctgtctcaaaataaataaataaataaaattaaattaaattatttggaatgatagagtaacagggtttagatttattcttactccttaagtgaaaaactggacaggacgtatggatcagctgttttcagactcggaccttttgctgaggggacggaagcaagtgaggtgagccctgtgatctccctgacttccatctgaaagcactttctggaccaagttcagagaggaacagtccaagtacagcttggaagttcctgattggtagaggggacaaactggaacttggggaagctgaggcagctggaatttgcagggtggcatatgagagagcagggaccttaacagaaacagctcctgaaaccacatgggcatcccatagcctttgcttgaatactaaactgtgcgtgtgccagggagctgctagctgaatgattctcagcgttcacacaaggccaggaggct[137 bp omitted]atggtgaaactccacctctactaaaaatacaaaaattagccaggcgtggtggcaggcgactgtagtcccagctactcaggaggctgaggcgggaggatcacttgaacccgggacgtcaaggctgcagtgagccaagaatgcgcgactgcactccagcctgggtgacagagactatctttaaaaaacaacacaaacaaaaaaaaaaaacaaccctgttgaacacccagatgttcactagaggtgccagaggtactgaattatgcccatccctacaagtgccaaaaattcatcatgacaagatccagcagattgacaagtaagtcaactgcctgccccccaagacattcaacactctctcttttttttttctccctattcttgccattctggatttcagttagatatatgttagttagaccttctcattttattctccacgtccctttgttgtactagttttcctttttttgcggggacagagttttgctcttgttgcccaggctagagtgtaacagtgtgatctcggctcactgcaacttctgcctcctgggttcaagtgattctcctgcctcagcctcccgagtacctgagattacaggcatgtgccaccacgcctggctaacttttgtatttttagtagacatggggtttcaccatg[131 bp omitted]caagacatgcaacatggcactgaaatgcccagtgcccaatcaagaattactagatatgccaagaaccaggaaaatgtgacccatagcccagagaaaaatcactctgtacaaaacagacgcagaaatgacagagatgatggaattcgcagacaaggatgttaaggcagcgactatgcatgtgctcaaggattcagggaaaacaatgcagagataaatgggtgttatataaataatccagtgaattaaagctgaaatgcagtatctagaatgaaaaattacttgttgggccgaatatcagagtagactttgcgggagttgagtgagtttgagattataacagtggaaactagctgaactgaagcaccaaaagaaaaaaatgatgaaaaaaacgagaagggcctcagcaaactgagacaaacatcagcgattctaatatgcctgtgattggaatcctagtaagaggttgtcggggggcagaaaagatttcaaaattaatgcccttgaatttcccagatttgatgaaaacgataaacccacagatacaagaagctcaataaacctcaagcaggatcgacacaaaggaaaagagccactgttgggcctagcactgaccaggtcaaaataaggctggagctgaacctcagtgtacccgaggcaacgtgcagtgggggcttaggatattggtgctgaaacttagttttcctcttaggggattgcagtgacattgtcaaactgcagagtctgagggcacagtcctccacaagactgcctttgctgcagacaccagccacacatttggggtccctggggccaccctcacttctaaccagcaggttacagttcaggatccaccctccccagctcttcaggtgacacattcgcagtactcactgggcgtgccctaatacgattatagtcaattggaggaaaggatgcttgttggaaggatgtgcagggcaaagtctgggaggtttccatgtgcaaagctttccctgtcctcagggacgcatcaccctccgagctctgaggtgggacgctcctcagggtactgccagccaggggcgctcacttgggctgtggtgttcagtttttattggggcttcgttgcatgggcacagttgactgaatcactggccacgtagctgagctcagcctccagcccttcacctcccaggaagtcagctgagttcaccaggcacacagccccaggcctctaaccccatgctgtctttctggtgtggccagccccatgttgagtcatcttgctagcataaagtcaggtgtggccccgtgataccagtcattcctgtcactcagaaatgagggtgtagagactgcctcctagaactgggccagaggccaccaaatcctacccaggagtcaatcagtatctaaacttgataaatcaagaagaagttgtagaaatgtattatttagaaatatagaggccgagcgtagtggctcacacctgtaataccggcactttgggaggccaaggcaggcagattgtttgagcccaggagttcgagaccagcctggccaacgtggcaa[177 bp omitted]gtggcgggcgcctgtagtcccagctacttgggaggctgaggc[131 bp omitted]tagtcccagatactcatgaggctgaggtgggaggatgacttgagtccaggaggttgaggctgcagttagtcaagatcacaccactgcactccagtgtgggtgacaaaaaaaaaaaaaatatatatatatataaaatatataatatatacatatagactataaatgtatatatataattatatagaataaatacatgtattatgttatgtatcatatatatgtattttgattaaaattttaaataatattataaagagtaattgcattacttcaacagttctgtatctgagttatatcatagacaaaataaattaaggcctgctttctaaatttaaccatcattttaaacattctaagcagggaaaacattgtgttctaagcagacatagtagtaaagcctcctctaggccgggcgtggtggctcatgcctgtaatcccagcacttcgggaggccaaggtgggcggatcacttgaagtcaggagttcaagaccagcctgaccaaaatggagaaaccctgtctctactaaaaatacaaaattagccaagcgttggtggcacatgcctgtaatcccagctactcgggaggctgaggcaggagaatcgtttgaatccggaaggcggaggttgtggtgagccaagatcacaccacagcactccagcctgggcatcaagagcaaaactccatctcagaaaaaaaaaaaaaaaaaaaaaaaaaagaaaagtctgctgtaatataagtggcatcatatcctggcgcttggctccctgcatggatttttactctgattttccatttgttgtcttctcccgcaccccgccgtcaccattgtaggtggacggaggctgacgtgtgtgccgtagctttgcaggtgtgtcaccatcggaggtggacagaggttgatgagtgtgccgtggctttgcaggtgtgctgctgtcaagggtgtgagcagtgcccaggaatctctgggaaatggggttcccttttctgagcatcaccctgaccgtagcgcctcctgatggaatgtacttcctggaacgggtgttaagaacacaggcgcagggacacacagacatgcacacatcctgttgcagacacatctgcagataacacatctccatacatggactcacgcagatgcaggtgcacagagacatgcagacagacatgcatgccaagcactgaggactgtggcacccagggatattggcatactgacagcacagggatttaggatccgtttggaaaggcatacccagaagtactgcggtaggtggtcagggggcctagtggctgctcctctgtgcagcacgtcctctcagatgcacacattgtgtgggacagcagtattttcacaattacatctgtttccatttcctgaagtggaatatgagttaatcaagtgcttggaattacataattagcaaatccacaaaattgtctttcttatacttctttgcaaaagttttatgtgtttaaacgaacccttccaatttgaaaggcttagctgagtttgatgtttctgcatgaaaatggacacattcgattttaagtgtcccctaatccattatcaagacacaatctcttgactaattgagtgggttacaaatacctaagtgtccctgtccttccctgctggtgtgtaacttgtgatctgaaccaccggggcgtcgccgttctcgtcacaggcagctgccccaccgtcctcgccgtgtctggaagcgcagcagagcccacgagctacctgaggattgcgttgggctcgaggcggctctggtacagcagaccagaccccgggtgttcctgctgtggcccctgagctttgggtgcatttattatatttgagtattgagatctcattcgttctatggttttcgattcactagaattttcctatttgatgattgtatcagttgactgggaggaagatttagtagatggattatggaggacttctgaattttaaagaactattgttaaatttggtttctttttcttttttaaatctttcttgtttaggtttgttcggacagtgttaccattttctcaggaatttcaaagagataagcagcctaatgcacagcctcagtatctgcatggatccaaggtaggctccaatgtgttcgtgttacgagcttgaagctcataatgaagcatgttttgaagtgtagtttaattggtttggttgcagtgacctaaatgtatcacgctgtgtataaaatgttattttttttttccattctgttaacatcttcctgaaaagtagcagtaatttaaaacaaaaactagccaaccaacccaaaacagtgcttatctagaactagcgcgtacgtagtgttgggacagctctggccttgtgataggtgtcaggctgggcctggtctctttcccagcacaaacacaagtgagattgttggaagattacaggtttaaaaacatcaagctgagaagacaagtggaagaggctcaggtgcattcctgagataaggaggcccagggtggctgtaaggcctgaccggaggagcggagctggaaaggtgagcccagggaaggtctgacatccagaaacaaggatgtccgcctgtgcctggagggtggaaacccggagcacccgggtctaccatgtgtgagataggatgatgtccacgctgggggtggcttggcttgtcacaagtctgagtattattaagggctagtttcttcacgtttcaagcacccgtgtgatttagtaaggaaaatataaacattgtagcaacgaagagagatgaaatgagcagataccccacaaaaatagagcagagcaaatacaagcagatccccagcctcagcggagctggggaaggaacaatgatggcggcaagagccagcaggcccccaggatgaggccagaggatccggctcgcctgtgaagagcgaaagcgtcttccctctgcgagctgcggtgtccccgggctctgcggtgggggcaggctgccagcactcatcagtatttaagtgtcctcgcttgtaggaagcggggacaatcacaggacattgtctgccccatctgcccaatgcctggagctgggatggagagggcccaggccctgccgctcacacgctgcctgcacctggacgctttctaacgcaccagctggctctgagtggcggaaacaatgttttccactcattcctttctaaccctctgttcttcagagcgagatcttctcactccagtcctttgggcgtcttccttctccttacagggcagtgccttggacctggcaggagcgcaagtgtttgcacctgggaaacggcaaacacccaaatcagggcattggtttttggagggcccaagcctcggcatacgctgcccgtctctcccgcccctgaaaagagcgagtgtgggccgggggcggcctttttacggcactcagagcatctctgagcaggagagacaggtcgtctgaactgtgtgcagtgatgaaggggatgtgagattcctcttcgggaaacggggcccacgtggaccaagggtgactgtgtaaacattatgtccttgaaaatatgttctttttattttttatttttttgagatggagtctcactttgtcgcccaggctggagggcagtggcatgatctcggctcactgcagcctccgcctcctgggttcaagtgatcctcctgcctcaacctcccgagtagctgggattacaggtgtgcaacaccatgcctggctaatttttgtatttttggtagagacggggtttcaccatgttggccaggctggtctccaactcctgacctcaggtgatctgcccgcatcggcctcccaaagtgctcggattacaggtgtgagccactgcgcctggccatctttagtgttttaggggttattttttttagcaatgttatgatggcaattgaaaaaaatacaattcagatcctctctagggtgcagatgtttgaaggaagtgggttcttgcctttcacaaagacaaggttaaaggtgggggtgggaggtggcattgcctgccttggggagaaaaatgtcagggctgggagcctcgctgacacatgagggccagggtcgccaatgcctggagaacatgggacaggctcattccatcattccacactccgcgttctcgaggctgttggcaggtgcggcctccgctgtgcccctccaccctgtctctgttcgtgttctcgaggctgttggcaggtgcggcctccgctgtgcccctccaccctgtctctgttcgtgttctcgaggctgttggcaggtgcggcctccgctgtgcccctccaccctgtctctgttcgtgttctcgaggctgttggcaggtgcggcctccgctgtgcccctccaccctgtctctgttcttagcaactcctaatggctgtggaactgtgagtggacacacagttcgtgtgattctgggcttcatgtggctgtgttggtgccccaggagggcatccagacaggtacccaggcgccaagaatgcagtgaccgggcctctcctctgtggggcagggtggggtgcacgcctgggcaggggtgcgccacagctgttacggggctccccctcacttcccgaagccctgtgagtggttaagaattcacctccattctgctccatgtgatactcccatgttctttctagcaaggattgaagttgacttttctttttttttttttttttgagatggagtctcctctatcacctaggatggagtgcagggcacaatctcggcttactgcaacctccacctcctgggttcaaacaattctcctgcctcagcctcccaaatagctgggattaaaggcgcctgccaccatgcccggacaattttttgtattttttttttttttagtagagatggggtttcaccatgttggccaggttggttttgaactcctgacctcaaatgatccgcccaccttggcctcccgaagtgttggaattacaggcatgagccaatggtggtgcccagttgaagctgacttttatgcaataattagttatactcaaaaggatgtttctttaaaggattagagtaagtgttctgaggcttctgcttctgaaagtaaaatgtagtgttttacctttagaactgaaggaaatgttattttagaagataggactagaaagtttggcgagtgagaataatttcttgggtctctgtgaactaaaagatttgctctgggcttctcttgactttgaaatttttaatccctgttttaggcataacaataaagtaggtttttgtcactccctgatagagaggcatttgtgcgcagagggcactgggcagagaggctcctctgtcacccccatctggagaggatggctgtggaagcgagggaggcaggcggggggtaggcaggcgacccgactgcgtggggccgtgcacctgcggttctgatggatcgagtcctggaaggggcctcgtggggttggtttttgagatcccaggatagcactgtggtgacatctttgctgcccagtgtgtctgtgtgccctttgtggtgttaaaggctcttgacacacgtttttattctccaggattttctcccaggagtgcagggaggcactgttgcttccattaagatgccaacatgagcgcgctgttccagggtggtggtgcggggtgcacatttgccttgagtcagcccctacactgccagagcaccctgctgccctgtgtgcatgggcaccacctcagggatggctccagggaatgggcacttggaggcatttgcaaagctgatgctcttttggagagaaagaaagatttgatgatgtgaatttgatttttttttaaattcaactatttgcaactgaacttgaacctcactgtaagagatttctgcctccgtttcagaaactgtttgtgtcgtttttgttaaaacctaagctagtacatggtttttctttttgttttttgttttttttgtgtgttttttttttttgagacagagtctgtcccctaggctggagtacagtggtgtgatcttgcctcactgcaacctccagtgattattgtgattccagtgattcgtgtgcctcagcctcccgagtagctgggattacaggagtgtgccaccacgcctggccaatttttgtatttttagtcgagacagggtttcaccatgttagccaggctggtctcgaactcctgacctcaaatgatccacctgcttcagcctcccaaagtgctgggataaaggcgtgagccactgtgcctggccataaaccagtaattttttttttttttgagacagggtttttgctttgtcacccattgctggattgcagtggcgcaatcacagttcactgaaacctccgcctcccaggctcaagcaatcctcctgcctcagcctcccaagtggctgggactacaggcatgcaccaccacatctggctaatttttgtgttttttgtagagatgggatttcaccatgttgcacaggctggtcgcgaactcctgagctcaatcagatctcctgcctgggcctcccaaagtgctgggatgtagccgtgagccaccgtgcctagtcctaaaccagtaattttctattagattatttagacatatacaagtgacactgatgttgaccaccacccactcaagaagaggctggatactaaaagagatgatgtctgagctgagtcatgtgctcacagcagacagcccttgtactcacaagcactcacatatgccacgtgcacttgcttctgctgcagtatgagtcacagtgtatatctgtgtgattatggaatacacaggaatccactcaaaaaacagattagtgctttttttatgaatagtgaactagggctggtatcttgcaggaataaaataaacttagatgagggacccatttatgcaatgttatctttttcgttcttggtcatgtcaccacttacagcatgcctgcttctcagtaagacacccttttgagcacattaactagtattctttatctcataagtaagattgtccccatttcacagatgaaggctcagagtgtcgtgaaagttagagcacccaagttgcacgactggcgagtccagagccggctctgtgtgctgtgacccaccttctctgcttgtcgaacaaggctggagactgtatcaggcacgggcagcagagtctgtcttgaactgagctgtgtgactggacatccagagtgcttcctcttctgagcttaagtcttttacagcacagtgtttgtgacggtgcccttccccagaagtagtgcctcctcccactcccctgagtagttaagtcacatctgctgtttgttaccctagctgtgttgtctctcggatgtgtcatctttggggtgagcttagtctactgggaaaccggacactgggcagggggccagaggcctgggaccatgtgttcattgagtgatgcctcctctgacagctgtcatcctgagccagtcagggcgggtctgagaatgaattctctcacttgtaacatgaggtcattagatttcactgatgactttcgtgttcttcttttcaaacattgaacctgttatcaaccaaaaatattacacagaatcccagcacataaagcccagggtgctgctctgaggagaggctgggaggagggggtgtgggcgaagatgtgtagatggtttcttcaaggttgcagcgggccgcagggcttgggcctgggacagacactgggtggggtttctgtccttcagtgttgtctaatctcgtcactgtaatcagttttggctctttgttttggggggtctcatgaccctctacacatctgataattcactagaaggactcacataactcagagtcttacagctgcagtttattccagcaaaggggtacaaagcaggatcagtaatggaagcagacagatcaggcggaggctgaagaaagcaggagtggctgtattaatataagataaaatcaacttcagagcaaagaatattgccagggagattacataataataagtcaaaccaccacgaagaaaacatagcaatgctagatgtttatgcgtcaaacaacaaggcttctgtacttgaaggaaagactaatagaagtaaaggagaagtgaacaatcccacagttacagttggggacttcaactctcattttagtaattgacagaacaagtagacacaaaatcagcaacagtagaaaagaactgaacaccaccatcgaccaacaggatctaactgacgtgtgtaggttcctctaccccacaacagcagaatatatacgtttttcagattcccatgaaacattcaccaagatagaccatacgctgggccataaaactcacctcaacaaaatttaaagaactgaaatcctatggagagtgttctccaactacaatgaactcaaaccagaaaccaataataaaaagataaccagaaaatctctatatgctcggaaattagcacacttttaaataatccttgggttgaagaggaaatctcaagagaaatttaaaaatacattgaattgaatgaaatgtaaatatatcaagatttgatatatacagctaaagaagtgatttatttgatttgattattcgatttatttatttgatttatttggtatacagctaaagtgctgagagggaaatttatagcactgaatactcacagtaggggtctcctgctatctgcacccgtgtccttagacaagctgaggggtgtccttctgcaggaaccaccttgatatgttttggctctatgtccacacccaaatctcatctgaaattgtaatcctcataacccccatgagtcaagggagggacctggtgggaggtgattggatcatgggggtgacgatgttctcatgatagtgagttctcacgagatctgatggttttataaggggttcttcccccttgctctctcttctcattcctgccaccttgtgaagaaggtgcctgctcccccttcaccttccgccatgattgaagttttctgaggcctccccagccatgtggaactatgagtcagttaaacctctttcctttataaattatccagtctcaggtatttatttttagcagggtgaaaatggactaatacagtaaattggtactggtagagtggagtactgctataaagatacctgaaaatgtggaagtgactttggaactgggtaacaggcagaggttggaacagttcggagggctccaaagaaggcgggaagatgtgggaaagtttggaactctctagagacttgttgaatgttttttgtttgtttgtttgttttttgaaatggagtctcaccctgttgcccaggctggagtgcaatggcgcaatctcagctcactgcaacctccgcctcccaggttcaaataattctcctgcctcagcctcccaagtagctgggattacaggtgcccaccaccatgcccagttaatttttttgtatttttagtagagacagagtttcaccgtgttggccaggctgttctcaaactcctgaccttgtgatccacccacctcggcctcccaacgtgctaggattacaggcgtgagccaccacgccctgcctgttgaatggttttgaccaaaatgctgatggtgctatggacaataaagtgcaggctaactaaggtggtctcagatggaattgaggagcttgttgggaactggagcaaaggtcacttttactacactttagccaagagactagcagcattttgccccgccctagagatacgtggtacattgaacttgagagagatctgaaattggagtttgtttaaaagggaagcagagtataaaagtttggaaaatttgcagcctgaggatgtgatggaaaagaaaaacccattttctggagaggaattcaagctggctgcagaaattttgaatgtcaatcaccaagacaatggggaaaatgtctccaggacatgtacgaggcagcccctcccatcataaacccagaggcctaggagggaaaaatggttttcttggctgggcccagggcctgccctgcccctatggttccccctcccccacctccccaccccaccccccatccccgtgcagcttcaggacttggtgccctgcatccctgcttcctggtcgctaaaaggggccaacatacagctcaggctgttgcttcagagggtgcaagccccaagccttggtggcttccgcgtggtgttggaccacctagatttcaaaggacatgtggaaatgcctgaatgtccatgcagaggtttgctgtgggggtggagccatcatggagaacctctgctagggcagtgaggaagggaaatggggggttggagccccacacacagagtccccactggaatactgcctagtggagctgtaaaaagagggccaccctcctccagaccccagtcagcttgtactgtgtacctggaaaagccacagacactcaatgccagcctgtgaaaacagccaggagggggactgtaccctgcaaagccacagggtggagctgcccaagactgtgggagcccacatcttacatcagtgtgacctggatgagagacacggagtcaaaggagattattttaaagctttaagatttaatgactgccccactggactttgggcttccatggggcctggagcccctttgttttggccagtctctcccatttgcaatgggagcatttatccaatgcctgtacccctattgtatctaggaagtaactaacttgttttttattatataggctcataggtggaagggacttgacttgtctcagatgagactttggacttggacttttgaattaatgctggaatgagttaagactttggggcactgttgggaaagcatgattgagatttgggaggggccaggggcagaatgataaggtttggctgtgtcccccacccaaatctcatctccacttgtaatccccattatgcccacatgtcaagggtgggagctggtgggagttgactggttcatgggggcagttttccacatgctgttcttgtgatagtgagtgagttctcacgagatctgatggttttataaggggcttcgccttttgttctctcttatctttcctgccttcttgtgaagaaggtgcttgcttcccctttaccttctgcataactgtaagttttctgaggcctccccagccatgtggaactgtgagtcagttaaacctgcctttttttttttttttttttttgagatgaagtctcgttctgtcacccgggctggagtgcagtggcgcgatctcggctcactgcaagctccacatcccaggttcatgccattctcctgcctcagcctcccgagtagctgggactacaggcacctgccaccacgcccggctaattttttgtatatttagtagagacggggtttcaccgtgttagccaggatggtctccatctcctgaccttgtgatctgcccacctcggcctcccaaagggctgggattacaggtgtgagtcgccgcgcctggcctaaacctgcttttttttaaaataaattatgcagtcttgggtatttctctatagcagtgtgaaaacggactaatacacaccctaactaccttcctcgccttcccactccacaggggtctctctcccggctccgggggtgccctgtgcatcctgagaaggcagctcccccggccccttcagggtccgaccttgggcatcctgctgggagactgggaggcagggggaaactctgggtcgtattcatttctcattctagacttcaaaatggcttctagcgagtcggctattcaacaaatgttgaaacaccaaatggttttcttttcttttctattttagcaggtttctttttggtggcaggctaagtaggttttgtaactgtaccagttaagggcagtagattttacaagtcagtagactcagacccgctcacctgagcctgtgtgtgttgagtgatcttctcacacagttcttcatctgcacatgtgtgcggggaccatgctgagagctctgtgccctgttttccaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctggtgagtgttccctggacatgcttctttcacacagcctggattccctggggcacccatgccagagggtcttctctgcctggactgtgattctccaacagctggattcgttcaattaggcttcaaacatttctgaccatatatagtttgatacttccctcatcttttcaaactcaagagaatgggtccaggttattttaactgatacgcagagtttttatttgtatgtgtagagagggggtcttgctatgttgctcaggctgtccttgaactcctgggctccagagatctgcccatcttggcctcccaaagtgctggggttacaggcgtgagccaccttggccagcctggatttagttttctagacataacttactttttataatttttcatcctttttattattttaatcttctgtgacttgagaccatgtaagagtttggtcacttggcacagccatcagcccgtgacccaaacaggtccttccaggacccgctggggactctgtcccaaaacatgtggcagcttggagggtgttaggattgctgacctcaccacagctgagcctggggccgcacccaggagcacagacagcgtcctgggggaccctggagctggcagtgctcacgatgctggggtgcatccccataggagacacctggcgacaaagctctcccctcattgtggcaccccgggaccactttcatcttgaaagaggagtccagtttcagaacatgaattcagtcatgggaagccacctggtgatggttgctctctctcccggggtggattttattccccagccagacgatcctgcagccttgctggttaccgagctctttgctaacagacttgtttcagggtatgcgccggccacaggcgttagcagagcggagtggggtggctgacgcagcccgtctcatctccccggcagctgcaaggcacaatcctgcagtacgtgaagacgctgatggaggtgatgcccaagatctgccgcctgccccggcacgagtacggctctcctggtgagtgcgggcgtgtggagctcacagtgctgtctgtggagaggtcagaaaggaattcaagtcagaaattcttgagaaggattagatttgccatgtgggaagaggcagtagacagacaaatgcaccttacaaccaggaagaggtgtgttggggtcactgtctgcaggcgaggaagcagaggtcagcctgcaagagttgagacaagagacccctgaacaccacgctctcgggcacccctacgaaagaattgccacccaatgaggcgagagagccgactgctgggtcctgctgccctgctgggcctatagggacttgaggctcagagacaggcccaccgagatggtgcaaggcctgcccctgcccccaggccgtcccatccatctgcaggtccagctgcagggccctcaggcaggtgtgctcttagggacaggcccacgtgacttgctgtgggttggtttggggcaatgcaaataaatagctttagtgatctcagaaagcattgtctcataaaattgtatgacagggacctttgtcacgtaacaaaactgcttttagtctcttacctggccgagttttcttgaaagctggacagttgaacactagccttgtgttgtaaagcgacttgagcctgcacgtgggtgaccgacgaggcactgtcctgatgggcagtcagtcagcgtggctgagctcttgaacacgtggctcaggactttttgctttttggcaactccccagggctgttgctggtgtttgaggagacgataaggtgtccccctcagccaccatggggaagtagccatcagcacggccctggctcaagagaatctgttttcagtttattgtcagaaagtagaggaggaatgctgggatgattaaaaccaatgcttatgtcgtgactagagatggaaatttcagatgttgaggagggagccatttcccagtgtggtacagggaaagcttgctgggaatgacacaggtgcatgagcgtccccgcccccacccccgccaagtggggctgagtccctgcagcggtgctgagagctgggaggagcagaggggccgtgtcgggccgctggtccttggggaaggggcactcgggcaagacctgctgggacaagggtttaaggtctgctgagcctcccgctttgctcttcccagggtagtttaggcccctcctgatgccacgttcattgtgcggtcagctgccggtttctgtctgggctggagttgaagctgtagattggctgggaaacgttggccttctgtcccatatttgcaccttgcgtctttttgtgccttattccgctgtccgggatgccgttgagacgcctgccttgctctggagctggcctggtgtgcggcctcccgttgggcgtgctgttagttagctgcaggcttcctagatgccctttctcagattaggtgcggccccttccatgcctgcgaagagagattgcattttgtcaaataccttgtctgcccccactggggatgtggtgcagtctttgttcttgtcatgtggtgacgtttcctatcatcatagccttccctaaagatatgaggttgagttgaaaagaggcttcagagccaaggcccggggtcacatggtgtgtggagaacgtgcccaggtggcgaataaaccaccgctgcagggaagatgctggggatgggacgttgtggctgtccttatagccaggcttgatggcggtgtcagaacggcaggtgctcctggctgtggacccaggctgctagggcccggccccctccagtcccccaaccccacctcactcccgccaccgtaggtatcctggagttcttccaccaccagctgaaggacatcgtggagtacgcagagctgaagacggtgtgcttccagaacctgcgggaggtggggaacgccatcctcttctgcctgctcatcgagcagagcctggtgagtggccccccaacgccgcccctccccgccccagcccaccccaccccaccccaccggccaggggagggctttctttggcgggttctttagtgggggtgtggcaacagctgtgcatcatttttttttttttgtggctgttgagactttagtttgaatttgttcccttcaattgaaaaacaaaaatgtactgtagttcactgtctcaagaatgtttttctgtgttaacgtcataaaactgttatattatgtgatgttttcaacatctaaatgaacatatttggtgtgcctgtaaggtataaggcattgctgcgcaggagggccctctgtatgcctgaggccgctgagcagttgaagtgtggctcagtgtgactgaggaactgagtgctaaatgttactgaattatcactgatttaaatctgaatggctgcacgtgccccatggtggacagcacgagtggccagcatgaaaggggagcccccgggagcccaccccctcttaggacgtggcacagtggacgcctcgtgttttcgactggccgcctttttgtggtgctgtctggctgtccctctgtcctgtacatcacagcagctcagtttataacctcctgggctgggaaagccagtgggaaatggaatctcaggtagccctctcctgccttccatcgtgactaacgaggtgggcatctcttcgttcgttgcgtcttcttgtttcttttcctgtgaaatgccccattgagttcttcggcctattttctttttctttttttttttttttgagacggagtcttgctctgtcaccccggctggagtgcagtggcgtgatgttggctcactgcaagctccgcctcccgggttcacgccattctcctgcctc[221 bp omitted]ctttatgtgctgcacatatcgtaaattcttctcccatttgtggcttaccttttcactctgatagtggtgatttttgataaaatgctcttaatttggatgtagcctttttttttttaatgattagcacttttttttttttttaatctaccatctgcacatggaactttcagtatctttttgaagatgttttccctgccttggggtcatgaagacattcctttacattgtcatctaaagatttgaagctttgccttctgcatggaagtttgtaatccttctggagttggtctttgtgtataatgtgagaggcagaggaagcttctttctctctgtggagacccatttgtccctcctctagtggctgaagggctcctcctcccgttgctgaccagtggtgtcccctgccatctgccagcttttcatgggcacaccggcctgtctcctggctttctgccacatctcgctggtccaggcatctgtctctgacatcatagcacattgtcttgctcatcgttgctctaacatgactctcgagtccccacttgccgcgttccctgccttgctccttcttcttcagcatgttccctccccagggctctctgctctgccctgtttggggattggttcaccacataccctggcgaagcgtattggcttgtgcatgggaatggcacttcgtctccagagctgcctggggaggcctttcctatgttgtttcccaaagcagtctcttgtctttaggtctctggtagctttgcaaaggcagagttgtgtttgggaagaacagggagagggtggtctgtacacagctcagggcattgctgtcagactgccaggcctctggggactgagcctctggaccagccgcctcacaccagcctgtgcggtgaaagagaatgtgttggctcacatgtcaggggagtccgaggtcaggcgtgacacgcctgggagctgacagcctccatcagacctgcatcttcggctccctctatgcctgcacgcctaggcagaccctctcctggtggtttcaaagagggactgcagcagccccaggccttcattgtcctggccacccacaggctcggtggggaccccaagtagcatctcctcccatgctcccctcaccactgtgagtgtgaggggtacaagatggagaacccaccagtgtctcagaccagcaagaagccagtgtccagggtggccctgctctaaggacatgttccccaaataattgtgaattgttaaaaaccagatgttaggaagcatctctttaagtataatctctcattatgaattttaaatatttaatacaggaatattcctttcatgggtgacttttcctgaacttacagcataaggcgcgccctatctcatctgctatcttagtccattttgtgttgctgtggcagtgcctgagactgagtaatttataaagaaaaggagtttatttggctcatgactctggaggctgggaagtccaagatcaggcagcccatctgtcagggtctcatgctgcttcagctctgggggaacagagaaggggaagcgggtgttgccaagagaacaaacatgagaggcagccttgcttacaacaacctgctctcgcaggagcttatccattcccacaaaaactaacccaattgtgggagaactgacccagccctgtaagaaatccatcacctctcggaccaccttccaacactgctacattggcaattaaatttcaccatgagttttggcagggacaaaccacatccaaaccatagcctctgtgtatgtccaagcctgaggatgcctgtctggtcattggcctcaggtcagggaggtgagacccgagctttcttaatggggagacagccttgtggaattgatagagatagtgtcagagaccccttagggctggtttctcttctgtccagctgccctttttggaaataagataaagtgtcaaaagcttttctttacatcatttctttttttttttagactggagtttcacgcttgttgcccaggctggagtgcagtggcacaatcttgactcaccacaacttctacctcctgggttcaagtgattctcctgcctcagtctcccgagtagctgggattacaggcatgtgccaccacacccggctaattttgtgtttttagtagagatgggg[135 bp omitted]ttatttatgtccatcccaggactcatggacataaataattatagaaccacaagagtttgaagcaggcagaatggaatttactaggataatctcttagcttaaaggcacggtttctgtgcattgtcatggcaacagttggccctctgttggcttctggatggagtgtgatgctgcattagaaacagggaaagagaagcggagcagatggtgtctggccggcgtctggcactggattgacgttgatgagtacggaaaagtctgcctttcttcctcttggtcttagttttgccatcatctctgggaggtcctcagaagttaaaatctcattgtcggtatttcttgattttctgatagctgtttctttgtttaatcatttcttttactcctatgggactttaagatttcagcatggctgtggggtcggaggcactgaaggctccatcaccttctgcctgctccgtgggggtggtgagcgcactgtggtctgaagaggcccttcctggtggcctaagagccctcacctctaaagatgaacagcagttgctcaatttttgaccatctttgggttcttggtggatttggggtgttctgctgtcctcatgatcctggaggtacattttctttatatatatatatgttattctggagaacggaccttgtgtggtttttattacctctgtaaaggagcttgtgacccaagagcagttcggcatgatggcctagaactttgttttgggctctgtagggaatgagtggatgtggacaccagggtaggccacccctactccttccatctcctgtgttgtttgcaggagacgccccttccttctgtcagtgtggtgggatcttgtcataaactgtggttcttaagagcctggtggcaaattagcagggaaggatggggcgagagcttttagacaggtaaatcctggaaaacagagcacacattcaacactgggtcttacctgtgtctatatttacattaattaaatgtaactaaaaataaaattcagttcctcaagtgccaagccacattccaagtacttactaggcatgcatggctggcggctgccggaatggacaggacagacggaagcatttccatcatcccagaaatctcttgacagagataaaataaacttacagagtttattttatgctaaaaggcaaagaagttcttggttttcagcaccagattgctctctggcgagatacccttcctagcttgaccctctctttctctgctctagtctttagaagaagtgtgtgacctgctgcacgcggctcctttccagaacatcttgccgcgagtccatgtgaaaggtgagcctgctgacccccaccagggagtccagactgccctctgtgggggtggtgcccactgtatgcaaccggagagctaaggaccagtgcagattgtgggtttggcgcctgttcagtcatacccaggggtaatgaggagtgtacagaacctagttaaatgaagattgagaaatagagctgcaatgatatgatgtcttagaattgcttccaaatatcaatagcatgggagcagggggagttgggtatataagaagcagagtggccatgagttgataattatagcagatgatgggtacaggctcattgtgccattttctgctttcgattacatttggaatattcaataaatgaaaagtgaatattgagcagaaaattggttctgccggtttgaattaaaatattaaatgagccagttctgtaaaataattttcaaagagaatctgtatccataatgttaacttaaaaatcttttgttttttaaacaaatgtaaacctttgcaattaccgtttcatacaaaggagcagaatatagtaaaatattttttctactgcagagggggagagacttgatgccaaaatgaaaagactagaatcaaagtacgccccgctgcatcttgtcccactgattgaaagactggggacccctcaggtaacgtgtaccgtgatggctgtggctgttgcaagctgggcatccatgccaggccaggtggcctggttgggagccagactggaaggcatcgtgaagtccagcggctgcgtggctgctcaggcctcaagtgttgcaagtggggtgtgcaccaggactgcttccctgggtggtgggaggattcagatgagctaacacctggaaagagcttagcacatcacctggcacgtaaggcttacacagaagacatcactttcactgtccagcccttcatgaagaaggctttcccataggtgtttaagaacagaagaaattaggccaggaggcaaggtgtcagggtagagttctacagtgatccagctgcttatgctaagtcagggtttctcagccattttggaccagataactctatggtgggggctggggcgccctgtgcatcgtaggatggttagcagcatccctggcctccacactagctgccagtagacccgctccacccaaaacatttttccagggccgggcaccggggttcattcctgtcatcccagcactttgggaggccaagacaggagtttgagaccagcctgggcaacatggcgaaaccccatctctacaaaaaatacaaaaattatccgggtgtggtggcatgcacctggtcgcttgagcctgggaagtcaaggctgcagcgagctgtgattgtgccactgcactccagcctaggcagcagagcaagaccctgtctcaagagaaaagagacatagaggatgtggagtagctggatgcctggaggcccacggcattccacggcttgtcctttctgcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagtaagtgtgtgctgagagcaggacaaagccccagaggaggggaggagctgtgggggaggggaggcgtgttaggctaacaagcagccagccatgctcaggaagtggaccagaaactcactgagcggcttttaagcctcctgtagtggggattcttacttgatgccaaagagctgactcaggactctagtattcagggagtctctgaacccacggcaattgtatgcacgttgggcgtgcatttttctaggtgggaggtccatagagtcattcatcacagaggggatatgatctaaaaagggacaggaagcagcacaccagaagagcccaaaaaagttatttatcaaaaccagggaacagccacctggctgcccggcattctcttcctggctgtggaaggtgactgtgtaggcacagacagtaatgcagatggcttggtcactgacatctggagacagactgagaaaagacttcataacgtatcactcatctcccattctgtttctgcttcttgttcctaggcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtggtatgtggatgaaaatctcgcaccatctatggaccttttgcaaaagcatactttctttgtgttataagttcttgtttctggcaatgtttttcatcctagtacgtaaggtgccaccaacagaaactttcttttcgttcccaaaatgaatctaaatataattggccagtaaagcagtctggcagagaaaatactcattgttccgttttccttctcaaggtacttagatttacttccagtcttacaggatctgcattgtcagaatattggcaactatagtcttcgggcccctggaagtctgtgctttcttggctgctttaaaggccttttgtctttgttgctttatggatccctcatagttgaattctggaaaatactcagccattatctttgaaatatttcagcctcctttccattctccctattcttgccattcaggacttcagttaaacatatgttagaccttctcattctattctccacatctctttgttgtatcagttttcttttttctttctttttttttttttttttgagacagtttcgctcttgttgctcaggctggggtgcaatgccacgatcttggctcactgcaatctctgctgcccaggttcaagtgattctcctgcctcagcctcccgagtagctgggattataggcacctgccaccacgcccggctgatttttgtattttgtaattttgtatttttagtagagactaggtttcaccatgttggccaggctgatcttgaactcctgacataaggtgatccgcccacctcccaaagtgctaggattacaggcgcgcccagccctgttgtattagttttctattgcttccatgacaacaaatcaccacaggcttggcagtttaaataccactgattatctcacaattctctaagtcagatgcctgagttcagccaggcccagctgggtcctctgctcagtctcatggggccagtgtctgaggtgctgggttcaccctggaggccttcaagcttatgcacagttggctcaattattccttgcagctgtaggactgggtcccccttccttctcatgctttccaagtggccccctccagcaatggtgggttgggcagtctcagcctctagtcttctgccatgtctctcctgcctccggccagagaacattccctgactgtgactatattgagcccactggacaaccccagatactctccctgttctacagtccagtcttagccacacctgcccaggccccgtggagtggaggcaatgcagtcacaggctccaggtcatgggcctctctcaggggcccttctgcctcccactcctccatttccggggctcccagagctgtgtccagatactgtattcatgtgtcttagttaacttgtttacttcagctctaatctgctgagcttttactctgaaaatattattagttcactttttaaagttcaattaggttcttcaaatcttcttggtaactgacagttttattgtcttaactgaactttttccatctcttatttctttatccaattcatgtattctatattctgtgtgttttccttctagtatctgaaggccttggaggtatttaaaactttgctgtttccttgtgtgttgggttatttgggagtctttatttaactggagttaatttagattgctttcccccaagatgtgcatttgtatctgcccatctctatggggtgctaccaactcagggccgctttagccgaattggaggtcctggcttcactggggagtcttcggtgtggtcccgcttgcttacgcccgggctgctcctcaccccaccgccgctgttggcatctgcccctgaggaggccctggcttcccccttaccacctgcataggtagaaccagcttttcaaagcgttttgtttgcgtgtatgttcttaattcgtgttctttattcctgtggtagcaggagggtctgtcagagtatcccgtcacagtatttccaaactggaagtctaaaacttgtgttagttgactggcctttctccactgaccacatcatcttcatctggagatccccagctttgagcagacagtaggttcttaattgccaatgtggaaggaataggcctatcaattgtgcgcatgaatgaatctacagcagcatgaagccaacagagggattctaaattcaaaatatattcatccttccaactgttgcattaaagagatggtatgtggctgggagtgctggctcatacctgtaatcccaacagtttgggaggctgaggcagaggaggattgcttgagctcaggagttcaagaccatcctggacagcataataagaccttgtctttacaaaattaaatttaaaaattagctgcgtgtggtggtacacgcctgtggtcccagctactcaggaggctgaggtgggaggatgtcttgaggctacagtgagccgtgatcatgccactgcactccagcctgggcgtcagagtgagaccctatcttacaaaaaaaaacccaaaaagaacagtatgtgtgtcaattccgtttgctattatttttctgagaaaatataagaatcctgacattttgaaacatgaagaataaatgttgaagtgttaatagtaaaacatcctcactttgatggttgtagcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatctatttgtgttcatttatttactctaaccctgtgctgcctggcttggcaaggaactctaacctgaactcacataccaggccagctgggatggaggtcacctctaaggctgaggtgggatgggaccgtgacaccatcccatataccgctcacctcagcacaggtttagctttatatttagggttccgcaggcaaatgaggtgtaaaacggccgtgttggctgctccaatctggatatgaagaggctactcagtgcctctctgttacctgtgcccatgacctggaggaagccagcaatgtgggaggagatcagtcaggcccagtgggtgctgcacaaagggaccgggagcaccgagtccagccttcagctgtccccgatccacagggctcacatggctggagctggttcacatgatctgtcagaatgaaaaacaatcggtctagactaccagtagagtcacgaacatgtttgagaaactaaagccatattttaaaaagtactaaggcaatgaggttctgaaaatcctaactaactgaatggaaaaagatgctatgcctgtttattgtagatgaatactacagataaacacaagtccagcatgattaactgaactcactttatattgtagcctggcagtcattttacattatttggagtattgcaaccttcaccaattttaaaattttctatggatgccaagttgccataaaaagcaggcctcgcctacttttccggaggcctttggaaactgtccagaagcatatgatgcacggcacagaaaagtagtaagtgtacgaaccatcctgttacactgccaaactcactcaagtgacatgaagcctaacaaacaattattctttctttataaaaagttccctaaaaatgcttttggtaatgtgaattaataaccctggggccagcattctgctgcagatttagaggtggtagctgtgcttatcttagaaactacagaataggatgaaaaattatggtaaaacttaatcaattaccaagttttataaggcttaattatataccaaatatgtaataccttaggtataagacaatctcaagtgctacaaaatgttaaataagaatttattatttattaacctatgcatgttcaaatgagtctctgtcctcaagggggagaaaactggttcttttatgtacaaagcacagatgtaggtacagtatataaacagatacgtagtacatctgtagtattaaaatggcatgggaggaggcagttagaaaaaacatctaaaacagctccttagaaggccaataataaagttggaaaaaagggagtttccacgcagccagtggtgagctgcatgggataccagcaccattggcaggggaggccctcggggagtgatggcttggcgctggcgcaccactgggtaacctccaggcaggagccacaggctggaacaggcgaacactttcttcccatcacctaggtggaaattaattctgccaatacttttttttaaaggccagtcaatggttatgagtggataggttcaaagctgaatggagttcattagaccttttttattattctaccttttctgcatatgtttgcagttttccatcgacttcttcataaacaaacattttctagaaaccaaaatatgtagtggcccaaaggagctcttaagcaaagtacttggtacaaagagaccatattctataaacatgttaagtttgttctaagcattcagacttttagaataagaacttcatttcaactttttattataacatgagctaaatttaagaaacaaccctagtcttctatttcccagagctgttcaaagtctaaatgacaatataactcattatgaaaatatactgaaaagtacaagagctgatgtaaaacggtaatcaaggttccaggcatcatgggattagggtaactgaagaataaacccagccaggctgcaacagcaggcaggatgtgctggcttgatgaggtgctaaggccatcgaatgctcagaggaagccggattcacggtgatcatctcaacctgagaaatcgttccttggggtgatttctgcccttttttttgttttgtaagaaagaggttccttcattcagtaacttagttttcccttaataaatatttcaaaaataaaaccaatcatcatcaaacaaacaggagccacttttgtaggtaaggtaaatcacaggataatgtattgggataactctgtttttttaaaataaaaaagccttacatggtcagggattgatggagtggggatgacaaatgcacatttcagactttcatcaccaatgaaaaaataaagcattttcatagacttaaaactgtcattagtgcattcggcttttggagaagggatgaaaatgtaaaatacttctacaacaataaaatgttaatagaaatcgtcatgtgctgaggtcattttagtgagctaccattgtttgtttaaatacaagaaaagtaatttcttggtccaaattagtgaaatctttaaaaagattgcctttaaagaacattatttgaggacaatgttttttcagacacattctgatgatattcaaattcacttcataacaatcacagattaacctttaattacacctttcttaaaaagctgtcagatttccatttcttcgggagacattttcaccagtgtgttgttcgattccacaggttaagctttcttcattattattaagaacttcatacatattagagagattgccattcattgctttctcgtcttttcgaaaagacacaggcagacttgctagactaaagctgacgtctttaaaggcatgcaacaagaatatccccacaatgattgtaaagaagccactcaaagtaccaatgacatcgtcaacaggcatatcttgccactccttaaaaagaatagctgaacaagttaaaactgatgttgtaaagaatacataatatattggagtcacaatggaagtgttgaatatatccagggccctatttaggtaattaatctgtgtgctcacacagacgatgaggctcagcagcagaatccaagccaggggatgccgcagcacaggcttccctgcaaacagctccttgatagcaatgcccaggcccttcacacaggagactgaaaacgcgccgattacagagcagattgttatgtacacaagaatgtttgtctgtccatggcgaggacccaccacgaagattaatatcaaggccacaatgaccacaagggttgcaaagaccacaaaacctggaggaggcaaagaaaagttacatgagtcaaatggttggttgttcttaaacacagaatgcaaaacaaaatataataaacttgatagggagaaaaggtatggcctggaaataaaaatcagctttattttgcagcccaagcagaaatgcaaccacaaaaatttacttagatggacacactggaagattaatgcgagcttcatattcacaaattgttatacccctaacatttttgcagcagcactttatgccgacttaagtgctctagctcaccaggcaagagggacagtgggaacagaacagacacagaaactagggaggagaaaccatgaggtggccttgaatgttcaacaatttatagatgctaaaaaaaacaaaaaacacaaaaacaagagttcttcatcaagttttccctaaaaggggaaacttttaaaatttgtggacaactgctggagtaacgagcaagtcaactggagaacttgaaagatactactggggttctggttgaatacggagaattaaatccagcatgataatagccaacaactgtgtagcactgtgggccaggcatttttctcagcaattcgcactcaactaccctgttatcacggatactaccacctgcattttcggatgaggaaactgaggcccagataagtcacatgaatttactcttccttcctcaaattccactaataaaatacacagtaataggattttttttttttgagacagagtcttgctctgtcgcccaggctggagtgcagtggtgcgatctcggctcactgcaagctccgcctcccgggttcacgccattctcctgcctcagcctcctgagtagctgggactacaggtgcccgccaacacgcccagctaattttttgtattcttagtagagacggggtttcacc[143 bp omitted]agccaggtgtggtggctcacgcctgtaatcccagcactgggaggccgaggatggcagatcacctgaggtcaggagttcgagaccagcctagccaacatggtgaaacctcatctcttctaaaaatacaaaaattagccaggcgtggtggcagacacctgtaatgccagctacttgggaggctgaaacaggagaatcgcttgaatctgggaggtggaggttgcaatgagctgagatcatgccactgcactccagcctgggcaatagagtgagactgtctcaagaaaaaagagaggaccgaagataacaatccttcgtaagtcagaaagcaaaggctaactaataactggtacagagatccaagaaagcggaatcctacacatccgctgtgataaaagatgaaaaagcaatttagtttgtggcacagaatgctcaaaagatacaaagtgcctctgaagtggagtaaaggcaagattgaaagtgaggcctggctgaaaagtccattcaagaaacaaggagactcctgcccagttctgggagactgtccctcccgtgccacagagttccaggaagctgaggtcaaccatgcctccaggcattaatccttccccccagtcaattcccaggatgcccacagccagccatgaaactggaagctttttttgctgg[222 bp omitted]gaggcaggagaatggcgtgaacccgggaggggagcttgcagtgagccaagatcacgccactgcactccagcctgggcaacagagcaagactctgtctcaaaaaaataaaaagaaagatagccaaagaccaccaggagagaagccaaaacaaacagaaaagtgcaaagcctctttctcccatgtagacagaggaaaacttcaaaataaacaactgtccctcaaaaaacaaaaaaattactaatatcctcagaaaagcaagaaaaactattattaatatcctcagagacacaatgaaacagactgacctggcaccccaaatacctacaaacgatggatctacaacaacaaaaaaccccaaacaaataaaaaagaaacatttatttgagggcatcaaagagccatcaaagtagccaggacttaaagggccaaaatccagagaaaagagaagaatcagcccaacactcacctctgccttctcccttggggcaactactaatgcaaggggtgagatggcataaaggccaatcaacaccggcctaagcttaaggggactaggtaaaaacaagttggaatttggggctgcctaagcagctggaactgaatggaacaagacccagaaaggagggaactatagagtagtgagcccaaatttctgtgtgcatttccccttacggtgtttcttggcacacaagctgcacagccaaggtcagaggagccaaatggaaagcccggccaggaggccacaggactaagcagggattttagtgtctcaagttactgaggagcagatcctggagctctcagtttctcaggtggaggggcccaaaccaacatctgaagctatcagttgagagccaaagggctatgaataagaataaaggcaaactgagccaggtgtggtggctcatgcctgtaatcccagccctttgggaggccgagggaggtggatcacttgagcccagtaggttgagaccagcccagccaacatgacaaaaccctgtctctaccaaaaaaagatacaaaaattaggccaggcacagtggcgcatgcctgtcatcgcaactacttgggaggctaaagcaggagaatcacttgaacccaggaggcagagggagcaatgagccgagactgcaccactgtgctccagcctgggtgacggcgagactccatctcaaaaaaaaaaaaacaaagaaaatacaaaaattagccagatgtggtggcacacacctgtagtcccagctacacaggaggctgaggtgggaggatcgcttgagcccgagaggcagaggatgcagtgagccatgatcacaccactgcactccagcctgggcaacagagtgagatactgtctccaaaaaaaaaaaaaaaaaaaagaataaaggcaaactgaaagaaactaggcccaacaaagcttaaaacaataccttcagggtgaaggtgagctactgtattcttttctgcctaccagaagaaatttacattctctctgaaggaagaaaaaacatcacttaaaacctctacaccttctaatatcctacatccagcattcaattaaaaaatgcctaaaagccaaaagagaaacaccaccacaggaggcccacaaagaattctaaaactaaagttagcagacaaagactttaaaataactaggaatcaaagaacagaggcaagaaactcttagaaattaacaatataaccgcagaaataaaaactcagaagggctggaagaaaaaacagaaaatctccccaaaggcagagcaaaaagacaaaatggtaaaatgagggaaagaaaagataagaaaattaatgatctaggtcaggaactgcaataaacagatgaataagaatctcacaaagagcaaacaagaatatcaaaggagtattcaattcagttc[132 bp omitted]gaaaccctgtctctactaaaaatacaaaaattagctgggcgtggtggtgggcgcctgtaatcccagctacttgggaggctgaggcaggagaataacttgaacccaagaggcggaggatgcagtgagccgagatcacgccattgcactccagcctgagcaagaagaacaaaactctgtctcaaaaaaaaaaaaaaagagagacccatcaggcgaggcatggtggctcacacctgtaatcccaacactttgggaggcaaggtgggtggatcacttgtgatcaggagttcgacaccaacctggccaacatggtaaaaccttgtttctaccaaacaaacaaaaaaaattagccaggcatggtggcacacgcctgcagtcccagctacttggaaggctgagatgggagaatcgcttgggctggggaggaggaggttgcagtgagctgagatcacatcactgcattccagcctgggcaacacggccctgtctcaaaataaaatgaaccatcaggcacccagcacaatggacaaaaatggacccatctctaggcatgtcagtgggaaatttcagacactgtggggaaagagaacatcctacatgcttccaaaaacaaaaaattggtcgcatataaaagataagggataaactgttcaatttctcaacagcaacatcagaaatgagaagacggtggtcacaataggttaaaaacattttgagataaacaaggtctcaaaaaatctcatctcttcatgccctttcttgtctcctctagagtgacaccaccaaaatgaaggcacaaacccaggattctggaaataagggatccaagaaaaagcaaactgaagggaatccccaggatgctgctgaagagaaatgcagataacagctgtgctggcagcctggagacacccgcctagattgaggccacacagaaggcactgagagaaatttccaaaagagatgaaacaaagaatacctctttgtttgaaattactgagagtagaattagtcaactggggaagagtttcatgatacattgatcgattcataaaaaactacacaaacaagataattattacttctggaaaaacaaattatacagggaaggaacaacaaccataataaagactaagatgacaataaaagttatgtatcaatgataatgtaaacaatctcaagaaaactatataggtacagtaaataaaaggtaaaacagataatgcctaaagctaaggaagtaagtagtagcaatatacgcacactacttacaaacacagagttaaagaacagtagaaacacaggcttgggattgataggagggagcagggaacatgacgacaatttgttcttctaccaggtggaacaatttctttccttatgtgctcatcaaatttcgattaaagtaaaaactaagttaaaaagtaaaatacagtaagactaataagacttttttcttacctggatcacctagcttgtgagacatttcatttaaagtctcaatctcctcttcctttggagcatgaatgaccataactgtagatcctagaatacttagcaaacacccaattttcccatgaagattaagtctttcattgagaaagtatgaagaaagaatggcactaaaatggggaggaaaaaaaattgagaactttaatcagctactttcctttttcaaatatcaataaaactcgtaatttaaatcactgaaatcaaactaaaacactgtgaacttatgaagattctggctttcgccaaggaaaaaaagtatacatttcatcataaaatgtaaacatttctagggaatcatctgcttcatcatacactacacctgtatacttaccatctttccactgcaagaagtcagtatgaaatttataataaagaacaaatttg[133 bp omitted]atggtgaaaccccatctctactaaaaatacaaaaatcagtcaggcatggtggcgggcatcctgtaatcccagctactcgggaggctggggcaggacctagaaggcagaggttgcagcgagctgacatcgcgccactgcactccagcctgggtgacacagtgaaactccatctccaaaggaaaaaaaaaaaaaaaagaatctctatccaaaccaccagtgcttaaaatttactcaacttattcctattggttgatgcatgcacccctcttatgttgttaattgtatataatttgcctattacattatcaggttttaataacttgtagctagttttatctagacctaaaaagaaaatacagcataaaccaataaatacagtaacaaaatactacaaagaaaattaagggtaaagggcaatgacttataccataaccctgttttacatatagttttttggggaaaaaaaaacagataaaaatcagtcaatctactttgggaatagtaaccaagatccagacatcaatatgggcttagttgtttgggctaatcattacaaagcagaaatgggacaaatctcagatcactcattcaaaacaagcactccaggccaggcatgcaaatctactcattggccgggcacagtggctcacgcctgtaatcccaacactttgggaggccaaggcgggtggatcacgaggtcaggacatcgagaccatcctggctaacatggtgaaaccacatctctactaaaaatacaaaacattagccaggtgtggtggcgggtgcctgtagtcccagctactcgggaggctgtggcaggagaatggtgtgaacccgggaggtggagcttgcagggagccgagatcgtgccactgcactccagcgtgggcgacagagcaagactccgcctcaaaaaaaaaaaaaaaaaaaagaaaaagaaatctactcattaccaaccagaccctaccaaagtgcacatgcactgaatgataaatactgggatgagtgtaactttgaattttacttattttttatttatttattttttgagacagagtctcgctctatagcccagggtggagtgcagtggtgctatctcgggtcattgcaacctcctcttcctgcgttcaagccattctcctgtctcagcctcctgagtagctgggactacaggtgcccgccaccacgcccagctaatttttgtatttttagtagagacagggttttaccatgttaggctggtctcaaacttctgacctcaggtgatccacccgtcttggcctcccaaaatgctgggattacaggcatgagccactgttcccagccaactttgaatattaaaaaactgaaatcgaagtagaactagtactggctctgaatacaagcaagacaaagcattttctcccacaaatcaatagcctgcctatgcacagaagtaactttttaaaagcaattactacgtagtgtaaaaagcgaagttctccaggttgttgaaatgtaaattgtgttgaacatatttaattagatggtactgaatattttagaaactaagataccgactactgtttctacatgaaaaacgtgtccttaccttactagcacgctgagagctcctagtggagtcactagagtggctggtgcaaacgcatacgcagcgaagttggccacctcaccagctcccacttagagacagacaacaaaagaaaaactcaggtaagaatgtatgtactcaacttggaaatgccggcattttatgcactatctatatattatttcaactgtatttagtaacctccatatttttccaatttattatttttatttttttgagacggagtctcactctgtcgcccaggctgcagtgcagtggtgtgatctcaactcactgcgagctccgcctcccgggttcacgccattctcctgcctcagcctcccaagtagctgggaccgcaggcactcgccactatgcccagctaatttttttgtatttttagtagagacgga[145 bp omitted]ctattacagtaagagtccaagtcaattagaaacattctagaaacaacacatatctgtaaatctaacggaagaaatctagctcatgctgacataaggcattttaataaaaattttaaatagatacttatatcccaggacagtaaataaaaatcactgagaagaagccgacatgaaggtaaaggtactcttcccccaagtccttttcatttggtccttttttttttttttttttttttgagatggagtcttgctctatcgcccaggctggaatgcagtggcacgatctcagctcactgcaacctccacctcccgggttcaagcaattctcctgcctcggcctcccgagtagctgggactacaggcgggcgccaccatgcccaggtaatttttatatttttagtagagacggggtttcaccatgttgaccaggctggtcttgaactcctgacctcaaatgatccacccacctcagcctcccaaagtgctgggattataggcgtgagccaccgtgcccagcttgctctttttaaaaatgcaaatcatgctatacaccaggtcctgttctag[142 bp omitted]ccaagttaaagcgattctcctgcctcagcctcccaagtagctgggattacaggcccacatacccgccaccacacccggctgatttttgtatttttagtagagacagggtttcaccatg[137 bp omitted]cacatgtgccaagaggttaaaagtgttatgaagaaaaacagtgagggaaaagaataaagtgctggtgatgaaagaaggtatcctactatgtgtcatggcattagatatgggctgtcagataagaaattttagaacactgggaaattaagtcccactaaggaattatctaaattgaaaagctactgaggaatcctacacagggcagaggcatgatctcacaaaaggatccctcttggctactgctttttccaaaagttatgccaattttcatttagcagcgtatgagagctccctttgctccacattctccctgctgatctttgttaggagtatgggatgattctgttatgccttcaatttgcatttcccattttcatttgtttattaaccctatgaaatcttttagggaagtagctgttaaagtttatcctgttttctctaattgatttaaggtaattctttatatatttcagatgtaaatcttttattggttaaacatattacaattatcttcatttacactctacaatttgcctttttcttctcttgttaaactctttcttctttaattcccaaaatgtcttttaaatatggttactgttaaaattcaatcaaggaatttggctgcaatgtctcaaatatctttttatccaggatactctctactatctaatttccatttatgtatgactgacttctcaaaaagaaaaaaaaaaagcttggagaaagctttttaactaattaggaaattatacacaatcttctattttttttaactgaatactctagaaattacgtgtatgcttaacctgtgaagtctaatattaatatttagctttatttccttctggataatgccagaaccttagaactcttcatccattttttcccttccaactgactattgttgtgtattttttaatacacaacaggtgagccaaggtagctcactcacaggactggcaagtaggtcctggcacagtgagagcctggggagctctccatggctgcctgagtgtcctcagagcacagcagctggcttctctcaaagtgagcaatccaaggaatcaggaaaaagctgcaatgcctctctctgcttcacctcggaagacacacatcatcacttctgtggtattcttggatcacaccgttttgaactgcactaattcactgtgaaaggggattagagaaaggtgtgaataccaggaggggagtcactgagggctatgtatcacacgttaattggcctggcatgctccccactcgtggccttcacagttacagtttcctcctgcttcaagggtttctcccccaaatatcatatgggcagatcactcgcttcctttacatcttctacccaaatacctttcagcgaggctggccctggctgcagatctaacatcctaataaacctatctatcctccatttcacaacactccttccgacttcactccttctccttcccatttatcatcacgcacaggcacataaacacataacttctttatcttgtttaatgtctcccacctagaatgtaagcttcatgtgggtggagatttttcagtcttttcctctcactgatgtatctccagcacctagaacaatgcctggcatacaagacatgatcaataagtatttgttgactgaacagtcagtcaaggctcagtgtcttcagaatatttttttttttttgagacagtttcactcttgttgcccaggctggagtgcaacggcacaatctcagctcactgtaacctctgcctttcaggtccaagcgattctcctgcctcagcctcccgagtagctgggattacaggcatgcaccaccatgcccagctaattcttttgtttttttttttactagagacgaggtttctccatgttggtcaggctggtctcactcctgacctcaggtgatccacccacctcgggctcccaaagtgctgggattacaggcatgagccaccacgcccggcccagaataatttttttccacgtgcctttttaaaagttattaccaaaataggcatggtgattttttgtatttttatttggtaagtcttatcaaatacatacctctttttaatttggaatgagaacaaatggaggggcaacaaattaaaacagaattctcctcttaactttcaaaattaccttaaattgagcagaaattttaaaaatgcacaggcctatcaaacatgttttaatcagatgggtaaaaaaaagccttgtcgttccatttaaatgcactatgagggtacgacaaatagaaagacttgaatacctggtgaataacatcaagtatttgatagcacaacagggtgactacagtcaataataattttttttgttttgttttttgagactgagtctcactctatcacccaggctggagtgcagtggtgcagttatcagctcactgcaacctccacctcccagtttcaagcgattctcgggcctcagcctcccgagtagctgtgattacaggcgcctgccaccacgcccggctaatttttgctatttttagtagagacggggtttcaccatgttggccaggctggtcttgaactcttgacctcaagtgatccacccgccttggcctcccaaagtgctgggattacaggtgtgagccaccgcgcccggcccaataataatttaattgtacatttaaaaataactaagaggccaggcacggtggctcacacctgtaatcccagcactttgggaggctgaggcagacagatcacaaggtcaggagatcgagaccatcctgggcaacatggtgaaaccccttccctactaaaaatacaaaaattagctgggcttggtggcgcacacctgtagtccagctactcaggaggatgaggcaggagaatcgcttgaacccaggaggcagaggttgcagtgagccaagatggtgccactacactccagcctggcaac[138 bp omitted]gtgaatccctgtctctactaaaaatacaaaaattagctgggcatagtggtgcgcaccagtagtctcagctactcaggaggatgaggcaggataatcgcttgaacccgggaggcgaaggctgcagtgagccgagatgggccactgcattacagcctggcgacagagcaagattccatctcaaaaacaaaaaaaaggactaactggattgtttgtcctgcaaaggataaattgttgaggggatggataacccatggataccataatgcaattattatgaattgcatgcctttattaaagtatctcatg[229 bp omitted]tgaggcaggagaatcgcttgaatccaggaggtggaggttgcactgagccaagatcacgccactgcactccagcctgggtgacagagtgagactctgtctcaaaaaaaaaaaaaaaaagattatttaaacctttaaaacttgctagtaatgaggctataataccatatgcaaatattttaatatatagctatcatatttttcttgcaatgttctttatacatacttgacagcagtccagcccaccacaaccattccttaagatatgcatggccaccttgacctgtgaatgaagaaatatttcacatctttggaagactgtaagactcttgtataaattataactattagtaatgacagatttttaaatatctcagttactcctttaaataaaggtttctgcatgactcgggatttctctgacaatttcttaatgattatcttgccaaggtgaatgaatcctttacaagcatacccgtcatgaacagtgagagcacctcttaggaccaagcatcagggactaggggaacaagcagtagatgctgacagtttctcctctgtccactgaaccccatagaggctatcatttcatgtttttctgactgctgaattaggtttagccacagagatggcacagggaagacagaagggtggtactgtttcctgccaaggcagctctcctcataaggtccaatcaggtctaaaaatgaagccaggatagaatgatggaatgtgaccataacgccacttaacaccgggagctaccacgagtgtccctgatagaggagtcagggcagggccaatcatcctgattaccccgcagggtcttgtgacttgtcagtgatttctagagaaacaacctacaccagccgaagttcactaaactggatactcttcaagctggggaagcccagtctttccttcctgccaaaatgtcgaagttcaaagtcagaacgtctactatcatggacaaaagatcccagcctttaataaattctgattttaaccatggcttttttttttttttagacggagtctcactctgtcacccaggctggagtgcagtggtgccattttggctcactgcagaggtttctgcctcccgggttcaagcgattctgctgcctcatcctcctgagtagctgggactataggccaggccaccatgcccggctaatttttgtattttcagtagagatggggtttcaccatgtttgccaggctggtctcgaactcctgacctcaggtgatccacccgcctcagcctcccaaagtgctgggattacaggcatgagccaccacgcccagcctaaccatggactcttatttccttccctgcagacatatcaaaatttaaagaaaaggttggatattacttgggcattggtccctgtttccattttgatgataactgcaggactgagtagttaactaattatgacatcttctcacttcttttctcaatataaataaccaaacatcaactttgtaaacatttagaactcttgaacaattcaaagtttcaaatacactcacgaggaatgaagatgtggtcttgtacaaagaacctgtgcatgtaggtagacactgaggtcacttcaaagtcacataaggcataacctacctgctctcatagagcctttcctggcaagtcgaaggaggcccttttttttcaaaatgaaacttcctccaatgaaaatgctggagctcatagccaatcccagaccaatatagaagtcatattttccacgcccctggctcatttcgtttgttacttaaggagttcctgtgaatcacattgatcacagaacagagaaaccgctggtactagaggcagaatgaagcagtcttcaaacctaaacaataaaaaatgaaatgtggttttcacagaatgctcatgacagctcacatgcaattcaaaattttactccatttctcttcccctaaagaaaaaatagctccttcattactaatattgataatatttattatttaaatttagcaccaacctgtatatttcttcaaattatggcaaaagataggatcatgctataaaaccaagtttaaactgatttcataaactctgatcccatattttaaaaaaaaatgtttctagccttaataaaactttctgataagaaaaaaaaattctgcagaaaaaattaggcataatatacaaatctagtttggaaatacatttatcaggttctcaaatgtgtccttttgaataatctatacaaagaaactcaaaattttctcacccatacattttcttcttagcaataggtgcacataagcatatgctaatttatttatttagcctattcagggatgtgctgagagaaggcagatttcacattatttatcagagggtaacaattcttgcagagaggtgtctgctggggcgtgcagtatggtaccggtggcctttggagaacatgaggaccatggtatctggagggctcaatcctcgaggccagacaggaagcagaggcttaccaagactgcaattgtttttccaaatggccaactcataaactcagttgacagatgaactaaagcacagtgtggatagcagagaaaaaatagtttttagcaacaaggtttatgattggttctaactgccagatcagctttctagcacatcttgggatttttagtcccacaatttaacttcggagttccaaaactaatctgcaattcagtcaggaccctaactagccatgtttttccgttcttcaagttatgagacactggcttttaaccaaagcaacttaaactccctgtccacctagcccctcaattactttatccatccattcaaacagtatttactggatattatgtgctaagcgtttattatgctaagctctctagcttcacaaggaagacagacaagagatagttaaataaggagtgataacattactgcagggagactgcaataatggtaaacacgacattatcacactgagttgatattactcccaagaaatgaaaaagtccaatgtttttgatttgcccattaaggtgcattatcgttcctgtatgattcaatgagaagactattctccctcacccctgatttgccgcttggccatcaagcttgctttggccaatgggagggaggtgtaaggaacagagtgccagttctgagtctacacctagaggcctctcttacttctgcttgccccttcgcaccctgccatagccacaggaagtgcatgtcctgatcacaacagagtgaagggtacagaacaaaatcgtcccagtgactcacagaactgtgagcatgatctaagtgctcattcctctatgccactgagatagctaactcacacacacaaacaggcttactgcaagtatgaagtttccaccctgatttttgaaaaaccaaaaattttctgtagaaaatggggattcagtgatgggtaaaagctgggtgatgggtacacagggactcattgtattactatatctgcttttgtgtatttctgaacatttccatattaacgtttttaaaatacaacctttagtgctcaaaaggtacaaggatgccaaggtagaaaccaccagcaagtcccaaaagccaggtcaccccacaacctaagacaaaataatactgaaacactgggtcgggcgcggtggctcacacatgtaatcccagcactttgggaggctgaggctggtggatcacaaggtcaggagatcgagtcatcctggctaacacggtgaaaccccatctctactaaaaatacaaaaacaaaattagccggaagtggtggcaggcgcctgtagttccagctacttgggaggc[145 bp omitted]aaaaaggtgctgagttcttctaagtatcagtcataatctcatggatgagactgtctacccgaaagccttccagaactgacctctcccttaacagatttggaaaagtacccctagtccctctgtgccattcataaggcaagattccatgagaaaagtcttaggtggggagtttggagaccccgtcttgcttccagctggaggtgtgatcttggatgagtcaccacattaacagatatatacataaaaagaaagaagctgaacaatctaaggtattacccactttatgtgccaaatactggtcatctcaagcctcaagttaacttcagcatatctatggaataattctagataggtgagtctcattgacagtaaaaataaattacagagatgtaaacacatttaaagacaaggtaggagaacttgaaacaagatgtcagggacaatcatcatttctacacgctgtaagattgcaacaaaaagcaggtgtgcttacactgttcccactgcatcctgcatggcttgttgatctgtgtttatcagccagtctcctgcatcagactgtaagctcctgggctcctgcatgatattcgcccttttagcctatgcacatagctatctggtagtctcaaaat[131 bp omitted]cactgcaacctctactgcccaggttcaagtgattctcctgcctcagcctctgagtagctgggactacaggcacatgctgccatgcccagctagtttttgtatttttagtagagatggagtttcactatgttggccaggctggtctggaactcctgacctcgagtgatccgcccatctcagccttcaaaaagtgctaggattacagccatgagccaccaccccagccaaatggaataattcataattagcccttaaaaacagccagatacagtggtacacaccaggaggctgaggcagaaggattgcttgaaaccaggagttcaagtttagcctgggcaacatagttatgcctggtctcaaacaaacaaacaaagcagccattaatacacagaaaactactgcatcatttagattggcatcctaaaatgtaaccgatgttttatagcttttaaacttgagaaccataatcatttatccaatatgctagcaagtggcagtactagatggaagtgaaaatgcaaggaaaatggttatacggactacgaaaatgggagtgagaaaccgagctacccaaacgcttcagccctcctggcaggtatatccttctcatgagtcagggtcacctcacttca[142 bp omitted]agaaaccccgtctctactaaaaatacaaaaattagctgggcgtggtggcacatgcctgtaatcccagctacctgggaggctgaggcaggagaattgcctcaaccagggaggcagaggttgtggtgagttgagatagtgccattgcattccagcctgggcaacaagatagaaactctgtctcaaaaaaataaaaataagataaaataaaaaagatcatctgacataaaaatcatcggccgggcacggtggctcatgcctgtaatcccaacactttgggaggccgaggtgggcagatcacgaggtcaggatttcgagaccatccttgccaacatggtgaaaccccatctctactaaaaatacaaaaattagctggcgcagtggcgggttcctgtaatcatagctacttgggaggctgaggcaggagaactgcttgaagccagaaggcggaggtttcagtaagccgagatcaccccactgcattccaccctaggtgacagagcaagactccgtctcggaaaaaaaaaaaaagaatcatcatcctcctttaatctttgtcttcatgaagcaatgttcttaattatcatgcaagttctactgctgtggaagtgactacttgacagctgtattgctcactatatactttaagttctatggtaatggaacaaatcaaatttatagtctgaatattctgtaagcaataaaattgaaccttcttaccaataaagatgatatccagaaaaaagtcaggtttatctacagttctaatcccagtataacaatagactcacaaggccgggcgcggtggctcaggcctgtaatcccagcactttgggaggaagaagcgggcagatcacctgaggtcgggagttcgagaccagcctgaccaacatggagaaaccctgtctctactaaaaatacaaaaaaattagcagggcatggtggcacatacctgtaatcttagctactcgggaggctgaggcaggagaatcgcttgaacccgggaggcagaggttgtggtgagccaagattacaccattgcactccagcctgggcaacaagagcgaaactcggtctcaaacaaacaaaaaaaaaacaacaacaaaaacaaaaaacaacagactcacaaatccaaatttaaataataataataataattattattattattattattattttggagacagggtctcattctgtcacccaggctggagtgcagtggcacaatcatggttcactgcaacctcgacttcccaggctcaagtgatcctcccacctcagcctctcaagtagctgggaccataagtgtgcaacactacaccacctggctaattttggtattttttgtcgatacagagtttcaccatgttgtccaggctggtcccaaactcctgagctcaagcgatctgcctgcctcggcctcccaaagtggtagattacaagtgtcacccactgcatcctgcccagattttacttgtatcatgaacctttcaaataactgatttgtaactacttaatttactaatatttactaacacttaatgttaactttcactaaatgcaagttacatacatgtggtgtaaggtctaacattaagagccagtattacatgttgccttgacatctggtaaaaaccaggagcttttaatggcctcagggcaagcttccctccccaagatgccaaacaattctcatcacagtgaccaggcacaggtacagttgctgcttatgcctgaggagtaggccccactgccctgccagcccaaggaattctgaaagcaattattagtctttctgcaggaaccacagccactctcgttaccacaaagccttgcctcccgcagcccctggttctccgttctatcctaagcgaaagactaagaaacttccgtccatctcgtctgtccagtgtcagtactgtgggatggaaatccctctctcactgacaaggtgaagaggtgattaaaacaatacatataatggaattttactcatttaatcctaaggccaatgaacattattcctaaccttactaaggctatcatatgagattttctccatatttattttacataaagtttcatgatgctatttaaaatctattttcccctttcccttttattttaatttatgtgttatgggaaatttcaaacacaaaaagcagagagaaggccttttctgaccagctgggtccatcatgtgcatatggctttcgagagtccccctggccaggcacccctctcctgcccacttcatttcctaacacagaaacctgacaccctcagacaggccctcccctcctcctcctcctgcaacccaaagcctgctctccactcaaggccagggtacaccttaagctgtgctacaaagacttctgcaattaactccagcccacaggcattttctcttctttactatttaattctcaactactgttctatcttcaaggtaaactctttaagttccttaaaaacaattacttaggttttctgtggtggtttccccacaaaaggcactcatttacggtagcaaatttgatttacaaatctttctagaatgaggcatatcaccaaataaggtgatctggttgtttcttcatgcatggaactgtaccagggtgtatgtgtggagggctgggggatgacaagcagcatacaatttgcaagccttcaaattataaagcagccttctgccaccaagaaaataagtgatctcattctgacttacagtttgaaaataggacatcagagggaatgtcctgaaaggaatgagttgcttcactattctcagacctggtcccactctgctccctctctctgtaactgaaggtctatcacagccgggagagcctgcaacagagatattttttcttcttaagaattagccatgaggcagggccagtattaaagacagataaacagtaaaattttctaaatttcacttcaactaggttcccaagctccatgtggttcacctgcccagtttacttagggggactcgggagtaatccgaactgtgaccattgctcaacaaacactgagcagctattatctgccaggcactgaagttgtaaagatgatcaaagggcctatcctcaaggactccacgactaagagaattaaaaattccaaaaataacctactgacgttttaaacacttttaaagagtcttatgattttctgcttattctgtgtgtgggaggggaagggcttttttgttgttgttgttgttgttgtggtttttgacagtgtctcactctgtttcccaggctggagtgcagtggcgcgatcatcgctcactgctgtctcaaatgcctgggttgcagtgatctctgacctcagctgctcaaatcaacaggaccacaggcgtataccacgacacctagctaatttttttgttctgcttgttctctctacattttaacaaactctttttttttttgagtcacagtcttgcactgtcgcccgggctggagtgcgatggcgccatctcggctcactgcaacctccgtctcccgggttcaagcaagtctcctgcctcagcctcccgcatagctgggattacagacgtgtactgccacacccggctaattttttgtagtagagacggggtttcactatgttggccaggctggtctcgaactcctgactttgtgatccgcccaccttggcctcccaaagtgctgggattacaggagtgaaccaccactcccggccaacaagttcaattttcacaattgattttactaatatttgtaatgtgaactttcattaaacataaagcatgtcaaaaatggaataaatacatctcaaataaaagaaaattatgaaattagtccactttcttaaaaaatgtggaaaacacatgatttaagaaacaggcaaaaatggactagtattctaataaggaaaacctaaactaggacctgctttgcaaaatgattatcagtaggcaacacaatcaccaaagttagcaaactttaaaaattacaccaactgggccgagcacggcggctcacatctgtaaccccagcaccttgggaggccgaggtgggagatcacctgaggccaggagttcgagaccagcctggccaacatggtgaaaccccatctctacaaaacatacctggccaacctggtgaaaccccatctctacaaaaacataaaaattatttttttgtatttgccatgagggcgggtgcctgtaatcccagctactggtgaggctaaggaaggagaatctattgaacctgggaggtggaggttgcagtgagccaagattgcaccactgcactccagcctgggccacagggcgagactccgtctcaaaaaaaaaaaggaaaaaattgaaaaaattacaccaaatgaagtgcatagacagccttaaacttttcacagcacttttgacatttcaacaaagccttaattaaaaagatatgtggtaagggcccacaatgaggaaccaggtccagagatttttttttttttttt[135 bp omitted]ca[195 bp omitted]agaactataatccaggcctcctcatctctgccaatctcagccttctgctgaagaatttggaatcacgacccctgtttgtagcaagaagaccaaattgtgtaaactagtaacaaagaccctgcatcatttgttccaaacctaccttttagatctctcttttttttttttttgagacagagtctcactctgttgcccaggctggagtgcagtgacgcaatctctgctcactgcaagctccgcctcctgggttcatgccattctcctgcctctgcctcccgagtagctgggactacaggcgcccaccactacactaggcaaattttttgcattttttaatttttttggatgcagagtctcgctctatcccccaggctggagtgcgctggcgcaatcttggctcactgcaacctctgcctcccaggttcaagtgattctcctgcctcagcctcctgagtatctgggattacaggtgcctgcaaccacgcccagctaatttttgtatttttagtagagatggggtttc[138 bp omitted]ttcaccatgttagccaggatggtctcgatctcctgaccttgtgatccacccacctcagcctcccaaagtgctgggattacaggcgtaagccaccgcgcccagcctagatcttatttccccataccatatttcacacatcctgtgttctaccccggtcagcactctgctgctattctaacctgctcctacctttcctcctccatatttggttgacactaactacccctctgttacggttactttggtacttaactagtattgccttcactgtggctcccagtgaacatgtggcttgcttatatcatttactcaaccaaccaacgtttactgagcatgtacaatattctaggagcaggggtacaacagcccacatggggttatctcctgctagaggtagggcgaaataataaacgaaataaagacattattctggaaaagtggcaaatgttatggtaaaaaataaaacatgtgaagggcactggggagttgagttgggggattctaatgaccatagttaggaggccttgctgagcagtaacacttgagtagaagcttcaaagagctttttgaaaagaacaaaggagagagaagcaagtgcaggggctctgaggtatgagcgggtgtgcagtttcctaaacaaaggccactgtggctgaccttgagtgagggcaggtgagatacattagcgtgaaaaagcgagtgtccggccgggcgcggtggctcacgcctataatcccagcactttgggaggtcgaggcgggtggatcatgaggtcaggagttcgagaccagcctgaccaacatggtgaaaccccgactctactaaaaatacaaaaatcagccaggcatggtggcgggcgcctgtaatcccagctactcgggaggctgaggcaggagaatcgctagaaactggagggcggaggttgcagtgagccgagatcgcacagctgcactctagcctgggcaacaagagcaaaactgcatctcagaagaaaaaaaaaggtgagtgtcagatcacgtggggccctatgggccatacacaaacccaaaaggcaaggaacagatctgcaacccatttatttggccagatcataatttattttcatctggagccattacagaactatttaagtagttctgtttcaacttcatttacataaaacaaatagatatgcagaaatgtttaaggatgctctaatctagtctgaggggtgtatttaattctacaacacagataaatctttgcaaattgtgtatatttgagatttatgttatgggaaacatacagatactaacacagttaccacagtagagcaaatcaacatatctatcatctcatgtagttacttttttatgacaaaagcagctaaaatctactcattgaaggaaaatctctaatacaatttcattagctgtagttctcaagttgtacatcctgaatatctgctactttgtatcctgtgacctaaatctcccatttcctctcccacccccaccccaccttttattctctgcagaagtcttatctttctgttcaatatcacaatgtatagcaatcaaataaatcagtttaaatgaagcttacaccatctataaaaaaatgtaatattcaaagtcatgtgttttaaatatgagtaaaccatatttacctattaaaaacattctgaaaatatgtgaaattctttttattatctctccctaacaatagctaccacttactgaacacctccccaggcactattccatgcatcatttctactcatttctcttctacgcaataagatgaaggtatcactttacagctaaggaaacctcccaggggtaaaaaagagtcacatgcagaggaccacacagaaagggactttacttct[135 bp omitted]gccaacaaggtgaaacccccgtctctactaaaaatacaaaaattagctgggcgtggtcgccggcgcctgtaaccccagctactccggaggctgaggcaggagaaccgcttgaacccaggaggcggaggttgcagtgagcagagatcgtgccactgcactccagcccgagtgacagagcaagattccatctcaaaaaaaaaaaaacaaaaaaaaaaactatatatagagctcttagttttctacgaaatctttactacctggtttccactgctatctaagttagcttaggcccggctcggtggctcacacctgtaatccccgcactttggaggccaaggtggttggatcgcttaagtccagaattaggagaccagccggtgtaacatggtgaaaccccggttctaaaaaaaatacaaaaattagccaggcatggtgccgcacgtctgtggtcccagctgctggggaggctgaggtgggaggagcacttgagcccgggaggcggaagttgcagtgagcccagattgcaccgtctagcctggggacagagcaagaccttggctcagaaaaattaaatacatgttagatttaattttttccaacctctcacttggctaataatttttcaaagcagtactgtacttataaatattacagaacctaaatctccaaccctaactatgcaacaatattagttataaattacaattttaacttacatgtaagtttaatatggtctctcttatgaaaaaaaggctgggagaggttagagatgacttattcactctcatttcctcgtaaataccaccctttattctcatttaaagtcttaaaccctggccgagtagctccagcctagaaagaagaaaacacagaagtaggcaaaagacttaaagttactaagtacgttttataatttggttactagccttcatactcattttgccaaccaatcaacataaaacctactcaatcgagcacaactactgcttcgacaggcagcttactggaatggaaactctcgactctgatatttcctcttactaaaaaaagtattaaccgggcacatggctatacacaggatttctagaaacagaacttaacatgcagtcctgtattaaatgaactaacaacctagaaaagaaattaaggaggcacaaacaccaaactaaacacacagttttgagcaattgtatagagagggaaataggattccgtgattttataaaaggaaattaaaacagtcaggctcaaaacgtcacagcagacttctaaggcttgtttaactgtcagttatgatccccgcagcagctgaagccaccttctaaaactcaccaagacaaatgaaattattttaatgaacttaatgaacatgcgtccccgacatggccaacgagccaggcttccgtgggactgaacggcaatccgattcacggtgggtttcctcactgaggattacaggaaaaccgcttcagaacacccggaaaggaaagttgcccgaagaacccttctccgacacaaggcgggctggctcgccaccaagtcagccccttcgcgcttgcctgaaaggaaggagtggcgacctcaccctagtcggccggccggccgcgcggcttcccctcgccggcgcagccttgggcaccgcggctcacacccccacacaggccgcccagtcctgcgctcgcacggccaccgccttcgtcgccgtccagtgggagatgcgagcattcggggctgaagccgttcgcaccgcctcctccatggagaagcgccgaggaaaacctgccaaggacaacctccggcaccgccgtcaccaccgctgccgggacctagggccggcgccggaaaacctaggcgcggctaaatgacgcaagaggcctcgcgcgcacgcgcagtgccgcaccacgtacaccccgcccccggggctctctcccgccgggttccggttcctttacaaggccccagtcggctgagcgcggagggcggggcgcgtagagtgtggggacgggggcggggcgcaggatccaggcgggacctggcgagggacgaagctggaagcgtagttaagcagtacagtatgctgccaggtggcgttggccgatcagttcaaaat[134 bp omitted]cacggtgaaaccccgcccctactaaaaatacaaaaaattagccgggcgtggtggcgggtgcttgtagtcccagctactcgggacactgaggc[138 bp omitted]tcacacctgtaatcacagcactttgggaggccgaggcgggcagatcacgaggtcaggagttcgagaccaacgtgaccaacatggggaaaccgcatctctactaaaaatacaaaaattagctggacgtgttggtgcgcgccagtaatctcagctactccagaggctgaggcaggggaatcgcttgaactcgggaggcggaggttgcagtgagccgagatcagccactgcactccacctgggcgacagagcgagactccttctcaaaaataaataaataaataaaataaaatgagggttcccaggggcagtcacagtgtgaagctgcatttaattggtgtccccgggcgatgccaaaggggaacagagctcccaagagggcaagaagcgggggaaagggtgggtccaaagctgggggcgggacggggcggggccgaaatagctgtggtagttcgacgaccgctgggcccttccttactgacccggtcgcggaatagatgtgaggttgacgtttggtgaaagcccgcctcgagacactgagagcagattgattgaatgattgattttgagacagagtctcgctctgtcgccagactggagtgcagtggcacgatctcggctcactgcaaactccgcctccccggttcaagcgattctcctgcctcagcctcccgaatagctgggactgtaggcgcgcgccgccacgcccggctaatttttttttttttttaagacggagtctttcttgtcacccaggctggagcgcagtgacacgatctcggctcactgcaacctctgcctcctgggttcaatgaagccattctcctgcctcagcctccccagtagctgggattacaggtgcacaccaccacgcccagctaatttttgtatttttagtagagatggg[135 bp omitted]ttcaccatgttggccaggatggtctcgatctcttgacctcgtgattcacccgcctcagcctcccaaagcgcagatttatttttcatgagatgtataggaaactaactgttaggctatcctgccttggctcctcctggaaaggagaaattccttgggatccaccaacgtggtttctgcaaaagtagtcaaagacagagctcatttgtaagaagcaaagagtagccagctagagttagatctcctagtaaatcaatgattccttggttgcaggtgtagagtcccttaggaatgttgttccaggttgtgactagacacaaaaacactattatatgaaattcaaatcatgtggggggaggatctttataaaatgaattatgcactttttgaaacaaaacaccaaatatcatttgtccttttcaggctctaatcctattggactgttgtgttctagactgtatacacagcccctgaccactctggttttggtttaggtcactatgcagcttctaattttaaagcttttaatctgccgtgagcctagcaatcatcttaaaactggctcagaggacctattacttgcatctcagaactggctcagaggatctattactttctttggtctcagccatgttttggctagttgacactctcagataaggaattccattgaatattgaaagacggttgacaagttggtctcaggtgatgtggtagattgatgaaaaatggctccaatttcccacacattttgcagtgactttgcagctcccctctatttcctgaatctgtactggccttgggctttggccaagaacatgtggcagttccagactaaattatgatgcctggactagcctgctggaggaggggaccacatggggcaaggcaagcagcaaatccacctaggtaaatgctggctgactaccattgagaccagccactgaccaaaactgccccattaacccataaacacatgaggaaggataaattactattgtctgagccacttattttggggtagattggtatgtagcaataactaactgatacagatgccaacaaatacctctaggacagaggtccccaagagtgcgaaccttattgtgaattgtgcatgcgagggatctaggttgcacgctccttatgagaatctaaataatgcctgatgatctgaggtgggacactttcatcccgaaaacatcctccccgcgccccccttccccagcgtctgtggaaaaattgtcttctatgaaatcagtccttggtaccaaaagggttggggactgctgctctaggaggcagatgagtaataaagtagtggtttgttcacatgaacaggaatgcttaggtgtcgatatgttaatttaacctaacgaacaaatttgcttgtcactcctttctgccagctggagctccacctcatctaatcagctttctgtcattatttggacctcccaccggacacctcccccgacactgcacagtgcattgtctttataagtctatatataccttgctaatatgctgcaggcttcttacatgcccacatcacttctccagcccgtgatgttgtacatcttgtatactctgagtgttcaagcagttgtcatgagatatttttaaggttttaaaactctaactccttctcatacactactggtggaattgtaaaatgggacaatttccttggaaaattggttgacagtttcttaaaaagttaaacatacaccgaccaaatgacctggcagttctactcctgagtatttactcaacagaaatgtatccataaaaatacttgcaggccgggtgcggtggctcacacctgtaatcccagccctttgggaggccgagatgggcggatcacgaggttaggagattgagaccatcccggctaacacggtgaaaccccgtctctactaaaattacaaaaattagctgggtgtggtggtggcggcacctatagtaacagctactcgggaggctgagacaggagaacagcgggaacccgggaggcggagcttgcagtgagctgagatcgcaccattgcactccagcctggggaacaagagcaaaactcctaaaaaaaaagcctcaaaaaaaaaaaaaaaggcagggggatgaactattgatacatgccttaacatagctgagtctcaaaataattagtaagtgaaacaagcagaccaaaaaaacagtgtgtactcaacgatcacatttatataaaagcctaggaaatggaagcccatgtatagttacagaaagcagatgagtgggcccctaggagtagaggaggcaaggagggtgaagggattacagtgggtcaaaaagaaactttggtgtgatggggatgttcggtgttttgtttatggcaatgttttcatcataagacacttgtcaaaacttaccaaatcacacattttatatatgtgcagtttattatatgtcaattataccccaataaagctgttgaaatcttgtcattgttacagaggcacagaagcaagaagtctggcctgtgcttctgtaacaatgacaagacttcaacagctttaaaacagtatttttaaaaatcatgtattaggaaatcaaatagttttcttatgtataaattgttccccaattactcttgtatgttttggttttgttacaacagaagcatcaaaacagcaaagcagatgatcattttttctttacctcaacccctatcactagttaaaattgccctttgtccttccaaaatgaatagtggcattccctgttgcgggaagtcagggacccccaaagggagggaccgactgaagccatggcagaagaacgtggattgtgaagatttcatggacatttattagttccccaaattaatacttttataatttcttatgcttgtctttactgcaatctctaaacataaattgtgaagatttcatggacacttatcacttccccaatcaatattcttgtgatttcctatgcctgtctttactttaatctcttaatcctgtcatctcgtaagccgaggaggacgtatgtcgcctcaggaccatgtgataattgagttaactgcacaaattgtagagcatgtgtgtttgaacaatatgaaatctgggcaccttgaaaaaagaacaggataacagcaattgttcagggaataagagagctaaccttaaactctgaccaccagtgagcccggcagaacagagccatatttctcttctttcaaaagcaaatgggagaaatatcgctgaattctttttctcagcaaggaacatccctgggaaagagaatacatgcctgggggtgggtctctaaactggcccccctgggcatggccgtcttttatggtctgtagactgcaggggtgaaacagaccccagtctcccatagtgctcccaggcttattaggaagaagaaattcctgcctaataaattttggtcagaccggttgctctcaaaaccctgtctcctgatgttatcaatgacaatggtgcccgaaacttcattagcaattttaattttgccccgtcctgtggtcctgtgatctcaccctgcctccatttgccttgtgatattctattaccttgtaaagtacttgatgtctgtgacccacacctattcgcacactccctccccttttgaaagtccctaataaaaacttgctggttttgtggcttggggggcatcacaaaacctactaacatgtgatgtctcccccggacgcccagctttaaaatttctcccttttgtactctgtccctttatttctcaaaccggctgatgcttagggaaaatagaaaagaacctacgtgactatcggggcaggttccccaataattccctgccattttaaagcatttctattatatgaatacttttcaattaatattatttggtttattcaaggccatcaatgacctacaaatgtagtagggcattttccaaaacatttgttgggggtgagcagggagaaactttctgaaaaatataggaataactcaaggtgaattgaggtagaacagtgggatagtgattaaaagccaggagttggcttttgtgaactgcctcacttggtaaaatggtaagtggatgtggtaagcagaaagcccaaagatatccacgtcctcaccttgtaacctgtgactgtgccaccttccatggcaaaaggggctctgcagaggcaactaaggatcttgagagagggagctgaccctggattgtccatgtgggcccaaagcagtcatgaaggtccttccaagagggtgacaggagtgtcagagtcagagagtaagctatgatgatggatgagtggcgagagagatgacattgctggcttcaaagatggaggaaggagccacgaggcaagatacaaaggcggcctctagaaaccaaaagagcagggatgagactcttcccaggagcctccagagggaagtaatcctgtctgcaccttgattttagcccagcaaagcttgtgtggaacttctaacctccagaattgtaagatgatacgcgtgtgttgttttaagctacaaggtatgtaacttgtgaagagccgtaataaaaaactaacacaataagtatgccaaattaagggaaggagaagatgctgggatccccccaatgtctttgtcaaaaataaaacagattcagtgttatagatgagcaacctggtctgaccttctctccaccctctggtccatcatctcagtgattttcacactcattatgtttacttggtcaccaccaccgctgtcctgcttgccaccatccagttccacacctctttctcatgtgctcggctggaatgaatcctgtcctctttggactggtaatagagaggtacctagatctttttttttttagacggagtttcgctcttgctgcccaggctggagtgcagtggcgtgatctcagctcaccgcaacctctgcctcccgggttcaagcaattctcctgcctcagcctcccgaatagctgggattacaggcgtgcaccaccacgctcagctaattatgtatttttagtagagacgggggtttctccatgttggtcaggctggtctcaaacccctgacctcaggtaatccaccggccttggcctccgaaagtgctgggattacaggcgtgagccactgtgcctggctgcagaggtacctagatcttttatatctgtttcttgtctgtgtctcacctctccaactaaaaacctttttaaaactatcatgtgagattcaaactaatggtgaacaagtaagtgtgactaatactacaacaaacatgctgacaatgtcaaaacgaagggtcatcagatggatgggatggatgtaactaagcaacacagaaattctagaacaagtcccttgcagggaaggcttggctagcagccagcacaaactactctatagtagtaaccaaccaatgcaagcttttgttcaatgacagcagaatttggcattaatacacttcacagccccaaaaacctatctggagttatccatagatgcatttggtgatttcataaaatgtttgttcttgttttctgtataagtatactttgatcaaaatgtgaataattaaatcttttgggatagagactaagaaaaaaatcttactcattttttctcatttgataaaataacttataggacaccagtctgagcaacataactagaccctgtctctacaaaaaaattaaaaaattacccaggtgtggaggcacaggcctgtagtcctagctaccggggaggctgacgcaggagggtcgcttgagcccagcagtttgaggctgcagtgagctatgactgtaagagagtgagaccctgtctctcaaaaaaaaaaaaaaaaaccaaaacaaagaaaattataggacactaaagaagatcagcaacaagatttctaatgatgcttgaagtatgaaaatgcgttataattgtctcattttctatgggctaaaaatgtaaaatgatatgttatacaactcaaaaacatgtcaaaggtactaacatattaaaatagagctggttttatttaatactatcacttcattggatcaagagacagtcgcaggacagggaatttctgcatacatcatggatttgctccctaaggtagatgcacaggtagacggtttctttttctttttctttttttttccaagacggagtttcgctcttgtcgtccaggctagagtgcagtggcacgatctcggctccctgcaacctccacctcccgggtttaagtgattctcctgcctc[134 bp omitted]gcctcctgaagtgctgggattataggcgtgagccaccgcacctggccttttttgttttgttttgttttgtttttgagacggagttttgctcttgttgcccaggctggagtgcaatggtgtgatctcggctcactgcaacctctgcctctcaggttcaagtgattctcctgcctcggcctcctgagtagctgggattacaggcatgcaccaccacctctggctaattttgtatttttagcagagacagggtttctccatgttggtcaggctactctcaaactcccgacctcaggtgatccgcccgcctcagcctcccaaagcactgggattacaggtgtgagccaccacacctggcccacaggtagacattttctacattgttatagagatctagaggctagtcatttctgtcttttttttttttgagatggagtctcgctctgttgtccaggctggagtgcagtgctgtgatctcggtcactgcaacctctgcctcccaagttcaagtgattctcctgcttcagcctgctgagtacctgggactacagatgtgcaccaccatgcctgtctaatttttgttattttttagtagagatggggttttaccatgttgaccaggctggtctcaaactcctggcctcaagtgtcccacccgcctcagccccctaaagtgctgcgattacaggcatgagccactgcacccagcctaggctactcatttctaaaaagagaataggaaaaatgggaggaactgggatgatctggaacctgagactacataagcatttcaagtaaagggaaaaaaaaaaatcaacaaatgttcagctagaaataagttattttattttaaaacacatacagattaataaatattactggaaaacttaatagcctttttatttacatgaggcaataacaacatgctatgactacatctataaagcaaaatataagcaggtcttggccactgacacatgtgtctatgtatgctaattggaagctccccaatacatgtctatgacaaaacttttacacaaccaatcaacatttgacattttttacatcttcttcctctcatgattatattccattttcaagaaaataatagttatcctttgaaaaggcaaaacgctcaagccactgaaaaacagtatctaaatttctgtaaagtgcaaaaatactaaggtggggggcaattattatattctgacaaataaatattctgaacttttcaacatgaccctttggcactagtggtttgggagccctgacattcgcctggtgtcagttcagcatcagggttgagctgcttggaagcaggaagttcagcgtcatttattacaaatccagtgcaacagaatccacgtgtttcacaggccattaaatctttttcagaatacagacctcggccgaatgtcaggagcacatcacaccatcggaaggtgatctttctgtgcggctttctgaagtccctgtttaatttccatattttacaatagaacatataaaaccctttcttttaaaacaaaaaaaggaaaactaaagcttcatggaatcatgcaaactttacacccagcacttcctttgctttctcagcgcatgaggctgtgtgtcctacagcatggtcctgagcagactccatggtccgtgcaagcggagtttccactgtgccactcccaggcacttctgaacacggtgctctcatctcaggccaccagaacactgctgaaagtgccggtgttttagaaacaatttgaagaaccatcccacccctttagaggtagaaaaactgaggcacagaaaggttaagagactcacctatgtttgcacaatttagggaaaaatagagaaaagaagaaaaacatcctcctccctggctcatgctctgggccctggattctgctttttaaatgcttttgggtacatgtgaaatagatgtttatttacatgatccttgttctactgaatatcaactttttactagacaacatattttgatgtaacaaagttacattttcttaaaatataattatgttgttgcacgtgaggaatgtgaatgaaacaaatgagtcgtggtagtgggccaaattctcactgctgttcctgtaattctgaaccttttcaagtatacaatggaggtataagaatctggccagatgtgaaacatcacctataagctaaaggacagacccttaaaattcatcaccagtacaattgtgaggtggaaatgaggaatacaaaaaattgaggtattttatatgataaactgtcttgtggtgtgactggtgtacaaattggtcttttctttccaactcacattaacagaatctacctatgaatatgagtaaaacctatgaaaaatgaacacggatatgtccttgggaggaaggtcactgttaaggagtcaatgatacatttttggtccctgagaaggcaaaacaccaagactccatccaatcccgcctgatggacgaacaacgccctcggtgtcagacaccatgaaaagaacaacttcagaacacggaagctaatccatgctgtcgggaacagaccttacactgaaatgttctctttctagtttcctgcttggtggcaggaagcctaagtcagcatcgagcaggtgtcaggtcgaagcggcacaacgggaggggctctgggaaccaccggagtactctctcccctcttctgggttagctgagcagcttgaagaagaggaatcccccgaccagacagaagggcagcagcctgtgcccatcacacctgtttccacggaccaggtgtccgtgcacacctgggagacactgcatctccaaagtctagaactggcccctagaagttgagcacaacatttacaaagagctgagtcatctaggaagaaggaaaataagacgactgcacaagtgaacagtgctcacttctaccagaaaacagatgtgaaatccaaagaagaacaaacaccaacatattaccgctgggatgaacttctggaaagacaactgggtgtagtaaattggcttgaagagcaggaattgaaagaatattccttattgctgaacaaagagctgcgaagtatattcactaacattctgataggaaaagatctcaatgagagctgagcaaggccaccagaataccaaattcctccccaaagtccccagcatgggcagggcctcactccatgtggcactggaaggacttccctccccagcaccttctccacagagatggcatggtcctgccagccgggaagatgctccaggggggctttgtggtgctgggttagggttagaatccttaattggccctacctttgatcaatgagcagaacaggaagcaatcctttcaaatgcaaatattcagaggagaaaacaaggcattgcccaagaagaggagagaaatagcctatttaagtatctatcaagagaaatctgcatattgtgatcaaaacctttgattttagaggatgcttgaaaacaagtatacagtaagcatcttttttttcaaagaatagtatgataatgaaaatatttcaagtacatgtacttttggaaagaccactaagagatctatccatgttctaggccctcccccaaagttctcactttggggctttttcattttcaaatgaatgatgaaaacataattttttaaaataaatactatcaaatcagaagttatatgctctatattaaatttgaaaattagactgttcaaccactggtcatgtcatttactttgaggctggtgtcacgtgcttgaaaaacaatggatgatatgaactttgtttcactggaagaaaagctatgtatcctactgaagtatctgctgaacagaggtaaacctgaaagattctaactgtcccaggaccagtcaccttcaagggtagaagagctattaatacttttgagattttgttttactctaagaatattatagagaagatcatcgggtatcacctctcagtatcaatggtataattgtggattaaaatatactaaggtacaccaagagctgcctttaaactaaatttcccacaaaagctgtagcaacacaaacatgatcattttcatgtgacacatgaactttctcattacacttgttagccacatgtattctttgaatatctcacaccccttacctaggaaactatttttatgcccaaaagtatattgatactgctacattacgttttcagaaagttcagttcagtaagttaaggcctgcatttctaaaagcactgatgataaaacacaaaacctgcaagagccaataaaaagagtaatggactttgagcatttgttaaccatccattgagaggatttaagatttttaaaaaataatgttgttgctgctctcagttcacaaatcactgacaacccatgatcatcatgtacacgtttactccataaaggtatttttctctctatattaaactagtctcattttatttagcctctttactcaacactttaggaagctattccttgagactttagaaatgttctttttgcctacaaaaacacattttttttcttactgaggaactttaattgggtactattcaattttatgttctacttcacctaatctactttacccaaccccatctttcaacttggcgtagttccctgctgagataaaacactggccatgaagtacatgataccgtggtgaaatatgtgcatcacttcatgctatgctcccatttggaacacatggatgggaacactatagacagagaatgacctctttgattcaaatactggcataattaatggctcttttgcatttaagacacataatgagaggttagctgaggaactctaggatgctctgccattgcaaacaacaaggagatggctacatttattggctttttgttagaaaatctttcaaaaactgcatattgcaatttgtagaagctagcctaacctcaattgtgtcctttaacttgttcctgtatgacagggtactcgatatatgagctattgaacaggtactctcccacttagccttattatcaagttacctaatttatttcttctgaatggccatgaatgcttgctgataaagaatgtggatatatttgatactggatcccaggtaacacagatcgaatacaaataaaataatacctcatgctacttaaatcaactgtctttaattggacaataatcacatgttaaaggggtcaatttgctctaatgtgtctttagtcttgactatcttccagtgaatatacagtcatgaaccacgtaaccatgtttctgtcaaagacataccacttacatgacggtggtcccataacattgtaataccatagttttactgtacctttcctatgtttgtaaacacaaatactcaccactgtgttacaattgcctgcggtattcagtgcggtcacatgctgtacaggtgtgtggcccaggagcaacaggctgtaccatctggcctgggtgggtcataggtgtcccatctaggtttgtataagtgcactccatgatgttcacacaataaagtcaccttacaatgcatttctcagaatgtttccctatcattaagtgacatgtgactgtattatttctaactgccttatacatttgtaacttgaatattgaaatattaaagcatactcgaagttgcattattctaatctaagaacatatacacattaagagtcaaattaagttaataattcaagtgataaaggcactgaaattgatttgagctattgaaaagtcatcctgccagtggaacactacctcatgttcattaactcttctctctctctctatttactattaaaatgtcttgggtgggggtgggggtcgaagagtcaacttgtcagaggattaaaaacaattcaatgtatatgcctcttatttggatgacatacttgaatgttatacatgcttaatgcaaactaacacaactacagacacattcactgtacagtgccagagttcaagacaacaatctctcattcccaaagtaatctaagtaaaaatatctctgctatcatgtaacaactaaccagaaagagcccatctttttctgtttaaataatgttaaaatgttttaaaagaagagaatattcatgaaagcttccaggttaatggaaatgaaaatgagattcgtctcatcagagagagatggtgccaggcaaccgttggggacgtttgggctgcagagggctggctgggcctctgctctggtgctgagccatgctccccgctatccaccagaccacctgttactatccagtcaattctaacaccatgatcgaggacctcttctacttcacatccaatcacggccagaaaccacctccaatgcctattcctcgaaccatccaagctcctattgcaatctagtctgttttcatattagatttgttcatctccccaaggttgaaattgaactctttgaacacctgtataaggacaatccccacggagacggtcgtgaatccacaggccatccccaagaagtccaccaggcccacgttgctccactcccggaagaggatggctgaggccagcaggaccagcgtggtaaacacgacgtagtagatggccccgaacaccgaggagtcgaagcactccagcgccttgttgatgtacctgaactggacgatgatgctgcagccgagcacggccaggagtaccaggcacaggcagagggctctctgactggacgggttgttatgcaagatgtcttgggccgccagcccgatgcccttggtggaaggcacggtgaaactgcccagcaaggagcagatgctgatgtagaccatgatgttggtgggcccatgggccggcgcgatccagaagatgagcagcagcagcatgagcagcacgatgcacaggtagcccacaaacactggaacacagacagcacacagtcacccggagccaccgcctagcagccgcaacccaggaggtggactggggcagcacccgggcccccacccgccacccgccaccggcctctactgcggcacagccctggggagcatgtgggctctggcttgaatttaccagacccactgatttcattccacaaaagtattcccatcattttcactgttaaaacatttacagccgggttagccagacgcggtggctcatgcctgtaatcccagcactttggggggccaaggcaggtggatcatgaggtcaggagttcaagaccagcctggccaagatggtgaaaccccgtctctactaaaagtacaaaaattacagcgcgcctgtaatcccagctacttgggaggctgaggcaggagaatcacttgaacctagggggtggaggttgcagtgagccgagatcaaaccactgtactccagcctgggtgacagagcaagact[131 bp omitted]ttctccactaaaaatacaaaaaattagctaggcgtggtggcatgcaccagtaatcccagctactcaggaggctgaggcaggagaatcgcttgaacccgggaggcagaggttgcagtgagccgagatcacaccactgcactccagcctgggcgacagagcaagagtccgtctcaaaaaaaaaaaaaaaaaaaaaaaaaaaaccatttacagctcctaaatgtttacatggtcctctattggaaccattctctttttttcttgttgtttgttttgtttttttgagatggagttttgctctttgttgcccaggctggattgcaatagcacgatctctgctcactgcaacctccacctcccaggttcaagcgattctcctgcttcagcctcctgagtagctgggaatacataagcacccgccaccacgcctggctattatatttttagcagagacggggtttcgccatgttggccaggctggtctcgaactcctgaccttaggtgatccgccgtcctcggcctcccaaagtgttgggattacaggcgtgagccactgtgcccggcctagaaacattctcttaacaatacaagtgaatggagatgctccgaggtttcaaaaaagcacctgggaatccagggggcaggggtaaggcaggggacaggagggaggactttaagctgtgggggtgtttgtgggttttgcaatgattgggggctgcatccagtgggcagaggcatgtgcagacagcaacccccacccccatcaaaaatcatcccattctcgtcacaactgctgaatgtctcctcggacttgtaactgaaaaatatgcctataataatcagagcctagaaactattttatgtatgaaacaaagtaatttttgcatggatttaatatatgctgaattcttcagacatgtcacttccatgtaaattgagggaggattgttctttgatcaaaacttcattaagagttatgctccatctgaggatcattttgttgatagcaagacctcaagtgtcccagtcaataacattacacccccacgtcagtctatatctgcagctaccagattctcaaccactcctcacaaggtgtggggtcggccagcttcaataggtcttctcttatagtgggacctgagcatttacatattgaaagggatgttttgttttaaagtattgtcctggtatttctcctttatattacagttagggcattaaattgatggtttgaacttgtgtgtataaggaggttgtgttttccatgaaatccattccaacatcacaaatggacctgagagggctgggaactgctggctatgcaaaccagcaagtgtggacatgcaaaccagagagtgtggacaagaaaaccagcgagtgtggacaagaaaaccagtgagtgtggacatgcaaactaggtgttaacatgcaaaccagcgagtgtggacttgcaaaccagggtgtggacatgcaaaccagggtgtggacatgcaaaccagccagtgtggacaagaaaaccagtgagtgtggacaagaaaaccagcgagtgtggacatgcagaccaccgagtgtggacaaaaccagtgagtgtggacgagaaaaccagcgagtgtggatatgaaaaccagggagtgtggacatgcaaaccagcgagtatggacatgcaaaccagcgagtgtggacatgtaaaccagcaaactgatgtggaggcagttttgtgctggaacctgcctaaacttgttggtaagcaacacagggtggtctacttaaagtgaaatctatactttaagtctgttgtaatcac[132 bp omitted]taacatgatgaaatcccatctctactaaaaatacaaaaaaaattagccgggcatggtggcaggcgcctgtagtccccggctactcaggaggctgaggcagaagaatggcggagctcgcagtgagctgagatcgcgccactgcactccagcctgggtgacagagcgagactccgtctccaaaaaaaaaaaaaagaaaagaaaagaaattatgtcaaaagatatataaacagggctatatgaggaatctaaacttaagagatgccaggtctttgttctcacagagcttcacgctggagggagtgaagtgctgaggtggagatagagtgggcagggtacaccaggaaaggtatgtggggaggggcgggtggcagtcagacttgggagggtggcccaaggggagccactgtgggaagggaaggcgcccatgcacaaggccccagaagagaacccgaaggaataccaggccacggaggctccccgcagggcctgaggatcaggcgggagggtgagggcagagggctagcctgcgagcacagcccactgatgcacgttcccagagaacacagatctacagtaacagatcagggtggacacacggttcctctgccctgccaggaagcatccaatttgaagacgtggttaaaaaagttggcactcctactgcaaactttcttggcagtgctgctagaaaggaattacctggattggtcagcttttcctccagctcagcctgagttgtcacactctcagactttggggagtggataatcagcacgacggagcctgcacagcttagcaggcaccccaacttgcccaagatgttgagcttttccttcaggagataggaagctaaaatggacctttattgaaaaaagagaaatcattaaagtttaaaccaaactacctgacctttcttctaacagcagatattttatctagaaaaaccattttctttttcttctttttttccctttaagagaccacctcccactctgttgcccaggctggagtgcagtggtgcaatcacagctcaccacaagcttgaactcctgggctcaagtgatcctcctacctcagccaccggagtagctgggactacaggtgcatgccaccacacccagctaattttttaaaaattttgtgtagagactgggtctcactagattgcccaggcaagtctcaaactcctgggctcaaacgatcctcttgccttggactcccaaagtgctggaattataggtgtgagccaccatgcctggccaggattttcacaccaattccatgtataaccactacgtagttaatgatacacataatttacaccactatattactatgtcagcacatataaaatacaccagagtataaaaagttttatgactgaccaaaaataaaagtaatgcttcctttcttataaaaggaaccaatcaaaaatactaatatctatgctacatggaaaagtagggtacaaaaactgtcaaaataattataagtaatgcatgataaaaacaaaataaattaagtgaaaaatgcacaaacaaaagaaaaaataaaaatgctaatagtaattgcagtagtagaagtagtatggggtggctatttcctctaatactgaaaacttttaaaaactggtcacattattaatgcaaaaaaatgtattcttcaaaaacatctataatctccaggcttctaacttgtttcttctcttatttccctgtgtaattatcagtatacaatctgaattggaacaccttgccctcagtaagtcacaggactggtcattgtcactttactcatgtctgtgctgaagacgatcagaaaacaggaacgtccgggaggagggcataccaggctcaggtatggaccggattacttcctttaatacctattttaaagataaggaaacttgagcctcagaaagggtcagcattgaacctaaggccacaaagctaacaagagatacaagcacggtcatgacacacccacaggtcctaaacggcctacttttcccttgtaccacttcacatccttgtccctagacagcctgttcttaagaagctcccaacagtgtcattggggaaataagcaacatcactgaaagaaacaacaaaagacatgaatacacaactagatgttaaatagagaagctccaccgagtagctgcctggaaaaggagaaaccagaaatgcagggggctcacagggcaaaaagtgggcctggaactggcctcggacaacgggtggactatgccaagatgggaaagggttgccatgcacgaaagtggacagtatgagccacgaggccaaatcatctcttattccattgtggaataccagaggacagtgccattttcattcattcattcattcatttattgagacagagtctcactctgtgacccaggctggagtgcagtggagcagtctcgactcactgcaacctctgcctcccgggttcaagcaattctcctgcctcagcctcccgagtagctgggattacagatgcccgccaccatgccctgggggatttttgtatttttagtaaggacggggtttcaccatgttggccaggctggtctcaaactcctgacctcaagtgattcacccgcctcgcctcccaaagtgctgggattataggcatgagccactgcgcctggctgacagtgccatttttaaattgggttatctgactttttactgatgcactgtaagagtttctgtttcgttttcttttgttgagacagagtttccctcttggtgcccaggctggagtgcaatggcgcaatctcggctcaatggaacctccacctcctgaggtcaaacaattctcctgcctcagcctcccaagtagctgggattacaggcatgtgccaccacaccaggctaattttttgtatttagtag[153 bp omitted]atatactttgaaattttttctcccacgagttttcaattcattgatggcatccttttaagcagaaaggtttttaattttgatgacatcgaatttatctattttccttctgttgtttgtgcccttcgtgatccacctgcctgggcctcccaaagtgtgggaattgaaggcataagccactgtgcctggccagttaaatttattcttaagtatttcatcattttggtgctactgcatatgaaattgctttcttaatttcatttttggtttgctcactgctactgtatatagatgcaattttttttttttttctttgagacacagtctcgctctgtcactcaggctgaagtgcagtggcacgatctcagctcactgcaagctccgcctcccgggttcacgccattctcctgcctcagcctcccgagtagctgggactacaggtgcctgccactacgcccggctaattttttgtatttcttttagtagagatggggtttcaccgtgttagccaggatggtcttgatctcctgacctcgtgatccacccacctcagcctcccaaagtgctgggattacaggcatcagccactgtgcccagccgtaatttttttttttttttttgagacggagtttcgcttttgttgcccaggctggagtgcaatggcccgatctcggctcactgcaacctctgcctactgggttcaagcgattctcctgcctcagcctcccgagtggctgggattacaggcatgcgccaccatgcttggctaattttgtatttttatgagagacggggtttcaccacgttggtcaggctgatctcgaactccttacctcaggtgatccacccacctcagcct[137 bp omitted]cctctacctcctgggtttaagcaattctcctgcctcagcctcctgagtagctgggactacaggcatgtgccaccacacctggctgatttttttttgtatttttgtagagatggggtttcaccatgttggccaggctggtctctaactcctgacctcaggtgatcttcccgtctcagcctcccagagtgctgggattacaggagtgagccactacgcccggcctcagatgtaatttttatatagtgatcttgtgtccatcgaccttgctaaacttattagttctaataatttcttagtgattctttaggactctctatataagatcaggtcctctgctgggtgtggtggctcatgcctgtaatcccagcactttgggaggccaaagtgggtggatcacctaaagtcaggagttcaagactagcctagccaacatggcaaaaccccatctctactaaaaatacaaaaattagctgggcgtggtggtgggcacctgtaatccaagctcctcggaggctgaggcaggagaatcacttgaacccaggaggccgaggttgcagtgagccgacagcacaccactgcactccagcctgggtgacagagtgagactc[210 bp omitted]gaggaaggagaatcacttgaacccgggaggtggag[138 bp omitted]caatatggatgccttttaatttgtttgcttacctaattgctgtggctataacatccagtacaatgatgaatagatgaggtgaaagtaggcagcttattttcttcctgatcttaaggggaaaacatcaacccttgtgccattaagtatgatgttagctggggtactttgacagaggccctttgtcagtttaggaagttattttctatgcctagcatattgagagttttcgtcatgaaagagtattgaattgtaccacataatttttgtgtgtcttttgagatgatcacatggtgattattctattgctgtggtatattacactaatttattttcaatgctaaatctactttgcatttctgggataaatcccacttgtataatcctttttatatattgctggatccaactggttagtattttgttcaaaatttctccatctatattcataagagaattagttcatagttgtttttttaatgagctttatcttttctttgtttttttggggggcgggggagggacagagttttgctctgtcacccaggctggagcagtggttcaatgtcaattcactgcaatctctgcccctcagccacccaagtagctgggattacaggtgtgtgccaccacacctggataatttttgtatttttagtagagacagggttttgccatgctggccaggctggtctccctgggttcaaatgatccacctgccttggcctcccaaagtgctgggattacaagcatgaatcacactgcacctggcctagatcttgtactagaagaaaaataacggtataaaagataatgacataaaataatggcataacaggtcaattgtcagaattggaatatggaggttgatttgatacatgtatcataacaaggttaaatttatcgaaattgatcactgtactgtggttatttggagagaatctgaatatctctactcttagaaaatactaattgatgtgttcaggggtaaagaatcataacttatgctaaaatggatttttttttaaaaacaggaaaaaaaaatcacatcatattcatatagaacagtgcttcttgaccaggggtggtttgccccgcaggggacatctgccagtgtctggagacattttggggaggttgagtgctactggcatctgggaggtgaaggccaggatgctgctaaacacctcacaatgcacagaatggctccctcaacaaagagttatctggcttcaagcatcaacagtgctgagactgagatacccagatacagagaaagtgtatgatgaggcaagtgggtaagatgttagcagcaggtgtgtctgggtaaggggagatggacattgctttggttatacttaatcctgtttcctttctgtaatttgaaaatatttcccaaaagttttttaaacctctttctaaacacagcatgtacagatgattactttatcatacattacactattacagaaagaaatgaacctatttgggggctctctattctattcactgctacacagacttatttttccagtgccacattcttttcatttctgtttctatgtaattccagcaaccccatcccattatcaagaacagaactgcttttaaaatatacatatatacatacatattggccaggcgtggtggctcaggcctgtaatcccagcactctgggaggacgg[219 bp omitted]cacactttgataatcatctttgattgtttttttccaaattaattttagttttattctgtttaaaagaaaaggtcttactgggattccaagttgaagacaggctttttatccagaacaccatctgacatggttcctacagtgagtaacacctgcagatgtggagcagtgaacatttctggtgaagtgacttaatcatcaaagtgcatgagaacagttctaaggaaattaactgagcaaaacattttagtatatgtgcattcaatgtgccacgtgccaagatcaccaggtcaggttgtttatctgcctgattatctttcagggggacgggtcacagaagctggaggagtgtttcccaaagtgagaacactcttgccctcccagcgcctcagagccatccgaaacacaaagggacaccaagccacacatgatagcagtgtatgtgttcacgagaaaaatgtgccacacacacattctcaaggcgtcgcatgtgaaaaacatggtatttaggtcacagaaccttaatgcctacgtgactctaaggtgtaaacttcaatacacccatcatggacacacttctctgcaaggatttgggcatctgtctggaatacagcagaaaaccaatgtatccatgagttagaaacttggattttatttctcttctaccctatttttatttctaatgatttcttcaaagacaaatcagaatataaataggttcacacgaggatatatgttatttaataagtatctcatcaatcattttcgcagtaagtaaacagagagtccagctgcaatgtttgatggcttgcagccctccagttcccatttcccccctttcccctttgccccacaactgggcaaccttataggaagcttactcatgtgtatcaattaaaaagatgatttaaaatggagaaataaaattaaaaaaataaataaaatgaaattaaaatttaaaaagaagcctgcgcacacactgggtccctggagtcctcagttcccagagtcctcagtcccttggcatgggcaaaaacttcactccatgccagcccggcctaagcatgcaaaccgccccccagcccaccccaccacctaactacaataaaaatccaaaggtccccctcactcgtctcactcagaaccaaacccgggaccttctcctaagaaaatccatgtgctattgactgcgtcagtcataaatcctatttcacatccattgatgccgtgtattattcatcccaacctctgtaatttcctgggctgaggtggggactgtccggcatccagcaaggaatgctaagcaccccaataaaacaccaactcagtcattttgcttaatgagttctcagaataacttgccaaggtgtcagaagactctctagtctctaagatgtactccaggacaacgaccaggagaatgagagcatcagattcactgataagcaggaaaaatgagtgacagtttcaaatatactaaatatctaagaaaagggttaatactacccagaactacatttgaagggataaaattaaacgatatagagtagaatactgaagatctatcttcttttttttttttaaggcagagtctcgctctgtctcccaggctggagtgctgtggtgccatctcaactcactgcaacctctgccccccaggttcaagcaattcttgtgtctcaccctcccgagtagctaggactacaggtggtcgccaccatgtccagctaatttttcatattgttagtagagacagggtttcaccatgttggccaggctggtcttgaactcgtgacctcaaataattcaccctccttggcctcccaaagtgctgggattacaggcgtaagccaccatgcccggcctgaagatctatcttctattacaattttgctcttattactttaacagaaacatttaaaatgaaaagttgttatatctacactacacattaaataccaaacacaatcttggctctcacccgaacggtactccaagggcgcccaggggggttaccaggaccgtggggaccgccgtgtaagccaggaagtttccaatctggccaacagccactgtcaagaaaatcacaaggatactacttgcaattacagagctctcttccagcactgatcacagttgaattacgctaggctctgccctgaaagggctacttcattcacattacttgtgaagaatcacatctggggtgtcatctgcacatttaaggggtcaggggtcaggaaccacaccttcactggtcccatcagtcgggtgagtaggttcagccctccatggaaatgccgaacctaaccagcagtgactgaaatgggcgcagcactgggcatatctccgctctcttaacacatccttgttttcacacaaatcaggcagaacttcctgtgcaccctctagtggcctgggacctactctggcataggcagctggccacggtgacaggccactggcatagcaagaggatacagtactgccgcacaagactgcagcagggacatcacccagatggagcttaaagaggagctcttcaaggaacagaattggtattgccacgtaatgtcgtattaaaagacaaatgtgacaaacaaagtacatgatgtttcttttttttcttttgagacagagtctcactctgtcagccaggctggagtgcactggcgtgatcttggctcactgcagcctccacctcccaggctcaagcaatcctcccacctcagcctccaaatagctttgaaaacaggtgcatcccaccatgcccaggtaatttttgtttttgtacagacagggttttgccatg[137 bp omitted]taatacatttagagttctgaactctaatattattatttatctttacattatagcacatgacctgatctttgactcatgaaattctctgttaaaccaactgtgctgagaaaaacaaggcagcctaacatggaatttcaccaaatgccaacagcccgactacatgagtaagcaggagctgttttaatttcttcgggcccaggacagatcagcctggactgaattcacggctaatcgtgggcagcaggggcctccaccagctcctaacttgtccttctgcactctcatcctgggaggaaggggagcagggagagtgccctggggaggcagggacatccgaactgaaaggcacgcttagggcctggggagaggccacgcgacaccctcttccaaagaacagagccaccctagcccagccactccagccctgcccagaccagtgatggattctaagaaaggaaaagaccagacttcgccacacaggctacttacttgcgattgtgccagcccaccacacaatgtctgttaaataggaagtacctataaaaaatgagataaaaaatgtcagaaaagtgggtttaccagctacgtatatcaggaagaggtttacaagcgagaaacttttgacatgaaaactaaaattgaaaagaatgaatgtcatactgtttattcaccctaaagagaatctttcatctataaatggcagcattagagaccaccgaaagtggcaaagtcaagatattttttgcaaccaacacaggctgacccaaataaggaaatgagatctttatacatcagttttctttcacccaacaagctaccacaaagatattcctttgatggagttttatttttatctcaaaagggtttgagtctttaaagtccaactctctcatgcatttactgtagtccatttatataagaattttattatcatagggtttgacttcctgcttaaacaagtcactcaattttcattatttataactcttctgatacgactcttctttcagccatgcgggaaccacatccttacactcacctgatgctctgacatttgacctgagacttgccggcatcctctcaggttaccccacccatcccacgcagggcaggcggagccccagcaccttcctccctccccctgcctcttgacaggtgtgtatggtgagaggtctcccaacctttgagacaggtttgtccttcagatatggcaaaatgctcctaagcacttttttttttgaggcagagtttcactcttgttgcccaggctggagtgcaatggcgcgatgtcggctcaccgcaacctccgcctcctcccaggttcaagcgattctcctgcctcaccctccctagtagctgggattacaggcatgtgccaccatgcccagctaattttgtatttttttttagtagagacgaggtttctccacgttggtcaggctgatcttgaactcccgatctcaggtgatccgcccacctcggcctcccaaaatgctgggattacaggtgtgagccaccgcgcctggcctttttttttttttcagacagagtctcactctgtcacccaggctggaatgcactggtgcgatgttgactcactgaaacctccactttccgggttcaaacaattctcccgtctcagcctcccgagtagctgagactacaggagcatgccaccacacctggctaatttttgaatttttagtagagacggggtttcaccaaattggtcaggctggtctcgaactcctgacctcaggtgatccgcctgcctcagactcccaaactgctggattacaggtgtgcagcacgcctggcctgctaagcattttttgaggagattttttgttgttaaccacagattacagtaatgaattcttttttccttttcctttttttgagatggagtatcactctgtcgctgaggctggagtgcagtggcacgatctcagctgactacaacctctgcctcctgggttcaagcaattctcatgcttcagcctcccaagtagctgggattacaggcgtgcaccaccacgtgcggctaatttttgtatttttagtagagagggggttttgctatattggccaggctggtcttcaattcctggctccaagtgatccacccacctcagcctcccaaagtgctgtgattacaggagtgaatcaccgtgcccagccacagtaactaattctaattgtttttattctcagtaggaaaaccacaatttggtataagacacatagcctgctagcctgcttaatggagcagcagagctacaagtattagaaaaagtacttacaaaatgaaatgggggctgggcccggcggctcacacctgtaatgccagcattttggaagcctgaggcaggatgatcacttgagcctaggagttcaaggtcagcctgggcaacatagcaagactctatctctacaaaaaatttaaaaattagctgggtgtggtggtgcatgcctgtggtcccagctattcaggaggctgagacagaagaatcgcttgagcccaggaggatgaggctgcagttagccatgatcatgccacttcattccagcctgggtgatagagtgagacactgtctcaaaaaaaagaatattgctatttgatcacatcacagtaaaaactgatttaggcaagaatcattaacggatactaaaacaagcgaatgaaaatttactgagtcacctccatgggtttttcttattaattatgaacagaaaaagttatctttatagataagcctgatggacactggcttagccaagtggtcaaagtccccagcatcagttgtgccacctgcctgctgtggctgtctcccagccctgagccacgccctacctctgctgccaggctccactggagaagacagcctggcaccactggggctcctgtctggtgtccctctcagtgtatctaatacaaacaggacccagggtgtcctatgaagcagaaagtttagcgaagcttaagaatgtcccatggtgggcactgtaggagagtcagctattaatacagaatcaatgttagatttctaaatgtgctaatcaaagtggctatcccaaaatgcatgccgaatacttgagtgaaaggtcatcaggtccagaatactagtgtgaaaagtctgtggaccagtttcccaacaaaaccaccataactaataaataaagtacttaacaaagtgggccgggtgcagtggctcatgcctgtaatcccagcactttgcgaggccgaagttggtggatcacaaggtcaggagaccgagaccatcccggctaacacagtgaaaccccgtctctactaaaaaaaatacaaaaaaaaattagctgggcatggtggtgggcgcctgtagtcccagctatttgggaggctgaggcaggaaaatggcatgaacctgggaggcagagcttgcagtaagccgagattgtgccactgcactccagcctgggcaacagagagagactccatcacacacacacacacacacacaagtgaatttaaactctgtggaaattatcctaagggcatacagaaaatatctcctttttcattcctgattttagtaatttgattcttcttttttgcttggtcagtctagctaaaggtttgtcaatttcattgttcttttcaaagaaccaacttttgattttgtttttattgggtttttagattttttttttctttttgagacagggtctcactctgttgcccaggctggggtgtagtggcatggtctctcagttcactgcaacctccatctcccaggttcaagtgattctcctgcctcagcctcccaagtagctgggattacaggcgtgggccaccacatccagctgtccttttattgtaatgaacatggtttggtcaggacgttttgtgaagtcatgggattcctgctacagcagctggactgtgtgaccctcctacagtgaaagctggtcaaggatgacagtgaccagtgcaatgaggcccataggcacccccctttcactgctatggttatcccaacattgatcatcacatagtatatgtttttggcagtttataaaatgtcaaaagtcacaaaatgaggaggaacctggaataccaggtacacaggaatggcaaagtgaacaaaatggtttttgttcttttcccaaagggtccagttcagttccaagcatttcaggccctgcaacttgtactctccatcaagagcctggatttgcacaaatcaaaaggtgtataggtcaccctcaccttttaaaccagtattaggcaaaatttttctgcatccacagacattaagcaagtcaggtttttctccatccaggtacctgtcccatacccctacccataaacaaaagtgaagctcctgcacatggtccctgagagcctcggtccaggggtgtcccctgttctgccctgcaggaagtgcatggctgtgtgcccagcttcctcactgagttggctgctccattttccctcctccttcttttgccaggagctcctaggagtctgcattccatattagcccttggcccgtcatacagatatctgtgaggatatctaaaacaactgggtttcttcacagtttcaccctaagcattgctgcccctaagcactgttgttccgaaagctcattagccagcactctcagtaggtatctatgcccaagcttctcctcttcccagttgatgacggtcctctattaatctgcaggtcctccggcctcagcaacaacagggagctgcagcactgaaggatgcagaggatgctgtttgtcttgccacactcacgtctcctcccccactcctaggtgtgggctgcagaggatatgatcgctaagttccattggttttcctctcattggaaaccctgggtgctgagagttgcatagctgtttataacagctaaactataaaacaaagaagtgtttgtgcaaacacaaaagagccttgccaggatgacagtatcaactgacagtgatgctgtccaaccaggggcatgtggctttagaccttccatttagttataaatgtgtcggaaatgtccttaaaatacagctttaggccgggcgcggtggctcacgcctgtaatcccggcactttgggaggccgaggcgggcggatcacaaggtcaggagatcaagaccatcctggctaacacggtgaaaccccgtctctgctaaaaatacaaaaaattagctgggcgtggtggcgggcgcctgtagtcccagctattcgggaggc[136 bp omitted]aaatacagctttatagtataaaaatatagatgggcatccaatgtatttaccttctaattattccacaaaaagattgcttccacttatgtgtgcttctaacatcaacaacagaagttgctgataaaagccaagcaagagtggataactagttctttgtaaattaatgtataaaaaagatgtaacatagtttttacagatttttctttttctttttctttttgagacagagtctcactctcttgcccaggctggagtgcactggtgtgatctctgctcactgcaacctctgactcctgggttcaaacagttctcctgcctcagcctcctgagtagctggcattacaggctgcgccaccacacccagctaatttttgtatttttagtagagacagggtttca[144 bp omitted]tttcctgacaccggcacagccagaggaaggcattaactgccttctgaaacattaactgagcactgctgtgcaccaacttaactcatggacttaatatttgaagttcttttgcctgttggttattagatatgcagaacttatttttcctaagaaatagtttggcaattatggaaaaaagacaaa[137 bp omitted]cagtgaaatcctatctctactaaaaatgcaaaaaattagccaggcatggtggcaggtgcctgtagtcccagctactcactcgggaggctgagg[133 bp omitted]cagtatggtactggcataaggatagacaaacacaacggaatagagttcagaaatcggtccatacatgtacagccagatcacagactgaatgaagcaccagtacaattcaatggaaaagtctccaacaaatggtgctggaccaactggatgttgtagagaaaacgttgaagtttaattcatgcctcagaccatcctgtaactcaacgtggcttacggacctaacgctaaacactaaagctgtgaagctctaagaacacacaagaagatgccattgtgacctgaggagagacaaagatttctcaggcagaaatcaaaagcaccgaccagataggaaaaaaacagacaaattagacttcaacaaaactaaacattcgtgctcctcaagaggaacttttaggccaggcgcagtggctcatgactgtaatcctagcactttaggaggccggggcgggtggatcacgaggtcaggagttcaagaccagcctggccaagatggtgaaaccctttctctactaaaaatacaaaaattagccgggcccagctgggtgcggtggctcacacctgtaatccttgcactttgggaggctgaggtgggtgaatcacctggggtcaggggttcgacaccagcctggccaacatgatgaaaccccgtctctactaaaaatttaaaaaattagctggatgtggtggttcatgcctgtaatcccagctactcaggacgctgacgcaggagaatcgctcgaactagggaggcagaggttgcagtgagccaagatcacgccactgcattccagcctgggcaacagagtgagaccctgtctcaaaaaaacaaaaacaaggccgggcacggtggctcacgcctgtgatcccagcactttcggaggccg[133 bp omitted]gaggcaggagaatggcatgaacttgggaggcagagtc[134 bp omitted]gaggcaggagaatcacttgaaccaggggggcagaggttgcagtgagccaagatcacgccactgcactccagcctacgcaacagagtgagactccgtctcaaaaaaaaaaaaaaaaaaaaaaaggcacttttaagaaaatgaaaaggcaagccacagagaaaatatttccaatccctgtatctgacaaaaacttgtatccagatatataacatatatctgtatggttaatatatgcgtatatatgtgtgagtatatatatacatacgtaatatatacatatacacacacacactcttaccagtcaataatacggtagaacccagccaggcgtggtggctcatgcctataatcccagcactttgggaacccagccagatgtggtggctcatgcctataatcccagcactttgggaggccgaggtgagtggatcacccgcggtcaggagtttgagaccagcctggccaacatagtgaaatcccatctctactaaaaatacaaaacttagccaggcatggtgacagctgcctataatcccagctactggagaggctgaggcaggagaatcgcttgaacccggtaggcagaggttacagtgagccaagatcgcaccactgcactccagcatgggcgacagagcaagagtctctgtcaccacccacccaaaaaaaaaaaagttcatcaacaggagaatggatatgtaaactggtatactcaaacaacacaacactactcagcaataataaggaacatattgctgatacccacatcacgatgaatcttcaaactatgtccagcaaaagcagacgtaagagaatacatactatataattccatttatatgaagcatgggaacaggcaaaattaattcaacctatgcagatgggcatcagaagagtaggcaccttggtatgggggatgaggcaccagggaactttctagggtggcagcaacaatcaatttcttcactgggctgttggttacacaggcatattcatttgtcaaaactcatcaaactgtacctttaagatctgtgcagcttattctatgcaattataccccaatacttaaacaagaaatagttgataaatgacagttaaatttcttggtggtgaggatttcacaggtagcacacttattcgtgcactcatggaggtgtgtacattaa[131 bp omitted]cctccacttcccgggttcaagtgcttttcctgccttagtctctcaagtagctgtgattacaggcatgtgccaccacgcctggctaatttttgtatttttagtagagacagggtttcaccatgttggtcaggctggtctcgaactcctgacctcgtgatctgcctgcctcggcctcccaaagtgctgggattacgggcgtgagccaccgtgcccgacccttaatttttttaatttaaaaagttaagtttctgggttagcccacacaatgctgaccctaatacaactaaccactgtaataaagtttcttgcagtttctatgggaaatgtcattccctgtttcagatggaaattaagagtacagcacatattaacacatgcttcttcctctccatcctccctccagggaagctcagtgcagtatctctattctatttctttattccatctatcaaatatttactgagaatcatcagtgtacacagtcctcagtgaatacaaacacataaaaagtcacagccaggcgcagtggctcacgcctgtaatcctaacactttgggaggc[134 bp omitted]gaggcaggagaactgcttgaaccccgggaggtggaagttgcagtgagccgagatcatgccactgcactccagcctgggtgacagagcaagactctgtctctcaaaaaaaaaaaaaaaaaaaaaaaagtcgctagaagtgttgtctgcccctacagagcaccctcttcctctctgccttaactaaaggcaatctctctcatcctttcccccaccacagtgatcaacactgcccccacgcaccctgaggcctgagaagccaagctggccgactccttgatacatgacgggtagatgtcaagtattatacctgtactagcgtgctctgctgatgtgaacagaaaaatctaggataatgagctctgtcatgtgcactggtaaggaactggaaatgtccatgccctgtaaaagtagaacggtaacattcatgcagccctgaatatgtttgcaaagaacatctaacagggggacaagctcacgacagactgaacacaaccacaggacataaactgacatacatggggtgggctcagtgtatactgcctctttttttttttttcttgagctggagttttactcttgtcacccaagctggagtgcagtggcatgatctcggctccctgcaacctcagcctcccgagtagctgggactacaggcatgcgacatcacaccaggctaattttttttttttctttttttttttttgagacggagtctcgcactgtcgcccaggctggagtgcagtggcgtgatctcagctcactgcaagctccacctcccgggttcacgccattctcctgcctcagcctcccaagtagctgggactacaggtgcctgccaccacgtccggctaaattttttttgtatttttagtagagatggggttt[141 bp omitted]ttggtcaggctggtctcgagctcctgacctcaggtgatccgctcacctcagcctcccaaaagtgttgggattatagacgtcagccaccacgcccagcccactgcctcattttttaaattacatgataaagagctgtaccacccaacgtgtaggtcttaactgcatcctgattctaaaagatgaactgggcaaaacttgcaagataatcacagaaatttaaacactaaccagacatgtgagaacattaaaaaattattcttaattttctggtgcaataaaggtattatgtttaacaaagaaagactcgtggcaatatgcagatgaaatggtaatttgcttgggatctatttcaaaaaaatcctacaggggtgtgggtggggttggcactggggtatagataaagcgaaattgctgaggaaggatgatttgttgttgttgtggttgagtaattcaggggaccatgggcaggtttgttctttgcgtatattgtgcaatgctggggtttgggcttctagtgaactcatcacccaaatagtgcacatagtacccaacaggtaatttttcaaccctcaccccagtcttctaccct[132 bp omitted]ctgaagcctcaacctcctgggttcaagccatcctcctatctcagcctccccagtagctgagactacaggtgcaccacaacactcgcctaatttttttttttttttgagacagagtcttgctctgtcgcccaggctggagtgcaatggtgcgatctcggctcactgcaacctccgcctcctgggttcacgccattctcctgactcagcctcccgagtagctgggactacaggcgcctgccgc[137 bp omitted]gctggccggccaatttttgtattttttttagagatgaggtttcgccatgttgcccaggctggtcttgaactcctgggctgaagtgatctgcccacctcggcagattactgggattacaaactattatattcatctttatgtctatgtgtttagctcccacatataagtaagaacatgtggtatttgattttctgtgagttaggataatggcctccagctccatccatgttgctgtgaaggacgtgatcttgttctttttatggctgcatagtattccatatgtgtatatgtgtcacattttctttatctggtcaactgtcggtgaacacttaggttaattccatgacactgctattgtaagtagtgccacagtaaacatacaagtgcatgtgtctttttgataaaactatttattttcctttgagtagacacccagtactgggattgctgggttgaatggtagatctacttttagttctttgaaaaatctccatcctgttttccacaggggttgaactaatttacattgccacccacagtgtatgggtgagaaatgatcattgttaaccaagggtgatatgtacatgggattcattaactacttcctctactttgaacatatttgatat[144 bp omitted]gactcccgagtagctgggactacaggc[140 bp omitted]ccggtttttttttttaagatttttaggataggccaggcacagtggctcatgcctgtaatcccagcacttagggaggccgaggcaggcagatcacaaggtcaggagatcaagaccatcctggccaacacggtgaaaccccgtctctacttaaaatacaaaaaattagctgggcatggtggcgggcgcctgtagtcccagctactcgggaggc[141 bp omitted]tagaacatctgataggtggtgttaacatatgttttgtgcataggattttttcattaagaatcagttttgaggccgggcgcggtggctcacgcctgtaatcccggcattttaggaggc[134 bp omitted]ggctgaggaaggagaatggcatgaacccaggaggcggagcttgcagtgagccgagattgtgccacggcactccagcctgggtgacagagcaagactccgtctcaaaaaaaaaaaaaaatcggttttgaaatataattactgaatgtgactagaaatatatggccaggagcggtggctcacgcctgctgtaatcccaatactttgggaggccgaggtgggcggatcacgtgaggtcaggagttcaagaccagcctagccaatatagtgaaaactcaactctactaaaaatacaaaattagccaggcgtggtggcgcatgcctataatcccagctacttgggaggctgaggcaggagaactgcttgaacgggaggtggaagttgcagtgtgccgagattgcaccattgcactctggcctgg[180 bp omitted]gtgatggcgggcgcctgtagtcccagctacttgggaggctgaggcaggagaatggtgtgaacccgggagacagagcttgcagtgagcagagatcacaccactgcactccagcctgggcaacagagcgagactccgtccaaaaaaaaaaaacccaaatatattagccgggcatggtggtgttcacatgtaatcccagctactcgggaggctgaggcacaagaatcgcttgaacctgggaggcggaagttgcagtgagctgagatcgcgccactgcactccagcctgggtgacagagcgagactttatctaaaaaaaaaaaaaaagaaacctcaattgtaatagcagccacctccaggtggagagatgagtaagttccactttccgaaccaccattttctgtactttccagattttaaacaatgactatgtattctacaatcaggaaaaaatgctttttaaaaatatgactaagcctaggttctggaaactcaagatatactctgctgaataattatatcacagtaaagagccccggctgggcacgagtcaggcaaccctgtccctgcatgggtcggggacatggcctctcagaccagccctggcagcatctaaaagggaccgtttacattcacaggctcctggctgcagagtaggagtgtgagactgaacatttcctttctgaaagtgatcttttctagtccctcatggttaaaacaaaaaagaaattggtattcattaagggcttaattaaagaactgaaaatagctgggtgtagtggctcacgcctggaatcctagtaatttggaaggctaagatgggaggatcacttgaggccaggagtgggagaccagcctgatcaacataacaagaccctatctctaaaaaaagaaaaaagaaaaaaaaagaactgaaaatataaatataaattacatttatactataaatatttttgagggcaaaatatattctgtccaacagcaattcagtaagaccaaggattgttggtttcatgtagaaatttacattggtgatgtcttcctgcttctatcataagaaaatgaaaatgaatttctgtttgcccagcatcagagtacagcctttttctaaataaagagttaagtccctcctagaaaagccttatctggggccatgcatggtggctcacacatgtaatcccagcactttgggaggctgaggtggaggaccacttgagccctaggagttcaagaccagcctggacaacatagcaagatcttgtctctaaaaaaaaaatatataaaaattagctagatgcagaggtggtgctactcgggaggctggggtaggaggatcacttgagcccaggaggtcgaagctgcagtgagccaagatcacgccaatgtactccagcctgggcgacggaaaaagaccctgtcttaaaaaaaaaatgccttatctgtaggtggatttatctatcttccccctaaccaccctacagggggcagggtgagagaacaataccaaaatcagccccagctgtgttcacattccggcaccaccagttgtgtgaccaggcacgtgtgaggatctctgcaaatctgaacctcctcttctgtatcttgcccctggcattcacatccttatacattccctcccacactgcacttgagcagcccgagcaagccaagagatgtggcagaagcagcactacaaggatccaccaagcttccaccgtggtccttaggaggctttgccaagggaaagccacacaccatggaaggggtctggcttcccagagaccagcacgctgtaagggcgtccaagggagccctgtgtgaagaagccacagggatagaggaagggagagcagagacagcaatgctcagcaagccctcagctgtccagctaccccagactcgagtgaagatgccatctgcatggctgcccagtcctgtccggcactgagttgactccagccccagccaccatctgcttgcagctgctggagagtcgcccagcggagcccagtccaccacagaatcacaacatggcatgagtctgggacaccatggggcttcggtacgcagcagccctcctttatctccttttctgatggaaacagcattaaggaaaccaagcacaggctgcgagccattcaaagactcccgactctcacgcccttctcaccatgcctatatcagtgatctcctctcagggtcagataaagatcagagctggcagtaactctagattctgttgcttagtaggacgtaagtaaggtcagctccgaggcacctgaagacagctccgaaatcctttcataaaataaaaggctcaggttcgccatcctcactctgcggctccctgtggccagttagatgcctctgctccgtgtccagcccattcctcccagtggacacgtgacagccctggaagagctgggatgggggggaatgcaaatgagtgaataggccatcatccctcagggtcaggggacaggagagggccgggggtgctgaggacatgcaccagggagacacacaaggggcaatgacctcatgtcagggtccggagggtccccagaagcagcagaactaacctcgttccgtctccacctagggacgggagcgtgcccaggtatgaggagcgtgggtatgacaggaaaggcaatgagaaagaatacatccaccccagagccagtgcaagtgtggaaggcttggggactcgaaatgggacgcctggatctcagtttacactctcacgagacaactcccttcccctccacatctccacagcatggctgcactgcaggcagcactcctctcaaggaggagtctacaaaatccgaaaagcatgttttattttggtaaaatatacataacataaactttatcatcttaaccattttgaagtgttcagctcagtcctgtgaagtacactgacattgctgtgcagccatcaccaccatccatctccacactccatcttcacacactgaagctttgtacccataaacaccaactcccatatttcccctccccccacccctggaaccaccattctacttcctgtctctatgaatgtcactgcagtgggtgcctcacataagcggaatcaccggctttgtcatttgtgattggcttgtttcgctcagcacaatgtcctccatgttgcagcatgtgtgagaactgacttttgctatcatccttcagttgatgacacctggttgctaggttgttgcagataatgctacgagattcaatgcaatccctgtcaatataacagcaatatttttcagggaaatagaaaaaaaaaattcatatgaagccaaaaaagagcccaaatatccaaagcaatcctgagcaaaaagaacaatgctgaaggcaacacacctcctgacttcaaaacaaattataagcctagagtaaccaaaatagcctggcatttgtataaaaagacacacagaccaatgggacagaataaagaacccagaaataaatctacatatttactcccattgatcctcaacaaagccagcaagaacatacactggggaaaggatatacttttcaataaatgtagctaggaaaacttaatagccatgtgcagaaaaataaaaccggacctctatgtgtcaccatacacaaaagtcaactcaagatagactaaagacttaaacataagttggaaggctgaaaacaggcagaacacttgaggtcaggagttcgagaccaggctggccaacatggtgaaaccctgtctctactaaagataggaaaattagccgggcatggtggcggacacctgtagtcccagctactcgggaggctgaggcaggaggatcccttgaacctggcaggtggaggttgcagtgagccaagatcacgccattgcactccagcctgggagatggagcaagactccctctcaaaaaaataaaaaaaaagaagctctaatgtttgacagcagggcagaatgactatacttagcaacaataccatgtattctctttttttttttttttttttttgagacacagtctcactccgtagcctggctggcgtgaagtggagtgcagtggtgcgatctcagctcactgcaacctctgcagcccaggttcaggcaattttcatgcctcagcctcccaagtggctgggactacaggcatgtgccaccacgcccggctaatttttgtatttttgtagagatggggtttcatcatgttggccaggctgatcttgaactcctgacctcaggtgatctgcccaccttggtgtcccaaagtgctgtgattataggcatgagccaccgcacgcccgggatttttgagacagagtctcactccgttgcccaggctggagtgcagtggtgtgatcttggccactgtaacctgtgcctcccgctaccaacccaattctttttgttctttttttagatggagtttttgctcttgttgccgaggctggagcgcaatggcgcaatctagcctcactgaaacttccgcctcccaggttcaagcaattctcctgcctcagcctcccaagtagcttggattacaggtgcccaccaccacacccggacaatttctgtatttttagtacagacggggtttcaccacgctggccaggctggtctcaaacacctgacctcaggcgatccacctgcctcggcctcctaaagtgctgggattacaggtgtgagccaccatgcccagcccccacccaattcttaaaagcctccaagctgggcacagtgggagcccagcacattgggaggc[135 bp omitted]gaggcagaaaaatggcgtgaacctgggaggcggagcttgcagtgagtggagatcatgccactgcactccagcctgggcaacagagcgagactccgtctcaaaaaaaaaagaaaaaagcctccaacaaattctaaacacacagctttcctgagactgtccccaggaagcctgtcccagggcagccatgcgaacccctcaatggcagctctcctgcgcagcctgactttgggcccatcctcacccacccaggcacactcagcctctgctgcacctgctgagtgaaggcactgctattctaatgttgccatgggctttccacaaacattcacatcctgtgaatgtttctcttccataagccctgcttcaatggggctctgacactgaacatgacccacctgcctccctgcctgcttcccacagcatgtcatccaaaagcatggcaaagaagtttgtaggcagccccatctgagcctatgctgtagagcacgctccctggactatgtcttccaaaagcatggcaaagaaggcaggcggccccatccgagcctatgctgtagaggacgctccctggactatgtcatccaaaagcatggcaaagaaggcaggctgtcccatccgagcctatgctgtagacgacgctccctggactactgggagttgtactgtgtatctggctgattctctgggaagttcctttaaaagtgaaagagggccaggtgcggtggctcacatctgtaatcccagcactttgggaggtcgaggcgggtggatgaagaccagcctggccaatatggtgaaaccctgcctctactcaaaatacaaaaattagccaggtgtggtggcggacgcctgtaatgccagctactggggaggctgaggcaggagaatcgcttgaacctgggaagcagagattacagtgagccgagatggcaccactgcactccagcctgggcaacagagcaacactccgtctcacaaaaaaaaaaaaaaaaaaaaaaaagtgaaagaggaagccatgcctcaaatccctcagtagaaggactgtcaccagaacttgactcccctgaagatgagactatctagaatctcaaatctagaaatgctaccacctggcaattcatttagagtttaaactttcattgtttagcttccacttgtaagtgagaacatgcggtttttgactttcagacatacagagtggaataacagacattggaaactccaaatgaacaggaatgaaaggaagtaaagtagacttggaagagggccaagcgggcaacttgagagatcaagtgccttcattaatttcatacttcgccagtgaccacccagtgccactgatacaggctagctgggttaacctgaagggaagggtgggagcgatgaaatattatattcaggtgatgttacattaaaagcccagacttcaccactgtgcaatataaccatataacataactgcatttgtacccctaaatccatccaaaaatttaaaaaatttttaaagcttaaaatttcagtaagacacaactttttccagcataaggaacgtcacgctaggtctcccttaaagcaagaacttcattctctggtgcttgcgtatctcccctctcctccctcatcctctatttctgtcatttcatactggtcaattctgctgcttgcaacagatgtaggaaaggattttatggcgagtagattttaaaactgctgtattctcaa[136 bp omitted]atatggagaaacctgtctctactaaaaacacaaaattagccaggcgtggtggtgcatgcctataacccaactactcgggaggctgaggcaggagaatcgcttgaacccgggaggtggaagttgcagtgagattgcaccattgcactccagcctgggcaacaaaagcaaaactccgtctcaaaaaaaaaaaaaaaagcactttgggaggccgaggcgggaggatcacaaggtcaggagatcgagactggtgacagagcaagactccatctcaaaaacaaaacaaaaacaaaaaaagcttcatcagtatctgttgaacaaatcaaagcagacattgaaacaagactctatgtctatcttctaccaccatgagtaacacagctagcctgaatcagtggcactgggtggtcactggggaagtatgaaattaatgaaggcctctgatctctcaagttgccagcttggccctcttcaaagtctactttacttcctttcattcctgttctaaagcttttaaataaacttttgacagggcatggtggctcagacctgtaatcccaccactttgggaggccaaggtgggcagatcatctgaggtcaggagttcaataccagcctggccaacatggtgaaaccccgtctctgctaaaatacaaaaattagctggacatggtagcgtgtacctgtaatcccagctactcaggagcctaagacaggagaattgcttgagcctaggaggcgggggctgcaatgagccaagatcgcgccactgcactccagcctgggtgacagagctagactccatctccaaaaaaaaactttcattcctgctctaaaccttgcctaggtctccttctgctttgtgcccctcagccaaattctttcttctgaggaagcaagaattgaggttgttgcagtcccacatggattccccactggtaacatactttggtgccacatgactcggaaatgttccctagtgtaagacacctccatgcctccctcgccttcttcggcgggaggtgctcaacccccatacaagttttcttctccttttctctcctacttactaaccaaatcccaaaacaattcctctcagccgtaagtgactctgccccgccggctggtctctcagctcaccttgatgggtggctcacagggatggaaaggaccttgggtccagaccgggaagaactgaggtgctaatggcctcctggacgggaggctctgaagagtcatagagctaaagcctaacaccatgcaatgtctggggcttaaaataaataatgaaaatcacaagttcactttgatcaatttaaaaccataatataggccgagtgttggtggctcacgcctgtaatcccagcattttgggagactgaggtgggcagatcacctgaggtctggagttcgggaccatcctggccaacatgatgaaaccccatctccagtaaaagcacaaaattagccagatatggtggcacgcgcctgtaatcccagctcgggaggctgtggcaggcgaatcgcttgaacccgggaggcagaggttcagtgagccaagatcgcgccattgcactccagcctgggcaacaagagcgaaactccgtctcaaaaaaaaatcataataaaaaataaataaatgaatgaaagcatagtatataggtataagaaacagcatttatcttttttttttttttttttaagacagagccttgttcttctcgctcgggctggagtgcaatggcacaattttggctcactgcaacctccccctcctgggttcaagcaattctcctgcctcagcctcccgagtagctgggattacaggtgtgagccactgcacccagcttatcatgttttttttaaaaggctactcgcttgtttattttcctattcaccaattcctttgagccacatgacctgggttgaaataacacagttttcctcaactttttagaaaactaactaaagctggtattcagctttccttcgtttttccctaatgtcttacatctggtgttcacgtgttcttaggctcctcctggttgtgacgtgctttcagattccatgaccttcacagaggactggtcaggtgtactgcaagatttttttttttttttttgagatggagtcttgctctgccgcccaggctgagtgcagtggcggatcccggctcactgcaacctctgtctcccgggttcaagagactctcctgcctcagcctctcgagtagctggtactacaggtgcgtgccaccacaccgggataattttttgtatttttagtagagatggggtttcgtcgtgttagccaggatggtctagatctcctgaccttgtgacccgcccgcctcggcctcccaaagtgctgggactacaggcaccagccaccgcgcccggccgcaagatgttcttctactccggtttgtgtggtgttttcctcatgcttacgctagggccgtggattggggaggtgaggtgctttctcaggccatcctatttataaggtcacgcgcgttgaccatctcacccagtcctggggcctgtcacacggacagatgctccctgaagtgtggctgcggtgtgtgtgtatctgtgtgccttagagacagacacatctgcatccttggaaaatcatacttggttttatttaattctatttaaattgtatgggagaccactatgctttcactttaaagctaaattccttaaattatccatgattttatattttcattcgagactgtcgggccctttatctcttctctgaagccaacgcctggctcactcagagaaagtttcacctgcattccgccatgtaaattacgagttcactttctctcacaacccaagagtcgggggccacatccttcccagagagctcttaatattcttcttctaagagtatggccaagaaccacaagactttctcagtccctctggaagcaatggaaacggactgtttcacagcctgccatatcctgcattggcaaaccggtcccgtccggggcctcccagcacaaacgacactgacagagagctctaccccgcagagcactacggagtgcggtgctgcggcacatccacctgggaagtggccttggcccgtccagggcttggttttggatctgccgcgcgtgttctccaaactgaagatcacttgtattcatttggtgcaggtctaaggcgcagcgggctccgtaagagcaccccaggaacgcacagccctgagagcccgcccgggtcttccttttgcaccagcgaggcccctgcgggggactggaaatcccaggtcttgctctaccgagcgtaccctaggagcgggccgcgcatcggctgaagcggcgcttccaggcgggcgctgggctcgagcaccccagcaccgcgtccgcaggaggctcccggccgcgggttgcgggccacggcgagggctgccgggcggcgcggggcaggtcttggaccgagggaaaaagtcagccggggaagcccgcacaccaaagcaagccgctccagccgctgagaacggagaaaagccgtggcgtcggcgaagcgccggacgctcaggacgcacctgtgattcctgggccgctcccgggcccgagcgccaggacgcggcggcagcctgggcacgccgcggggagcacccgcccgcgcagccttcccccaacctgggcccgggccccgaccccgtcccctgccccgacccgggcgcccccacctgcgaccgccttctccgccgcccgcctcccccacccgcccgccgcctgccgcctgccgcccgccctacctcgccgcttggcacgcacgatgcccttcttctgtagcacgaacgtggacccgttcaccaggctcgacacgacggccacgcccaggccgagcgacacggcggcggggctcgggctacgcgccccctccccggccgccgccgccgccgccgccgccgctgccgcagctgcagtccccattccgcccgcgcccgccctccgagcctgcgcctgcgcgccgcgccccgcggggcgggatggggggtgaccgggaggcgcgggcgggggaggggagggggacgggtgggggaggagcaggaagaggggcgggggcgggacgggggtgccagggaccggcgccttaggctgcggggacagcagtggcgccggacgcggcggcagtgaggggccggtgaggcgctgggtggggcgggggttcccggatttcgcaaatggaaatgcaggactcctggttaagtttccagcgcggagaaacacgcatactttctgagtggtgtcctctgcaatatccgggcagcggagcgcggcaggacgcaccggcgggcagcggtccccgaagagcctccagcggaggccggcccaactcaccggagcgcgaagcccggcgcgccgctgcagagatcgaaggagagccctggcgctgggcgtttctcttccgcccttggcgctagagtcagctacatggggctctgggcttg[321 bp omitted]tcaaaaaaaaaaaaaaaaagaaacaacaacaaaattacaagcttgaaaaataggaaaaagttattttattttttttggaaaaaaatattttttaaagtgactcaattccacaaccctcacctaattattagtattttaggtgttttcccataatgtatacatacttttacatgtttccaattacaatatacgaaatttcctttttatttaatatatatcagtttctgtatcggtacataaatatgattattctaatgacagtataataatttg[145 bp omitted]ttctcggcctcagcctccgagtatctagaattacaggcgtccgccaccacgcccgggttaatttttgtattttgagtagagacgcggtttcaccatcttggcaaggctggtcttgaactcctgacctcaggtgatccgtccgctctacctcccaaagtgctgggattacaggcgtgaaccaccgcgcctggccggttgctgccaggttttgttgtctataaacgatgctacaagctgggcacagtggctcacacctataatcccagcactttggggaccgaggtgggaggctcgcttgagctcagacgttcaagaccagcctgggcaacgtagcgagacccgtctctaccaaaaaaagaaaaaaattaattagcggggcgtggtggcttttacctccaaccccagatactctggaggcagaggtgggaggatggcttgaggtggaggttgcagtgagctgttattgcaccactgcactccagcctgggcaacagagcaagattgtctcaaaaacaaacgaaaagtataaaccttttggcagctttgcatacagcattattattttgtgaagaaatataaaatagggccggggaggtggctcatgactgtaatcccagcactttgggaggcggaggcggacggatccggaggtcaggtggatggatcaggaggtcaagagatcgagaccatcctagctaacacgatgaaacccggtctctactaaaaatacaaaaaattagccgggcatggtggagggcgcctgtagtcccagctactcaggaggctgaggcaggagaatggcgtgaacccgggaggcggagcttgcagtgagccgagatggcaccactgcactccagcctgggcgacggagtgagactccgtctcaaaaaaaaaaagaaaaaaaaaagaactccaccccagacatttttccatgtgagtacataggttaaatgacaggcatattttatctgatggggaaacacatatgggattttaattaaaaacataaaactatattttgcttgaatttaacaaaagaaaaactgaaatgaaactacagtaactactgaatgacaaacattattttgccatgagatattacttcctaaaagatacacctaaaattaaagttagtaggccaggtacagtggctcatgcctataatcccagtactttgggaggccaaggccagcagatcacttgagcccaggagtttgagatcagcctgggcaacatgatgaaaccccatctctgcaaaaaaatacaaaaattagccaggcatggtgacatgtgcttgtagtcccagctactcaggaggctatgggaggatcacttgaccccagaagttgaggctacagtgagccatgatcacgccactgcactccagcctgggcaacagaagtgagaccctgtctcaaaaaaaaaaaaaaaaaagtgagaaacactaagagggtgggagttacgtttattttaactctgggtttcaattttgggctatcaattgattccttgcaaggagaaatgaggaaatcagttcacttttcagctccctaaaaaatttttttttcgtcttatgttttgagatggagtcttgctctgtcacccaggctggagtgcagtggcgtgatcttggctcactgcaacctacgcttcatgggttcaaccaattctctgcttcagcctcccaagtagctgggattacagacgcctgccaccacgcctggcgaatttttttgtatttttagtagagacagggtttca[139 bp omitted]tagaaatgccgggagatttttggagaggggagatttttcttttttttcttttcttttcttttctttttttttttttttgagatggagtctcgctctgttgcccaggctggagtgcagtggcgcgatcttggctcactgcaagctccacctcccggattcacgccattctcctgcctcagcctcccaagtagctgggactacaagcacccgccaccatgcctggctaattttttatgtttttagtagagatggggtttcact[271 bp omitted]gaggtaggagaatcccttgaacctgggtggcagaggttgcagtgagccgagatagcaccactgcactccagcctgggcaataagagtcagactccgtctaaaaaaaaaaaaaaatttaatggatctagttctaaacctcattttgaatccacccacgttgctctgaaatacattcatctttcctgtggctaaaaccttaaagcctagccagtaactcccattgcacttgaggaaatccagtctccttgctgtggcccctaacaggctgctgctggcccaccacggtgcctctagtttgtgtaaaatgcatatgttaattcataataaaccatacaaggcttttttttttttagctctaaaaggctattatttactagttgctgtgtgaatcagtatttctgggtgcagttagaaattattagagttaatgcccaagactcatctcaaccaacacgggggagggcatctgctccttttatggtcagtgactctgggcctccttctgctgggctcagtcctgaggtgggtctgactcaggtcagagctgtgcaccccggccctcctccccaacgtgcatgagtgctctttaggatggagctgaacaccggcttctcaaaaccatgtggccccatcacaggccctgagaactgattgggtcactctggtgggctccccagccctagacaagaagggtttctctagggagcctggcccccactcatgagacctggagcctcaaagatctcttcggagccccaaagatctctttgcagtgtatcagcccaggcctccacactgtggcctctgctctcctctcctgttccccatgtgcattttctttttctttttggcttcacttctgagttattcatttagccatttactgcaggagcgaggtgaggataggagagtacttggggtacccgtaatgttcactgtggtctgggggtccccgagcaggacagtgagtttggggtctggggctcaggcgctatgggagtagactgtgcgaagtgacaggaagacatccgccttgcatattttctttggttttaaagaaagacgttaccatttcatgttatatttgttttatgagacagtttcattctgttgcccaggctggagtgcaatggtgcgatctcagctcactgcaacctccgcatcccaggttcaaccgattctcctgcctcagtctcctgagtagctgagattacaaaaaaaaaaaggtacattttaaagcagagtaacaaattgataactaagcgtggagtggaaagaggtgacccccgaggactggaaatggcaacgttagactatgaactacatttctcccatggctgatttggcctatgcccaggaatgagcaaagacagcaggcccgtgagactggaagcaagatggagtcagccatgctaaacttctctcactgtcatctttgcaaagctggtctcaccatttattgaagtgaatattcttttttttttttttttaatgagacgaagtcttactctgttgcccacacaggagtgcaatggtgcaatcttggctcactgcaacctccacctcctgggttcaagcaattctcctgcctcagcctcccgagtagctgggatatcaggtgcccaccaccatgcctggctaatttttgtatttttagtagaaatggggtttcaccatgttgggcctcacaatacacatcagcccatctcctctcctgcttgacagggatggtcatgatcctcatttcccagttaaacaagccgaaactccattatggggtttcaccatattggccaggctggtctcgaacccctgaccacaagtgatccaagcacctcggcctccaaagtgctgagattacaagtgtgagccactatacccagccaattaggggtaaatatccaacatttagcccggtgcagtggctcactccttaatcccagcactttcagaagctgaggtaggaggatcacttgagcccaggagtttgagtccaggtctggcaacatagtgagaccttgtcttaacaaaaaatttagaacttagccaggcatggtggtgtgcgcctgtagtcacaactacttgggaggctgagatggaggagtgtttgaacccagaaggtcaagtaagctgtgattgtgccactgtactccagtctgtgtaacagagcaagaccctgtctccaaaaaaaaaaaaaaaaaaaaatccaaaatgtataaagaattaatacaactcaaaacaaataacctaatttttaaaatgtttttaaaaaacttgaatagacatttctttaaacaaaacatgaaaatagcaagtgggtatctgaaaggcgttttgcattgtaaatcattagggaaatgcaaatcaaacccattgagatgccacctcacaccccttatgactattatcaaaaagtcaaaagataaatgttggcaagggtgtggcgaaataggaacttttgcatactgttgatgagaatgtacattgatacagtcattctggaaaagagtatgaagatttctagagaaattaaaaatagaactaccatatgactcagcaatccctcttctgagcatacacccaaaggaaatgaaatcattactatgtaaagttacctgtattctcatgttcattgcagtcctaaccataatagccaagatatggaaacaatctaagtgtccatcaatggataaatggataaagagactgtggcacacacacacaatggaatattattcagccctaaaacaaacaaggtcttgccatttgctgcaagatggatgaggctggaggacgtcatgctaagtgaaataaagcatacacagaaaaacaaatattgcataaacccatttatatgtgggatgtaaaaatgtaaataaataaatctacagagatagagagcaaaacattgtttaccaggggaggtgggagaggggaggaattggggacatggaggccaaaggacacaaagtagcaggtatgaaggatgaacaagtctagagatgtaatgtatgacatgaggactgcagggaacaaaattgttatgcatgtgaaattcatgctaaatgagtagatttcaactgctcttgccacaaaagcaacaaggaaatggggaactatgtgaaatgattggtgtgttaatttctttcagtataggaatctttttacaatctatatataactcttagcatcatgttgtaagccttaaatatacacaataagatttatttttaaaaaagaaaaattgagagtcaaagaactgacaaagcaaagactaagtaaataaaaacaggggtaactatatttatatctgttaatcaaaaaatgagtgactgactgaggcaagtgcctccatcaacagagctttgttcagccaaaatttgatgatacccccagaaaaaacacaagccagagaaacgcctgtgacctgtgctttccaaagagggttttgggaactcagtacataaggggagaaggcgtgcaggagagaagaaagggagggggagcaggcagtgaagcggtggttacattcttaggaagctctaattagtgctcagtaaatcttcattttacataagataaggtaaacatctgaaaagaggaaggaaagagtcaattatgcagccatctcagggtaggtggaagagtgattgatctcatgttcttgttctgtacctgggaagataggcctgtaatcaacattgtcagtgtcagattgaatagaactcagttttacatcttgaactgaggttgcagagccacggttacaatgggcatatgcttattttatagggggacatggatcctgaaagattcaggggccagtaaagaacatccctgtgagcgatttgtgagggaggccatatggagaggtacgtggccttttgtggtagtggggacctggcttatgtctaatgccatcacacagggttgtgaaatggcagctatctctttggggagaaagaatggtagtgttgcatgactcagctcccaaacttaacgtctcccttagcataacaggtttggtggttccaagactttattttctcttacatattaaaaaaaactcttaacgaaagagctatgtgagagataaagtgggtatttcctcatgataaaagggtgcaaccagaagggagaaaaaggaattctaaatgtgtttatgcctggtaacttaaccttaaaacacacagaacaagcttaacaaatgaaaaaaaagaaataagttgatgatcattgtgggaaactttaatatctgtgtctcagccactgaaaaataaacaaacatcagtaagcacatagaatctttaaaggatgcatttaacacactggacctaactgagatacgtggtacactacgctcaacatgcagaatacatatccttttcaagtgcagaagcaatatttataaaaattaatcatattttcaatcattgagaagacacaaattccacagagttttagttatacaaatatttaatcacagtggaactataagtttggaaattaagcaaaacattttcagtatggtaaagggatgaataaaatcaaagtttgcttttttgaaacactaataaaattgatggcctccagcaagattgattaacaaaacagacaaaaggcacaaactctaaccggagactttataagtattaaaaagataaatgaataatagaataactttgaaattttcgataaaatgaacaaattgattcagcaaacacaggttaccaaaatgaatatttatatatatgtaattgaacctgtagttaaacaccttataaagaaaactacagtctcacatggcttaataagtgaattctttccaaatgcttaaggaagaaatagcacacatcttacataaactctgtcagaaataggagaagaaacattttccaaattgtctaaccagcata[175 bp omitted]ggtgttgggcgcctgtagtcccagctactcaggaggctgaagcaggagaatggcatgaacccagaaggtggagcttgcaatgagttgagatcacgccactgcattccagcctggataacagagccagactccatggcaaaaacaaacaaacaaacaaacaaacaaacgaacaaaaatcaccagaaaaaaaaaaattagactccactttctcttgtgaacataagtacaaaactaccaaatgaactaggagcaagcccatctcaaccatacataatatggtattaatcatttatcacaacaaagttgatttaattccagaaatgcaatgttcaacattcaaaagccaatcactgttaagttaccttatcaacataaaaagataagaaaaaacattgctcaatcaagaaagaaaaaagcaattgatacaattcagtacctattcataaatcttaaaacctgtctaacagagaggaagcaacatgtgagttaaacactcccccagctgagaatagtgacataacttatttgcagccaaaagatgaaaattgcaggccaggcgcggtggctcacgcctctaatcctagcactttgggaggcagaggcgggcggatcacaaggtctggagttcaaaaccagcctggccaacatggtgaaatctcgtctctactaaaaatacaaaaagaaatgagccgggcgtggtgtcatgcgcctgtattcctagctattagggaggctgaggcaggagaatcgcttgaaccatggaggcggacattgtgacagtgagccgagattgtgccactgtactccagcctggcaacagagcaagactgcgtttcaaaaaaaaaaaaaaaaaaggaatgaaaattgaattgcagtataatcttacaacttttgagaaatctatgtttttcagctaaaaagagagaaactcagccttctgacctttcttctttccctccttggaaggcaatccaaggcctggaaaaacagcagccatattttaaccacaagaataaaaacctggctaagaaagtatcaggaaactgaaaagaaccctggactgccttcctctgaacattttaagtgacaaaaatgaaatctatatttctttaagtcactgaatcagatttattctttctgtggctacatgtagccctaaatgatgtattaaatactaaaataaatactaaaatacacactaaaatactaaaattttggtcttgactcctgatctcaggtgatatgcccatctcagcctaccaacgtgctgggattacaggcatgagccaccacgcccacctcaaaagctttgtgtttttaaatatattagacatgtctctagtttaaaaaaaaaaaacttaacaataatgtaggagaataagagaaactttttccaaaaaagagaaatcactgtgattattttatcttattggaatgttggataatataatctgctttactaatcattaaacacgctgtaaattttccattacaacaggatttgtacctcaattaaggtgataaagttttaaagtttagaaagtgaaagccagccccgcctctctcccagagtgggcggggacagcagttgcatgggcagctttccttgtgacatcacaggaccttcatgacacgcagctgcctggccccgcctcctttccctttcatctttctcattgaccaatgggcttggatcattaaggccacgccccttttctgcattctagtgagaccctggtgacacctcctgtggctcagtcacatagctgcgtggtacgtgactggaggcatatcactgtcctcgcctggatcacgccaatgtggccccaaccccacctccctccccaccccatgatgtcagaaaaaacctgacacagaaaattggctggggccaagagaaaggtaaaatgcatcggattgcagcaccccaaccccaacccagccccaggtcccctctgatggcagaacagctgccagaatccgtgtcactccagaggcacacagggctgggcccccccagtgcctctgggctcccccaaccaaaatcttgtgtcagccccaacccctcagcagtccggccgctgccctcaccggtcaccccagggtgactttcagccggtgactcgtggggctccctgcttggtactctgccctcacctcctattgtccaaaaacggatctccctgggcccttcgggctcacgtttccaaggaactggatgccccagcacctgccctcaccagtcaccccagggtgactttgggcaggtgactcctggggctccccactccatactcagccctcacctaccactgccccaagcctgacttccctgggctctttgggctcacgtctccaagtacctgggtcccaaccctgtgaccccacgccaatctcaaagaggcaacttgggcgcagcactgatgggagaatgggtttggtttggttttctcccaggcttctactctccagagagactttaacagttttttctaagttatccacctcatatttgaattctccatggttctgggaccagagtgcccatcagtcagtgatctttgaagtgagatttgctcatcttctgtgcaagagatcttgggaaactggacttgacaacttgaatcttcctcatctcatctcaacctggggtactttgagtgccacaggatacagatggggcatctttctgaagcatcagtttcccttgattctcgtgggagagacaaaacattaatgttcttagggatgataggcacatagatttcaaagagtatacaagacttctctctgaaatgcagcttgggttgtcctctttctgtttaattcccacatttaacagaaaggctgccttctgccctgaggatacataactctaagaggatgtacgactgtaaaccacacagtgtacaccttcctgcctactttttactttcctacctctgcctctggttttggtctctggcagctgctgatttgtggcaacaccccagagctcagagtcagaagactgagtttcagttccattattgcctttcttttagccatggtatcaatccctctcagtcactaagtgattgcgacaacacctcgtacagtcgttggtggcattaaatcagatcgtctatgagagtattttgtataaactgtaaagtgactgtaggagcttgtagttctcatgagtatcactgctcctcttttccacagttcacagactatcgtcagtggaacattgctggtgttggtaccggagcaaccgacaccaaaaagaagaaaataaatcatggcactaaccctgagacaaccacttcggggggctgccactcgcctgaggatgtgagtcttggctggccggtctcctgaggacaaggggcacaagggggaggtcgagggtaactgttaagattgtggaaggaagaactgccgggtactggctaagaattctgggtttgagtcctacttctctctccatctgcgagggacacggtttagggaaaattgctcgagttctttgggcctctcttttcacacctgtaaaatggggatggtaatgttttacttacatgtgtgaagcttaaatcagatttgttgctgttgtttttgtgttaatccctagtccagggcctgctgtaagctcccctcctctttgggcttccgtttcctgaggaggtagagttagagtatcagagggttctgtttgctctgagagtctgagatttaaagattcactagaatggaaaccttggggccaagggctcctgtctgccttttccgtcctatatcccagctgtgaagaactgtccccggcccctatgtgcttgctcaatgcttgttgaatgaacacatctttctccatcacaagctggcagaagggtgggcttttctcacactcttatgtcggaaggtttatgttactgtcttttccagagaatctagtttcagactttcagttctgtggctgtgggcaaaaaccaacaaagacccaaatcctttttctttgggcgttaaggcaagttgaccagtttgtgttcccattgggtctgagaactttgcccttaaaatccattcctgacccctgcgtaccgcttcctggcctgggcaatagagtcgaggggccaccctcagtcaccttcctttgactctccccacagaaacaacagaacggagctcagctgaaagaggtaacatggtttctttctttgctcacgacatgaccgctgggtttggggggcactcagatgtagaggccccagtctcgtctcgcctactcccagcctggggaggaaggctcacctcccagcttccaccccatccccacagggtccctgataacctggtcccatgggtgggcctgtcctgggacagtggtgccatgctgggggcatgtctcttgctgtgccatctctgcctccctctagtaagagctctgtcttcctcttcttttctataggaaaagaaggcaagccaccaacatcagcaagccctaaggaggcagctagaggtgagtggagggtgtgaagttccctcctgtcctctggagaaggtttctttgcttctctttcagcacttgcttttcttgtctcccaaaggcccaggatcataccatacgaatccttatgtgtcagaaaactgaactggagacagcgctccatgacagccaggatgctgccaggaaatttgaaggtgggaatctgggcaccccgtcacccttcaacctggcactttcacaggcctttgggctgcagctcaacctctctcattccagaagattccaaggatctggcaggctgcctgcatcattcctggcactttgcaggagagttacagcgggctctctctgctatgtccgcagagcacaagagggcggacagggtgagtccaaccacttaccgggtcccctgggagcccagcttcgcagatggaggaatgagcctaaaggtcccttctgcagaatgcagtgtcctgcccagaagacagcatgggccatttcttgctgcttttgtgcgtggttgttagaggcaggttggggctgagtcagctgctgtgggtgagttgcggggcgctgtggggagcgagcactggacacagagctcggaggccaagtgcccaccccacccatacttggctgtggccttggtcaaatcctaggtggagttgagggtacttgtaccatgaaggtacagaagagtatctttagtatgttaccatttgtgtagagagagggaacacatgtacgtgggtgtgtgtgtgtgtgtgtgtgtgtacgtacgtattatggtaatatacataaaacatgtttgtaaggattcataaaaaactcaggagagaggaacagtgttgggggaagatatttcccttctgtaccttctgaggtttggactatgccaatgtatcattctttcaaaaatcaacaaaggattaatttcctcctccttatctgtgcccctacccccaaccaaaagaatgggtttagagaatcagatatacctgggtgttgaaatcccagctctaagtgatcttaggcaagcacttaacctttaataccccatgttcttcatctacacaatagaggtgataatgataactgtctcctgtggtggctgtgaggattaaatgggattgttagcatagtgcctggtgaagcactcaagaaaggttccaacagtggtagtaataacagtaataacaatagcaatattatctgatcgctctgggcccgttagccagctatcaattcagtctctttccctgtgccttccacccttactgagttctctgaaaaacaagtgagagccaggtgcagtggcacatgcctgtaatcccagctacttaggaggctgaggcagaagaatcgcttgaagccgggaggcggaggttgcggtggggtgagatcgcgccattgcactccagcctgggcaacaagagcgaaactccatctcaaaaaaaaaaaaaaaaaaagaaaggaaaaacaaatgagaccatgggtttggaaacgccttgagaacatgtcgggtgtgactgagagggagcaagtgttactgtggagtatcagtgtagctgtcgttactggtcgtccagctgctcctctgcctgctgtatcctgacttgacctttctctatttgcagtacatcgaggagttaacaaaggagagggaagccatgagtctggaactgtacaggaacacgtaggatgggggaaggtgggatgggaggtctgggggcccttagcgtgggtggtgtgctgggaggtggggggtacaggtgagcatggtagggggtcatacaggtttacatgtgtgtgcagggaagctccagtgacggctgtgccactgactcatggggtagcctcaggcaactcatgtcttctctctggcctgccacctgggacttttaattcctggggtcccttccaatgccacggttctgtggttgtggggcgagggtagagggtcgatcaccaaagcggtcctttctgttcttcgttcattcctttctctactgcctccggccatagcataaccaatgaggagctgaaggagaaaaatgccgaactacaagaagaacttcaactggtagaaactgaaaagtctgagatccagctccacatcaaggagctaaaaaggaaactggagacggacaaaatcccgctgccacaggtgagcggctgcagccccgggggtgtgggagccgcatccggctgggacatggtctagggatcatgcagggtgtggggaggctccagccaagagctggaaaatttgagtccttgttctggtcccaccatagaatcctctagagtgtgctaaaaatctacaatttgggaccatgcctgggaaatcagaacctcagggttagggcttaaaatttctttttaaagaatcatagacgaaaaccgttattttatagattacatttatatacctagcttatgactctatttccttttgaggttcaaaccaacactttgcaggagaagatgtggaggcagaaggaggagctacaggatcaggagaagctacggaagcacaaggagaagatgtggtgacaggagcagaggctgcgggaccaggagaaggagctgtgggagcaggagcagcaaatgcaggagcaggagcagcagatgcgggagcaggaggagcagatgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcaggtgcgggagcaggaggggcagatgggggagcaggaggggcagatgggggagcaggaggagcagatgggggagcaggaggagcagatgcagaagcaggaggagcagatgggggagcaggaggagcagatgcggaagcaggaggagcagatgggggagcaggaggagcaggtgcagaagcaggaggagcaggtgcaaaagcaggaggagcagatgcggaagcaggaggagcagatgcgggagcaggaggagcagatgcgggagcaggaggagcagatgctgaagcagaaggagcagacggagcaggaggagcagacgggggagcaggaggagcagatgcgggagcaggaggagcagatgcgggagcaggaggagcagatgcgggagcaggaggagcagatgcgggagcaggaggagcagatggggaagcaggaggaacagatgtgggagcagaaggagcaaatgtgggagcagaaggagcagatgtggaagcaggaggagcaaatgggggagcaggaggagcagatgcagaagcaggaggagcaggtgcgaaagcaggaggagcagatgcggaagcaggaggagcagatgcggaagcaggaggagcagatgcggaagcaggaggagcaaatgggggagcagaaggagcaaatgggggagcaggaggagcagatgcgggagcaggaggagcaaatgggggagcagaaggagcagatgcggaagcaggaggagcacatgggggagcagaaggagcagatgcggaagcaggaggagcagatgcggaagcaggaggagcagatgcggaagcaggaggagcagatgggggagcaggaggagcaggtgcgggagcaggaggagcagatgggggagcaggaggagcagatgcggaagcaggagaagcagatgctgaagcagaaggagcagatgggggagcaggaggagcagatgggggagcaggaggagcagatgcggaagcaggaggagcagatgcagaagcaggaggagcaaatgggggagcagaaggagcagatgcggaagcaggaggagcaaatgggggagcaggaggagcaaatgggggagcaggaggagcagatgcggaagcaggagcagcaggtgcaaaagcaggaggagcagatgcggaagcaggaggagcagatggagcaggaggagcaggtgcgggagcaagaggagcaggtgggggagcaggaggagcagatgagggagcaggaggagaagatgggggagcaggaggagcagatgcagaagcaggaggagcagatgggggagaaggaggagcagatgggggagcaggaggagcagatgcggaagcaggaggagcagatgcggaagcaggaggagcagatgggggagcaggaggagcagatgggggagcaggaggagcagatgcggaagcaggaggagcaggtgggggagcaggaggagcagatgctgaagcaggaggagcagatgcggaagcaggaggagcagatgcggaagcaggaggagcaggtgggggagcaggaggagcagatgcgggagcaggaggagcagatgtggaagcaggaggagcagatgggggagcaggaggagcagatgaggaagcaggaggagcagatgggggagcaggaggagcagatggggaagcaggaggagcagatgggggagcaggaggagcagatgggggagcaggaggagcagatgggggagcaggaggagcagatgtgggagcaggaggagcagatgcggaagcaggaggagcagatgggggagcaggaggagcagatgaggaatcaggaggagcagatgggggagcaggaggagcagatgcggaagcaggaggagcagatgggggagcaggaggagcagatgaggaagcaggaggagcagatgggggagcaggaggagcagatgcggaagcaggtcgagaggctgcgattcaaggaggagaggctgtgggatgagtatgagaagatgcaggaggaggaggagaagatccgggggcaggtggagaagatgggggagaagaaggagaggatgggagagcaggaggagaagatgcaggaggagcggtgctcagagccctgcctccctccctccaaatatccttgtgatatgagccaccctggcagcctggagcctgcacgagaagccgggaagggttattcccatgaccaccacactgcacagcagatcatgcagctgccccctggaatgaagaacgcccaggagcgcccaggcttaggcagcacctcctgcatcccattcttctaccgaggagacaagaaaaagatcaagatcatcaatatctaaaaagaacggtcaacaaggcctacagaagtgtaagccgccatgtgaccttgtgaatatagtctgagaacaaacttgaaaaaaagaaaatgtattttaaattgtggcaaaatactggccgggcacggtggcctgcacctgtaatcacaccactttgggaggcctaggccggtggatcaccaatcccagctacgtgggaggttgaggttgcagtgagccgagatcacaccactgcactccagtctgggtgacagagtgaaactcccatttcaaaaaaaaaaaaaaatttttctacctgaggactctaatatctatgtatgtttctattgttttttttgtttgttttctcctttcgtcttgtgttgtcttgtcttatggcatgcctagtaaagttttatgtgtctccagagagtattgactttgactttatggcacacaattggcgttcaagcagatcgctttcatctagtttgggactaagctggctcaaagcaggttttagtttttgtgacagctggtctattttttattcttttggactcttaggggtggcccttccaggatccccaccaaggtctcatctccttactgggacccaaattctcattatgtcatttcagccctgtgagagtgccaaacattcagctaggctctccagcctcttaactatcacttcatactcagtttcttagcctcttagccctctactgttgaccaatcaccaaatgtgggaaaagcactaaggactgtcaggatcacctcctaggcctggtcactcaagtcctggctgaggtccccaattaccttccaacaattgtttttgatggtggggggaaggggggacacatttttgtccagtttttctaactgttcctgtggggaggctagtctataacaagctactctgcctttaatgaatgttgaaaaccctttttttttttttttgagatggagtctcactctgttgcccaggctctagtgcagtggtacaatctctgctcactgtaacctccacctcctgggttcaagcaattctcctgcctcagcctcccaagtagctgggattacacgcgtatgccaccacccctggctaatttttatatttttagtagagacgggatttcaccatgttgtccaggctggtctcgagctcctgactcatgtgatctacccgcctcggcctccccaagtgctgggattacaggcgtgtgccactgcatccagcccatctgtctttttataaatgtttctaatttgaggtataattcctattccgtgaaatgcacagatctggtttacattttgatgacttttaacaaatgcattacccatgtaacccacctcctttgaagatatggaacatttatcatccagaaagttctcctgtgctttcatcctgtccggcactcccccagcagctgatgaacatgctgaggacatttgtacaggattctggcctccccaaaagagctgctttgacaagcctgcttgccttacccagcactaaatcccttcctgttctctcaaaatttccatctttaaactgcttgtacctataaccctcccacatcaaatccatagataaaccagcccacagcctaatatttactgtatacccaagctttcagaaatacgactcccaggagtggggactggtggctgcatcccctcctcctcctggaagcctctaccagcctacagagcccacagagtagatctcaccaggcagcctgagcctgaaagtgccgtggagcctcctgctggttcaccctcactatggtggcagctgcacgggagcagctgggctcactcattaagcaagaagacattggcttgatgctgacactccaaccccagcctgggtgagcctggctgaaaggccccttccttctggtcagactgtggggagacgcggcagagcatacacactctactgccctcctcatgcttcagctgtgcttccttcttaacagagggagccgctcatggatttggccaaagccttcctgagggctgaaggtttgacaggctgggtgtgtaggggccaccgtgctagagagagagactggtgtgtcagaaggcagccacctggccagaggggggtcaacccccttggtaacctccttcccccagctggacacagagccctgtactctccacatgtgactgctcccctcagagctgccaccagaagaggggttctaaccctgtgggtggggacattgtgttactttacagtgggccatggctccctctgacatctccaactcagaggcagtagagagaagatgagaaattccctgcgcctctagtcctagctacttgagaggctgaggcaagaaggtcactggagcccaggagctcaaggctgcagtgagctatgattacatcaacgcattccagcctgagtgacagagtgagacccaatctcaaaaacaacaataataagttaaacataaatctaactaccacattattggccaggtgcggtggctcacacctgtaatcccagcaatttgggaggctgaggcgggtggatcacgaggtcaggagatggagaccatcatggctaacacggtgaaacccagtctctactaaaaatacaaaaaaattagccaggcatggtggcgggcgcctgtagtcccagctactcaggaagctgaggcaggagaattgcgtgaacccgagaggcggagcttgctgtgagctgagatggcgccactgcaccccagcctgggcgacagagcgagatgccatctcaaaaaaaataaatatgtaagcattccacattattgaccaattccactcctaggtatagccacaaagaattaaaagcagacactcaagacactcgtaaaccagtgttcatagcagcattactcacaacagtcaagagatgaaagcaacctgattgcccactgaagggataacatgtggcttacatatataatggaatagcattgagcctttaaaagaaaattttgacacatgcggatgaaccccaaacacctaggaagttcaataacccagtcacaaaaggacaaatactgtatgattccccttataggagacaccttgagtagtcaaattctgagacaaaagtagaatggtggttgcctggggacagaaggagttagtgtttcatggatacggagtttcagttggagaaagggcaaaagttgtagagatggatggtggtgatggctgggcaataatgtgaatatacttaatgccaatgaactgtacacataaaaatgattaaaatggcaagttttaaggtatgtatattttaccacaatatttaaatttttttaattacatttttttaaattgttaccaaaaaatacgaataatccatccaagttatttagaaaaggagcgtcagatcaagctttccaaaatgccaaaactcagaagattacctggttgcttgacccacacccaggtctccagaattgacttggccctatatacaggtgcaggagtttcgtcttcatcttttttctctttgtcattcagatcttctttctttgttccacttggttcgacactatcatctgcagaattaaaaaattttttaatctgtcaccgcttttcagaatgtcataccattagtctctgcaaatgtccctccccgaaaagttacaacacacatcattaactgaatggcatgcggtatcccccaccccagggctgtgagcatgcgtgactaataaactgctatttcatctgtccagtgtcggtgtcctacgttcagccatcccatatccctagggcaggaatcttctagggttataaacagaactttaatcaacctctccttggttattttactggttccatgatacagctttttctgtgcaaaagatctgaacagaaacttcacagaggatacaagagtggcaaagaagaacacgatattcagcattcttagccattacggaagtgcaaattaaaaccacaatgagatcccactagacttgttagaatggctcaactaaaaaacactgataacaccaagtgctaacaaagacacagagcaacagaaacgtgacagattgccagtgggaatgcaaactaaaacagccacttcggaaaacagttcagcacatgacccaactttcacactactaggtctttatcctagggaaatggaaactatattcacataaaatctgtagagaaatgctcacagtaggattacaattgggaaagaaaaatggaaacaaccacaaggtcctacaatggcagaatggataaacaccatgtggtacatccaaatgatgaaatactaatcagcaataaaaacaactattaatacatagaacagcagataaatctcaaacatataactgggagtaaatgaagatggtttcaaaacgttacttaaaatatggttccactcacatgacattctcaaaaagaataccctatactgatggagaacagatcagtggttgccagggtatgagaccagggaacacgtgataaaaaggagcagcacaagggagctttcggggtgaagaaaattctccaccctgatgatgatgggggttacacgaatctatagaggtcaaaatttactgaactacataccacaataaaataaatttcat[143 bp omitted]tactaaaaatacaaaaattacccaggcttggtggcacgtgcctgtaatcccagctacttgggagcctgaggcaggagaatggcttgaacctggaaggcggaggttgcagtgagccgagatcacaccattgcactccagcctggaccaccgagtgagacttcatctcaggaaaaaaaaaaaaaaaaaaaagaaggaaaatatctaggtccagggagaacagctggaatacggtctggtggaatcatgtcagagcagggagctgggtctggagggctggagtagggtgcagccccactctaggaaggaactaggaaaggcatcctgggtgaagcaagagcagagtcccgttctgcaacaggtgagcatttatcctgatctgagaaactacatgcaaatttaatacgtctcacttagcctcttattttccttaacaacatggaaaatgagaggacaaacaattcagaaggttaagacatgaaatacatttaattcagaaatcatacacagaaaggtaggaaatgaatgggggaaaaaagcagctaatggaaagtgaaaatgggccagatgcggtggctcacgcctgtaatcccaccacgttgggaggccgaggtgggtggatcacttgaggtcaggagtttgagaccggcctggccaacatggtgaaacccgatctctactaaaaatatcaaaattggcctggcatggtggcagccacctgtaatcccagcagctcgagaggctgaggcaggagaattgcttgaacctgggaggcagaggttgcagtgagctggaatctcgccactggactccagcctgtacaacagagtaggactctgtctcaaaaaaaaaaaaaaaaagtgaaaataacctaacatgtactatgcaaagcatctggcctaacaacaatacattacccttttaaatctttacaaacaaccttgaaggaggcaggctttgttgtctccagtttaccaaggtagacagacatcttgggtcacagaatacacagcagaacccagccaggaacacagctcaggtgagaacacaggtgctggctctaaatgccagactctgccctacgtgtgtgtatgtgtgtgtgtgtttggggtcactaaccacagcccaggggccaaacccagcccacagcctctttgtgtatggtctgaacgcagagaaagtattttatttttgttgttcttttgagacagagtcttggctcatcacaacctctgcctcccaggctcaagcgattctcccaggttcaagtgattctcctgcctcagcctccgaggagctgggattacaggcgtgcatcaccatgccccgctaattttttgtttttagtagagatggggtttcaccatgctggccaggctggtctcgaactcctgacctcaggtgatccgcctgcctcagcctctaaaagtgctgggattacaggtgtgagccaccatgcccggccactgtattttatattttttaataattgaaaaacattcaaaagaaaaacagtattttgtgacttgcaaacattcggtggacttcatcttttggtgtccataaatacactttacagaatgaacgtcccctgcccgctgacgtggtattgtctgtggctactttggcactaaatctgcaaggtctcatggctatgacagagaccatagggtccattgagaccttaaaatatttactttctggccctttagagaaagtaggccacccctaccctacagctggctataaattttacacattaaaaaaatgcaacattcttaattttaaactcagtgtactggaacactgctcatctcccttcttcaagatgaaaagcttcgacagtcaccagcaagcagacaagaaccctaagtacacctcaagagttattctcaggagcataaattacaacactttacaacagcaaaagcaggatgaagtcactggaggccacgaaaacaaccaagagtaattagcaccaccagctcaaagaccacaccacaacaacttcaaagttgtctactcttcctttcactactgtagggttcaaagtatacatagagaaaatcgaacacatactaccgaaacacattgcttatggaatgctggagagaagggaagcgagacctcccattggccaggtgtggtggctcatgcctgtaatcccagcactttgagaggccaatgtgggatgatcacttgcacccaggagatcaagaccagcctggccaacacagcaaaaccccatctctactaaaaatacaaaatacggctaggcgtggtagcttacatctgtaatcctagcactttgggaagccgaggtgaggggatcacttgaggtcaggagttccagagcagcctggccaacatagtgataccccatctctactaaaaatgtggctcaggcctgtaatcccagcactttgggagaccgaggcgggtggatcacaaggtcaggaattcgagaccaatctaaccaacacggtgaaacctcgtctctactaaaaattcaaaaattagccgggcatgctggcgtgcacctgtaatcccagctactcaggaggctgaggcagaggatcgcttgaacctgaaagggggagggtagtggtggcgggcacctgtaatgccagctactcgggaggctgaggcaggagaactgcttgaacccgggaggcagaggttgcagtgagccaagatcacgccactgcactccagcctgggcaacagagcaagaccctgtctcagaaagtaaaataaaaaattcatagtcttaataatggaaaacaaaaacatttactgaatgtcaaaacgtctccctaaaaaccccaatcagttgggttctacgtaaagaacaattatgctctgctttctaaccatgatttttaaaagaacaaaggacaaaaaaagtcatcaaatgtggtccaggcacagtggctcacacctgtaatcccagcactttgggaggccaaggagggtggatcatgaggtcaggagttcaagaccagcctggccaatatggtgaaactctgtctctactaaaaacacaaaaattagctggccgtggtggagggcacctgtaatcctagctactctggaggctaaggcagagaactgcttgaacccaggaggcggaggttgcagtgagccaagatcatgccactgcactccagcctgagagacagagcaagactccctctcaagaggaaaaaacaaaaacaaaaattcatgaaatgtaataaataaaatatacactttggatttttccatgtacttagcttttctagagcatcttttagaattattgtttcacaaaaaacactttgggaaacgttttaatttattaacaaatactggagggctaggaagaagaggttaaaacttttcaaaatatagagaatgaattactgatacgtgtaaaaaaaaaaaaaaaaaggttgctgactccagtcatggaaggcactgtcatatggacactcctagcctcagcatctggaggtccggaaagggaaaatttcaagtcagagagaattctatacataccatttatttggaaccttcagcccttaagatcccaacattatgacctcagtttcaacataattgtcctcagtccttgtattggttacaaatacaaaacaaacagctcaactgaactaactcttttctctccagaaacacaaacaaaagacctcataaaaggagtgagtttctagcggccataattactgcaacttacttctccaattttgccctccacagttaactcaacagctcaaaaactatcagtaacaaacaacagtcaccatgatatggttaggagtgtagcagatttctcaaccagtaataataattaagaaaaaaattttgcctattaataaatctcgtttcctgcacttgcaagaaactaattaaaaggcagccctgcacgatctacaaaaacagccatgaagactgttacattttaagttacaggaaacaaacctgatcctctaatatagcaagatacaactgacttccccttacataccctaaaaaaaagccttacacgagaaatttaaacatggaagcagaaatacaccaagaaaaacacatgtcaaaccccacctgtatatctgttttcaaccattcggtgtcaaggcgagcctgggcagccaaacacaaagattcagagggcatcttttctccagcttcctcccagttctcaggcctgcaagtaaacatacatgttgaagacctaacgctttttactattttacaaagacactccggaaaggtttaatgcagaaaaaaaacaaaagagagagacagagaacaaaaagatgggagagaagagctgggggaccggagtgaagtgcagagagggaaagagggaacagatggagggagagggaggtggggaagggaaagcctccttccaaggtaggcagggtgtgcctggtttctcaggaggccagatcacaatgtcatccccctgccctcaaatccaaaaggtacacacacacatgacagaaagcccatcgttttttgttttgttttgagatggagtctccctctgtcacccagtcttgagtgcagtggcggaatctcagctcactgcaagctccacctcccgggttcacaccattgtcctgcctcagcctcccgagtagctgggactgcaggcgcccgccaccacgcccagctaattttttgtatttttagtagagacagg[136 bp omitted]agcagcacgaatctgccgctttaccctacagcagggcgcctgcgtgaaacaaattactcaaaaggatcacctgcagaaaaacccacagccaccaccacttagacatggagacagacccaaggctgcgccgcgggcggtccgcgcaggccccccgttcggccgcccgtcaacccagcgcccgcacctcctccgacgctggcagccccggtgccccaggccgggacctgacgcgcagggcccagccgcctcgccccgctggcttgcggacacagcctcctagcagccgctggctcaggcggcgccagggatcctgacgcctctcccgacccccgccacccgcgcttagggccaatcgcaaggcggctccgtgggcgcagccaatggggaagaggagcgcttcgccgctcctccggactctcccgcttcctgcaatgcggtttatcttcctacttgggagcccaccggctgaggccagggggcaaccgcaggtgccagaaggcgggatttccgcggcacgcacgcacacccgcactcctacggaagtcagtttctcaccacctgaattatttgaacttagcaccactaaacgtggagcaatcacgtacagagtgcttccagacctcatgtaatagaaatcactgacatcatctatttttttttttttttgagacagagtctcattgcgtcgccgagactggagtgcagtggcatggtagcggctcactacaacctccacctccccggtttaggtgcctcagccttccgagtagctgggattacaggcatctgctaccacacctggctaatttttgtattttcagtagtgacggggtttcatcatgttggccaggctggtcacgaactcctgacctctggtgatctgcccgcctcagcctcccaaagttctgggattacaggtgtgagccaccgtgcccggcctatttcatattttaaatattagaaaagtagaacttggccaggtgtggtggctcacacctgtagtcttggcactttgggaggctgaagtgggaggatcgcttgagcccgggagttcaagaccagcctgggcaacataacaagaccctgtctattcaaaaaataaaattagccaggtgaggtggcacgtgcctgtggtcccagctactcgggaggctgaggcaggagaatcgcttgaaccccagaggcggaggttgcagtgagccgagatcgtgctactgcactccagcctgggaggcagagccagactccatctcaaaataataataatagtaataataataagcttgggcggtggagggcaatccccgggcattggccacatgtggagtgacctggcttggctccctagcagccagcttctgggtcaggcatcttcgttggtgactttcagctctcctggtgtggccgtgagtggtgtggcactgccgtgacccatctttttgtcttaaagatgcatcctgacttacctccacacttgcacactcaagaatgcaacatcgtgattaacttgctaaaagaatatcacaaaaatcatagcatccgaacattttttggtcattgcaatgatctggatcaggcaatgagaaaataaatgcttgaagaatgagtacatggaaaagaggaccaagagcagagagtatggcaatttgatgcaaaagagacttttttttttttttttttttttttgagacggagtcttgctctttcaccagagcaagtgcagtggctcaatcttggcccactgcaacctccgtctcctgggttcaagcaattctcctgcctcagcctcccacgtagctgggacaacaggcctgtgccaccacacccagctaatttctgtatttttagtagagacaggtttcaccattttggccatggccaggatggtctcgatctcctgaccttgtgatctgcctgcctcagcctcccagagtgctgggattacaggagttgctgtgtccagccgcaaaagagactttttaattctccagaggaatctgaaaaataaattgcattttcactggatgccttggctgagagaagaccaaaaggctatgggttggcccgggcatggtggctcacacctgtaatcccagcactttcggatgccgaggtgggtggatgacctgaggtcaggagttcaagaccagcctgaccaatatggtgaaacgctgtctttactaaaaatacaaaaattagccaggcgtggtggcaagggcctgtagtcccagctactcgaaggctgagacaggagaatctcttgaacccaggaggcagagtttgcaatgagccaagatcacgccactgcactccagcctgggtgacagagcgagactccgtctcaaaaaaaaaaaaaaaaaaaaagaaaacgcagagtgcatagcacatggtagatactgacactgcactgagtctcttacacacatcgtctcattttactctcacaaaaccccaggagtttggtatctttattctaatttttgagaaactgaggctcaaaaatattagggatatgtccaaggtcacacaatgagtaatttgtagatctgaaatgcagacagatctctcattctgagccaagtgcttccacagcacagaaggtagagaaacaaaagttccctgtggagttgtgggatgcttattgaaggtagctcatttggtgtggaaaccaaaacacaaatgtgcattagtgggagtcaaggaggaaggaggagggaggggagtagagaatttcattgcagactgaaggaagagaatgctaaaaatactaatttgtgaaaaaaaaacttggcagttttagtaatttactggtatgaggagaaataaagttaaaagagtatgaatggtgtggcggcagatcatatgagaggtatagtgaaaatttacagaatctgctgaccccaatgtcaacaaaattcatggggcccagctctgtacctgccatgaccaagttttaaatttttctgtagataggctgttccttccaaagcttagagattaagcatatatatatatatatatatatatatatacacacacacacataattgttttttttttttttgagatggagtctcactctgtcgtcccaggctagagtgcaatggcatgatcttggctcactacagcttccgcctccgggattcaagcgattctcctgcgtcagcctcctgagtagctgggattacaggcacgtgccaccatgcctagctaatttttgtatttttagtagagacgggatttcatcacgttggtcaggctggtcttgaactcctgacctcgtgatctgcccgcctcagaatcccaaagtgctggagttaacaggcgtgagccactgtgcccggccacatttatatatttttaattgaagccactagacctcagcatgtggtctaaacaaaggctcttctcctagttcagtccattttccatgatatcaggttctccaaaggatgaacccaagaggttcttgttagctgaagacaaagtgaaaggctgacaatgacatgcaaatttagtagagcaaagaatacacatttatagtagaataatacaagaattttttcctttctaccatacaaaaaaaatgcttacaatgcaggtacattaattttatattaaaaatatccttaggttgacctctgatgttttgcttttgcacctgctgtaagccttaaggcatttggcattcccattttcacaaacctaatttagtagactaaatagctatgctaagcatttcacttgctttctattattgtttggctgtagactatcacataatgtgaatgttattgattttatacatgttaatttctcctacgacgtactatagcaagctatacctttagcattttttttaggtttttggcttataggaaggtatctcctaaaccataaaacttatcccatattttttttttcataatttatttattgagctttgctgtatgtagctttttgaagtagattttatagtttagaattgttgctttccttttttaatctttcactcttcatttttattgagctatgaattaactatctttattgtagcggtaaaaccatttgtaatagtcatagtttgattgagtgtacataaataaataaaacccctacgttaaactgggacgtgacatcagcctctttttattttttcatttaaattctgaaaacacatggagatgagtgtccttcgtttctaccttaaatgggttgttacaactgaaggtaataggggcagtcagttagcacaaaacaaatgggcagctacacacaaagaacattttaaagataaaacatgggtatttagaaggttgcttccatatgtgctatgagttatgtatgagtatcaaggagagaagacagtaacaactacctggtaatcatttatgctcttatggagaacgagcggtgactccataatgtccccaaaatgaggcaacagtctgtcactgtagcaaatgatgagagggcccttgagctagcaggctggggcacattctacaacccctttcctttgtcctgtaggaaattcaactttcacatatgagaaatactaaaggaattttctcagcattcacataaaaatactctaagaataaagataaaaaaggaatatatcaactcttgtaataactagaaacatgttgctacaaaacagatgaaaaaaggaatgaacatttatacattccaacataaattttaagggtgtaataaaacataaagagaccatgaagtgaaatgcaagagcatggggaagagatagccagaaagtgcaatagcaactggcagaatccatgaaagaaataggatttaaaaacaaaatcattgtaggaaaaaaaaaaaaactaaattgtaaagagaacaagggagactgaaccccaaataatgtaagggtcgtaaagggtgtaagtgagagaagaatatgtaataagtcctctccccgtccaaaaatccaaaaactgtaaaacataggatagaattagaaaaaagttattgcctatattaagccaagatagatcatcataagcacatatatttacattactgtgtagtatatgcttatatatgttattagaatgttcaacaccaagatatatctgtgtatgggactaggactttaaagattaagaaagcattatgtgggggcttaagcaaaaatagtcaacttagagaaaaagaaaatcattttggcatcagagttttccacagcaaaagttaacaccagaaaatggggggaaatattgagaaagaagagaagggagaagcaaatggttatccttatccttgcaagatatctatcagctataaagtgtacagttataagcacccataattgcagggaacactgtttacagaaagttcttattaagagatttaccacaggacaaagttcaatcaacctagttctgagtaggtaaaatactaccagtaaggcaagaggtaagcattcaatgcatcatatatagatttaagggatacatggtgtagaaaatgtaaaaagatattttactgatgattctgataatgtacaaatgattcaactgtaacaactaggaggacagagtaaaagaaaggggaaagtaggaattagctccctgattgcctcgtctataatagctgagagtaatgggttcattttaaatctcaaaatttgcccataatagtatgaaaacattaagtggcacaaaggcaaatattaagaaatatcctgccacaaaaatcaaatagttcaggagaagttgagaaagtgaaaatagcaaagagtctaatttaattgccactcattgtggggaaccattaggtattatctaaataaatggagaaaaatataaatgcaggtaaaattacaaaaataacaaccagaaaactacatctttcttatcaataaaaataaattatcatttaacaatataaaatatttaatactaaattttacaatacatatacaagaaatacaccaaaatcaaatatagccaaatgttttaaaaataaaatggtcaacaaataccaaacagacaaatgctaacaaatgaattatcaacctatttttattgtcttctccttgcttattttttaaattcctttttaaaattttgtttagatactttaaaattactttttatattattttctctaataattctaacctcctggttttgtttctcgacatttctgctgtttctatcacaatatctattttccttgagtgttttcttgttggtggtgttcttttctggtttttatttgttttgtttgtttgttttggttttgattgaaagaaatacaacaatggaagctcacactactgcaaggtgcttctccagattttgcctatcactcataattctacttttatttacttttcagattcctcagttagttgcttattgtacttttcatagttttagttgtaatcaacatgtaagataggctacagggagcttatcctgccacaaaataccagaaatccatctttttttttgtttcttaaaaaaagtcattttgaacttgtaatttgtaggaaggaacgcagatttagaggcatacattttccatgacatggaaaaatcatttaacaatgttaagtctctatttcagcaaatacagaaaagatatgattcacaggacaagaaagctgacagttaagaacttacatgcaaaggcatttcgacaaataatataatccatcctactcctaagagaggaaaatttgtattaatgaaacttctaccaggtatcactttcacctcagttaatccacaaacattaaatcagcaacattttgtgataaaccatatccaaaagagttgattgatgaaatgtcattaatagaacagcagttatccatgattcagtaaaaattcatcaatcacccatacaacaaacttaattccatcttatactaagcacatacactacactgaaaactgtcaacttctgatgatctaaaaatgtctcttctatgaccatgtgatcacactgaaataaagaatacagaaaattcatagatggtcagttaaaaaagcttccgtgaagcaataaactttccttaaaaatgccaaaatagtaacatagactgcatgatataacactcattttactgacatcatctgttgaggcattttgttaatcaaatactttcttttatatatacttataaatgtcataccagaattacacattttctaatgaaatacaaaagcataaaagaatcgtattcataaattgattttaatcattgtctcggttcaatattacaaacaagtgtaattatggtacaagtacaaaacaaatggtgattaaagcatgtcagaaaacagatgttcctgcatacagatggacaatccaattaatacttctcaaatagaaaacagctatttactccttactaatgaatgatataattatttatcattaatgaagcttggttttttaatgtctccatgaagagcttaaatataattttcctaaagatgcatttgggccggg[138 bp omitted]ggtggcgggcgcttgtagtcccagctattcgggaggctgaggcaggagaatggcgggaacctgggaggtggagcttgcagtgagctgagatcgcgccactgcactccagcctgggcaacagaaagagactccatctcaaaaaaataaaaataaatacatacatacatacatacatacatacataagaaaaaagatgtatttggatggttaatgtatttttaatgtataatcatctattgtagttaaaagatgatcaaatgtgctgattcactcagtgtctatgtttcaaatgcaggacttaaggaacaatttgccataagccaccaacttattgttttcttttaaattatatatctaacatgcacacatacacacacaatatatatatacaaaacattaataatgatgaaaattttgagaatcatgaagaatggtatatatgtaatacatgtttttttcacaagtttttcaactactctacttttttttttagtagaatacattagatactacaaaagaaatgaaaacaaaatgatgtggaatagcatgtaaacaacagaaagaagtttttgaagattgttacaacacagcttccctagctaataatacctgagaaaacctgcacatgtagcatatatgtgtcgctaccttttaacatatataatggatttattaatatttcttcattgcgttgatgagatgaataaataaaatagtatgtataaatacctagacctttgctgggtgtatagtaaatattgtgttaaaatagaactcttctatctttctacagaaatacactatgcagtgattacttctggctgtgatacataaaaacaggcaaatctcaatagagaaaaaatatgtattcatgatacatgatttggatttttccaaagaacaaaaactatgaattgggttgcaaggatttcctgttaagacaacagtaggaataaagacatggagtagaagatacacacattgagaaggtttaacaggcctaagcaaaagatgcacataatgaaacatcaggagaacagactagaaattcctctaagcctgttgtgagagccaaagaaaatacatctggatttgactgttgataatgaggaatttctgaaaggttgacctatcacagctctgaaaaaatgcttctaaacaaaccagattcctttgtcaaatagataagggaaattacggatatgtaatgccactttagaaatttcaaatgcacattaacaaagcaacagcgaaaagcaaaccccatttaactttgtttaacctagattttatgaacttatttactaagcaaactctcccatctgtatttccctacttgtaattcttattaagaatcactgttttggtgtcattggaatttacttagagaaatgcggtctaacctctgctttaagaagacaactctggcagaactatcaattggaaaaaaggagagtttagatgctaggaggccattataatagctcacttgggagctaatctgtgcatgactctgatgggagaaaataaaattgagaaaaaggcatgcattggaggcaacaatccttggaatgtgattgaccgtagagaataatgaatgtggaagacccagaacagactttaaacaaactttcagattcttgccaatctgaaaaatattacttcagactaattttgatttgtattttataatgaatgagggtattcatttttttttcatttatttaagagctatttgtatttccttgtctgcaaaattctgtttgcatcttttcctcagttgtctactgggttttcttcttgttcatttctaggagttcttttctaaataaagtaaattagccttttgcctctgaataagtttcaaatattggatccccaatttgtcatatcctgactctgtttatcatatttctatgagaaacttattattttcttttttttaatggcttctggattttaagtaggagttattagatcctgcccatcccagctttattaaggaattctcctccattctattttacactttatatttcatttacaaatttcaagtttggtccactcagaacttactctggtataaagataacttttattttctaaatggctgggcagttgtccacaacctcttctggttggttgaagatcttttacactaaattcacatatgtatttgaatctatttctattttctattctgtctttgtctaatcatgtaccagtaccactgtgttttaattaaagatggtattatataccttaatatctggtagaactagtatctcttcactactctttttattgttttcctggctgaccttgttcctttttctacttgaactttaggatcaacttgtctaattccaaatgaaaagctgattttttttaatcaaaagcatgttgaatgcatatgtttcttttttgttttttttttttttg[132 bp omitted]caccacgcccggctaattttttttatttttagtagagacggggtt[145 bp omitted]ggtctcactgctgcccagactggagtaccgtggctatttataggtacaatcatagcgcactacaacctagagttccagggctcaaaccatcctcccacttcaatctcccaagtagctgggactcgcagtgcatgccgtcacgcccagttgatacataagttaactgagagttgacatcttgatgaagttgagtcatcctacccaagaacatgctttttaacttgctcaagccttcttttgtgtccttgaaatagtgttttcttcacataggtctcatatatgacaaacttatattttatattttatcctttttgttgctaccgtaagtgggtctcttcatcttatcctctataggtttatttacatgaaagccactgatttctacaaattatttttatgatcaacaacttcagtaataattattttattatttgcagagttttggggttctcttgggttttcaagtagttgtacaatcataatgtctgtaaatagtgctagttttacttcttcctttcctattttttaatttctctctcatgtgattgtcttggctggtactgcagtatagtatttaaaaatagtgctgacagtgacatttgttgtctgttcttgacttcagaggggactgtttatagtgcttctccattaatcactatactgagttttgggcagaaatatatacacacacatacacatatattttttcatgttacggaagcatctatcttctatctattcttattttactgagtatcagaacactcattttcttaaatgcttctgcctcatctattaagacaagcctgtgatctttcctttgacgtgaaaacactgaatactgaatactggaataaatgcccccctccccttggtcaataattattttttaacgtcctggtgactattactggcaaatactttatttaggacttttgcatccatattcataactgaaactggtctgtagactgttttgtattaatctttgttaggttttttttatctttaagaataatatggagaatactcatctttttttaggctgggggggtggctcacacctgtaattccaatcacctgaggtcaggagttcgagaccagcctggccaacatggcaaaaccctgtctttactaaaaatacaaaaattagccaggcgtggtggcgcacacctgtaatgccagctacttgggaagctgaggcagaagaattgcttgaacccgggaggcggaggttgcagtgagccaagattgcaccattgcactccagcctgggcgacagagcaaaactctatctaaaaaaaatcaccttttttaaaacatttagaaccatttttaaaacattctaattatttgctttttataggtttagtagaaatattctaaaaacaactaacctgctctttcttagaggtagaagaaaataacttctctcatgaacatgagcagagaggtgaatgaacatgaacatgaacagagagatgaataaagatctagttggctgaaagggtcatcggtataagactctttcagctctttatatttattactaatgaatatatggctttttatgtacccgaaggacagtttggatataaaatctttagcatgtatttactatatgatataaaatctttagctcatatttactatccttgagattacagcaatcactccactctcttctggcatacagagctgccagcctaatttttttcacctttttatatactggtttgattgttttgcctgagtgcctaaaggattctgccattaccttttaaggccaataatttatatgccttgatgctgacagttcttgatcaatttcccctaccatgtgatatcctctttcaacaaccttcacttgttttaagaaaatgttcttgagtatcatgaaataagtgctctgtttacagaacgttaaataactgttctgtctggtttttcttctttgagagaaattcagttttgcctatattagatcttctgtgcccatcttctctctaatcctttctcattctttcttgactttggtttcattttaatttcctcatttctactctgtgttcctgtgtgttcttcagtgtttactcgccctttgtgctctttcccatgtcgtggtttgattcttcccttctacttctttcctgaattctgacacctcacatcttaccacttcctgttttcctaccatattcctgcagttctggaatttctgctccaagtgttccttagaggagcagtccccaaacctttatggcatcagggaccggtctcatgcaagacaatttttccacaggggagcggaagatgatttcaggatgaaactgttccacctcagatcatcaggcattactcagagtctcataagcaacgcacaacctagatcccttacacgggcagttcacaatagggtttgcgctcctatgagaatctaatgctgaggctgacctgacaggaggtggggctcaggcagtaatactcgcccagccgccggcctgtctgccacccacctcctgctgtgcagcccagttcctaacaggccacgaaccagtaccagtccatggccccaggactggggaccccggccttagaatgactgccttcttacatttgttgttgttgttctttttgtttagttcatggtcagacgtttgctcataattttcacctattctgtgacaatattattttggtaaatgttcttcatctatgaagttttattaaattttgttaatgtttttcaccttttatcagcgctgtgctactccgtattgattactcagcaggaaatgagtcgtatgttaactggccctgctttctcagcagcctcctctgaaagtgattttgctggtattctctgagctattcacgctgtctcctccatgttctatagctctagttttatgtaagaaacctatttgccacttcaaaataaattgcttgtatttactggcacttcctgagatctgccacctgaactgttttatcatttctgtgaccacaccaaaagtctccacatgattttttaaaagaaaattctttaagtacaatttgatacacaaaacagacttactttaagagttcatctctttctgtcttccatgccaaaactatatcgctgcatttgttctggaacctgaccaggatttcagtcaactcattgtaaaactataagcaaagaacaaatacaagtaatgaacaagaacaattttttaatccagagagtaatgtgatctaaagctaatttgtcaatgacagttaaagccgaagaactgagatctgcatgagatacatccgtacaatttactaggcccaacaacttaatattaaatatgatctaagattcctaaagaaaataaaaataataaaatcatttttacagaacattatcatcaaaaatgtaacaagttaaaagtttcatgatcatgaaaatcttcctaattcctagagaaaagtcaattgcttaataacatgaaacctatttaagtggaaggattaggttttcaaattcactacagaaatgcaagcatactccccatcaaaaagtgggcaaaggatatgaacagacacttctcaaaagaagacatttatgcagccaaaaaacacatgaaaaaatgctcatcgtcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcggtgtggtgattcctcagggatctagaactagaaataccatttgacccagccatcccattactgggtatatacccaaaggattataaatcatgctgctataaagacacatgcactcatatgtttactgcggcactattcacaatagcaaagacttggaaccaacccaaatgtccaacaacgatagactggataaagaaaacgtggcacatatacaccatggaatactatgcagccataaaaaaggatgagttcatgtcctttgtagggacatggatgaagctggaaaccatcattctcagcaaactatcgcaaggacaaaaaaccaaacaccgcacgttctcactcataggtgggaactgaacaatgagaacacatggacacaggaaggggaacatcacacaccggggactgttgtgggatggggggagaggggagggatagcattaggagatatacctaatgctaaatgatgagttaatgggtgcagcacaccaacatggcacatgtatacatatgtaacaaacctgcacgttgtgcacatgtaccctaaaagtataaaaaaaaaaaaaagaaatgcaagcacacttcagaaacccttaaaagaatttctaaaggctctctggagggttttctcagcttacctatttaaagaaagcattttaaaccaagttaaaatggcattttactatcctctctatttggaaggctttgcagtattttcaccctctcttcagagggttttacattttacctactgtatttatatcaaggtaactttattcagtgattattatggagttaagtaccaaaaggaattatgcatctgaaaaaccttaaaaatcactgttccctcaaaaacaaattggtaaaaagaaatataagtgaattccctaaactttttaaaggacaaggcaagaaagtacttacatattcagtaagccttctgacacttgggcaggccacaagtctgtcctcagcaaaccaccacacagaatataaaagtcatgtcccccagcttttccatcacaaatcagctttgactactcctgtcccctcaaaattcatcaaattaatcaacttcctatcccttaaaaaggtgtcattgacatctctgctaattcctgctacctggaatatttgtaccccttttctgccagttgaaatatgcaattcattcttcaaagttcccatgaaatgttgccaccttcattaagctttctccctcctataacaaacttcgcagaggcaatggcattaaagctaacattccaggcaaagagtaatttggttcaactggaaataccatttaacttccaacctatacgttcacatctgtacttgctagctatggttccttttgcatgtacttcatacctttgtgtcttccttcgaattagctacaagttcaacaaagttgtcatatgcagtagctaaattcttcaaaacttcttttcttaagttagcttcattattagattgcttcattttcgaaaattcctgatgtgagaccttgttaaaagaaagatttatgtatttacatttacttataaaattaatatggcttataacatttttattgatcttttccaattatgaaaattatatgtaattaaatacatatgcaaaattactagaaatacctagtatactcttttgaagcctcattatgctttaaatctttcttaagtaaaaatttcaaaaatccaataggagtcaaaacaaccaataatgatcacagatttctattagtatataacacttgcaaaaaatataacatgaaaattattttaccttttggaatattttatatcatatatagatacaatgtttaggagtagaaatatatgtttaattttgcacattaactatgaaaagggcaaactttcaagtctttgttagtccaaactacctatctgtaaacacgaaaactaacttcaaacttctcaacatatttagtttgcattatttttttaaaaaatgactgaagtctgtatgtatgttagccgtataattaaaggtatcagtaattccaactaatttcgattttcctcccgtatggaaaaaaaaacaaagctattaaaaacttgaaaccatgaaaaatatcagaagtatcaagcactcctaagtaatatgcaacattttagccatagaaatgactttgtttctgccgggcgtggtggctcacgtctgtaatcccagcactttgggaggccaaggagggaggatcaggaggtcaggagatggagaccatcctggctaacacggtgaaatcccgtctctactaaaaatacaaaaaattagccaggcgtggtggcgggcgcctgtagtcccagctactcgggaggctgaggcgggagaatggtgtgaacccgggaggcggagcttgcagtgagccgagatcgcaccactgcactccagcctgggcgacagaacgagactccatctcaaaaaaaaaaaaaaaaaaaaaaggagtgacttggtttcatagatacaaataaaactgatgtgccaagtttaattttacaaaacatacatgtattaagttctactctcaactatagatattctccaatgtcatttttctaattgaatataggtttagtccagacgtatcttttctgtaatttttaaaacatagatgttattaaatacataaatttcacctgaatatttttaagaagtccctcctgtgtctttagagattcttggactttagttgtaagacctccatagactcgatctagttcagtaacagaaagagcttcttcatttatcacaccatcttgagccagggctgtcaaaaacttgcttgtcatgtcaaaattcacagatttcaagtcattctccagaccctctctttccttctttacttcatcaagatttgacaataaggattttaagacatttacaacctaaacaataaaaaagacactttaactgaaaaaaaaaagccaatttcaagaaggaaataatatataaaggttcattcaggctgagagagagatgatttctcagagagccaaatataaattgaacatcaggtttatatagatagacactgtacgttcagttgactcatactaaaacaaaagcagcattaataacaatagccaacagctacaatttactgaactcctatgtgttaggcaccatgctaaacacttcagaaatataattttatgtattccttacaataccccatggggtatatatatttatgacctctattccaaagatagggataacgagtctcagaaaaattaagtgacatggttatacagctactaaggggcagaggtgaaatttgagacctaagtctgactagttccaaaaccaatctcttagccactctacactctactccctcccaatcatggctgtgaagcaggggaaggtatgagtttgctagataagtagatatcctattttgcctagagagactgagagagatatagagaaatagaggtgaagatagaaatagagatagttatgaagcaagcacggtagatggagaaagaaatagagaaagacacagatataaaggtatataccgcatttattttatacaccaggagaggaaagggaaagagggttcttgtgcctctcttcatagcattaagagttttaggccagatgtagaggttcatacctgcaatcccagcactttaggaggatcacctgagcctaggagttcgagaccagcccaggcaacaaagtgagacccccatttctacattaaaaaaaaattagttgggtgcaatggtgtgcacctgcagtcacagctacttcagaggctgaggcaggaggattgcttcagcccagggggtcaaggctgcagtgagccatgatcacgccactgcactccagcctgggtgacagagagaaaccctgtgtcaaaacaaaacacaaaaacaaaacagagatttatctcttgtattcagtcaagacactctctgacttatacccacctgattcataaatacccctttatagtcatagtgttcaagtgccttctaatgagcactttcaagctgccctttcactcatctcttcatactttgctaggaccaccaagaacatcaacccaatctccctattctgcttgccccaatgatgctcatagaaagaaaaccgggggaaagacaaaggaagaagaggacatcatgagccctgtctccacccctgtctttctcattaccagcagcaagtccaattcccatgatccccctaccaactgcctgtttctaaaaattcctaccctactctttcttccacagtcttagttaactccttgataggaacatccaaagtaacatccctttgtgaagaccagagactcgaggtttctgctaaatgtaggcgaatttcctttttggcctcgtttacatccgtatcttctaaacatcctaattttaaaatggaaggaaaggaaaggaagagaagggggagggggagaagagaggaaggaagggggaagggaaggagaaagggagggagagaaagaagagggtacaggggagaaggctgtggaaagagaaagaaatatgattcctagagtctagaaagcatcaaaccacagaaactctaaaaggaaggaggaggagaaagaatcatacgtgggtggatatgacaaagtctgtttaaagacctagtagaacttgatatcagacgatgtgaataaaagtttccttccaagtgacttccaggacatattattaaatgagaaaaaaagggtacaaaagcatatatagtgtgctgcaatttgagtaagacagaaggaaaatcagaaaataaatatacacatacataatatgtacatatgtatacatatgtatgcataattttgggggaggttgggttttttgtttgttgttgttcttgcaaaaagaaaatcagtaaggacaaaccagaaactaacggatatggttacttacaggaagtatacaggaaagaagtagaaggaaaaggaatgaggcttactctgcatgtaccttttgaatcatgaacattttttacacactcagaaaacaagattaagtcaaaacttgaatatggaaacaaatgaactaatggtctatcaaagtgaaacgtaattacacagaaaaaacgtaattacatagaaaattaaaaacacttcaactcggactatactcccttagagaccataatgggcttagtgactgtgcaatcaaggacaggttactacgtagaaaactcaattttcgcagctgcaaaatgggcatagtagtacctatttcaggactgttgtgaagactgagataatctatataaagtgctcaacataacttctaacaaagggtaagtattcaatcatattacctagattaggaagaaaagctaaccgcaacttccatggtatccaaccagactgatacagaagctttctaaccagactgatacagagggccaaatagttaacaaatcctgtgatattcaaaaatgcaataattctaactttctggggaaaaaatgccatttcaaacaacgaatttatgaacaaacttgtggactaccacacaaagatagagatcccttatattacgaacatctttttaaaaaaattcatatgcagtgcactagtttaacatatttcagattatatgacactcgcctcattttaacagagtaaatgaagtagaaaatgaattaaactgcttccacaaatgaatgaccatgataataagaaaaccactgcctaaattttcttataaattcaaatttgaggtttaacatgttatcaaagtatataaataattagaatcctagcgtatttatttcttatacacagctccagctatctttcaactgcaattaaatgtgtccctttattaagttaaagctgccagcgatgatcattcaaacaaatgctttttgttttgggaccattctagatgctatggacacaactactaacaaaaacagtcttttccttcattcgcagaccagagaggattaaataaatatggaaaggggaggattaaacaaatacacaaaaatagaataatgtgggtagacaatgacaaagatggagaagaggtgacatctgagactaatgaaaaagaggtaatagccatggaaatgggaagaaagccctgcacagaaggaaacgcaaatgtaacagtcctgtggcaggcacaagcttggcaggatcaaaggaaagaaaaaaaggccactctggctgaagcatagtaaacaaaaggcagaacaggagatgaggtcaaacagaatggcaggaatggcatcacctaggctgtcaatactttgtctttcagatcaggaacttacaaacttttttggtaaaggaccaaacagaaaatatttttgcctcagtaggccacagtctctgttgcaactctttaactctgctttgcagtgtgaaagacaatgtgtaaatgaatgagcgcagctatgtttcaacaaaaatgtattaacactgaaatctgaattttatataatgcccacatattaaaacattcgtttgacttttttttagccatttaaaaaatgaagtagaaagtagagttttatatttaaaaaatgtaaaactcattcctggctcccaggccatacaaagagaagaggcagaggattcggcccacaagccacaggttcctgacctgagttttagatttaaaactctctgtggcatttaacagcaccaagtacaatatgagacataagaaatgccctcaatgggccgggtgcggtggctcatgcctgtaatcccagcactttgggaggccaaggcaggcggatcacgaggtcaagagatcgagaccatcctggccaacatggtgaaaccctgtctctactaaacatacaaaaattagctgggcatggtagcgcatgcctacagtcccagctactcgggaggctgaggcaggagaattgcttgaacccaggaggcagaggttgcagtgagccaagactgcgccactgcactccagcctgggtgacagagcgagactccatctcaaaaaaaagaaagaaagaaagaaatgccctcaacgaaatcttctattttacttttataaccttgtcattttattttcagaaaaggcaaataagcaacaatgtctacagcaaggaatgcagaaacttgatacatttaccctacactaaaggtaacctaggggagttttttgtctctttatgttaggaaccaaggtactcagcacagttctggaatagtaggccttcaaaaaacacttggtgagtaaataaacaaacagattccagccattctcaacatgtctataaactttctgtcacgagaaatcaggagtaaaagctgtgtttgcagatcctccactagtctgtgaatccaaaaaaggcactcctctgggagggcacacagttttaaacagttctctttatgctctacctctaaggagataaagggttttttttttcaaaggtaccccctccactactcccagcagatgtaacactttgagtataattgaacatcatccttgtgcaaaaaaatagatgttccttcctctggctagactcagccccatatacattagggccaaggcttggccagccaaccacagaccagacttcaggccacagtagatcacaggcaaccaatcacaagcagtgatcctaggtatttaatacaaaaatcttgaaatacaaatgaccactagtctgcaaaatttttcagagtatctcaatatctaaaaccagatgcccaaagagactgaaaataagtaactagaaagtaggctacttcacaataaaagaaaaaacagccctaccatcaaacttggactttttaataaaacatgtacattgcatcactctaatcagcaatcaaaaaactgagttttaacataaaaattctggctaaaatgcgtcatcaactattacgacaaccatctgaaatagctctgataaacctgatgcttgccttatttaaggcacaagacaaacgaatatatagagagtactgaaatttttgtggttaccccatcaagaaatctagcttccaaaaaattacttcatattgactataaaagttcctttctcctgtgtaacacaagtaaggactaataaaactgatacaactgaataaaatatcaacaaatcagtgcataccaatgcagattttgcttagcacaaaccatttttacttttctactgaaagcagaagaatcaaaggacaaaagccacataattctgagtcatgtacaagacagcaaaaagaatacaaagagagtactaaacagagatctttttctaaaataaaaaaggtaccagaatgtattgctcttccaagggtctacagtttcttcttcgggttctttgttgctcgcaggttaatcttctgaccacctcccttttctccgctatgtcctcaaagcaacaactcacattccctgttccactgggttcccccgttagattcaggttcaatgcacattcaactacgtagccttctcttccctttgagaggtgcccggtacctgtgcatttaccctacactaaaggtaacccagagcagttttttgtctctttatgttagggaccaaggtgctcagcactgctctggaatagcagggcttcaaacacttggtgaataaataaataaacagattccagccattctcaacatgtctataaaccttctgtcacgagaaatcaggagtaaaagctgtgtttgcagatcctctgaacctcggataactctctagacacagccactactcagcccttctccgatcctacacgtttactttttctgcctatccactctgttctcataatgtgccaatctcttaagaagcctctgaagagaactactccaaattactgaaattttaagtacttcatctaaatcctcataacatacttcctatactttccctgtgacatttttaaacttcttccctatatcacagtcatccctgtacatgactaatattccacaaaggatcataaattgagggtaaagcctgtgtataatttgtatgttaattttccaatgtacctaccatagtgccttacacagagcagatatccagtaggtcttggaatacatatatgaaatatataaaatgcttctgcggaatgacaaataagaaacaaaactcatacttttcagaacttactatcccaggaagttcacttttttcaagaagttttcagcagtatttcttgccctttggcttgttttcctgtgcagagatttgggacctctatcttttcctactaacttaccctacctccccgtgataggccattaaattatacttgcactttctcttaggactttccaaatcagatgccctactattcaattctctctttcctgtcatcagtagaaacaccatgacggagctatccatttattaacacgcacaccttgccaatcttcccttcaaaggtagtcccggggaaacaaggtggaagggagtagagaacaatggaagaaataaagaatttgtgtatctggccatacccagtcctttcatttcaggaaatttctatacttccaagcttctctcttttataaaacccaaattaaatactgttgacctatgaagtatctaaaatttagttcaaaaaggggcattcaataaatggaagtgactattacaggatagttaatattagtataatttcctattacacagtccatatactacttgaaatataacaaccccaatttatttctgcatttttttaaagatgacaataaggaattggcagtgcattatataaaatggcttgaatgtggttttcttaagcagatgacaacccacatcaaagtgcccttctcacctcactgccctgcatggtctttgctggattagcagaagggatggcagcattcagctcaggctctggcttacacaaaagcacgatggggtcacgatgagacgggtaacattctttcacgtgtccatctgcttgcacagctttatctaaaactgttctgaagctggttccctctgggagaaaataggtttgcagagcacagaagtgattctaacagcaacgtgtatggcctggttatatgttgagttctagtctccaactttacttatcttccccttctctagaccccaattcacttaatcataaaaacacctcctaacagtctttgcgttctcgtttttggaaagatgacaaaatcacttataaaatcaaaagcatagctataccttaaaatacatttggaggttactatctgccaaataaaacctaattaatattaatcttttcctacaactcatgaatgtaggaagaaatcattctctccaaaaattggtccatttattttaaaagtattcctctctcaaaagagcaatgtgacttaaaaaaaaaagatttttagaaaaatctcaataatatacaaactttttacaaagacaaataaaactaatctccagccaccatgaagacagcatttatctcagcaagcacaaaatcttcataatcaaagtcttaagaagcataaatttggcctcaaaataacttaaagctcatttttttttaccacccaggattcactactaaatgaaaaaaaaattacaaagccataaatgtaatatgctctcatttatgtttttaaaatatgcgcaggggccaggcatggtgattcaagcctgtaatctcatcactttgggaagtggaggcaggtggatcacttgagcccaggagttcaagacaagccagggcaacacggtaaaacctcgtctctgcaaaaaatacaaaaattagccaggcgtggtagcacatgtctacggtgtcagctactcaggaggctgaggtagaaggattgcctgagccctggaggttggggctgcagcgagctgtgatcctgccactgcactccagcctaagtgacagagcgagaccttgtctcaaaaaataaaataaaataaaataaaatatgcacagagcttggaacagaaaatgaaagttggaggaccattttaactttcccctttataccgttcttaagaatctgtacttctgacaattggcagatcacttttgtgaacttttttaatctttatactaaaactgaggaaaaacagtttcggtaaaaacaaatttacaactgagcctaatttaatcaagtaaaaatgtgggtccaaattgggaatttattcaaatgaaggtcatttatacacatttttacctgctcttaaaggcttatacagttcattggatgatgtcctttgccagcgttccttaaattttgctcataaatcattatcggttgcttcttcttcatccaacaaccttaatgactttaaaaggaagcaaaaagaaccctgaaatgtcatttctggattaaaaaatttaatgcatttaataaattgttcatacacaatataagggagaatttggtgagatgggaatactaggttagaatataaatcgacttttttcttgcagacatctaagttataatgcatttaacagaaagtcttataaatttaaggctgaattagctatcacctttctcagtaaaaaaaaaaaggaagaatacataagagactatttacatccatatatcaatttaaagaaagttttaagattaaaatagataaatagaagccataaacaaaggggaaaaactgatcaattacattaaaaaataaaagatttagactttcattccaatacaacaaacagaaaattatgtttaatatatttttaaatgccttttaatgtgtagataagatgacaggatagtagggggccagaaacacaagaaaatactaatctaccagtagacacagtgctagcaccaacaatatatgacaatccccgatagcttaggacaaagaatagcaaacttctgtcaaacaccacagagtaaatattttaggctttgtgggccacagtctatggcacatagaattcttcttttttgacaatgctctaaaaaagataaaaattatccttaactagtgaaccacacaaaagtaggccacaagcctgcactggcccaccatccatagttcaccagctgtgtagttcaccattgacttgcattgtgaatttagaacatgaaaagtcaacaagaaacataggtagggacaataaaaggtgagaggtcagatcaaaagcactctccacactcaaactggtatacttccaaatagatgattctcagtggatgaatttttaaaacagaaaactgccctacagaagaaaacatgcctgtctggaccttggctctaaagaaaaaagaaaaaaaaaaaagaagtattatctgagattcctgatcaaaagcctgaacttgggactagaaaccacactatttgtgtgacacaaagtcctaagataaattactactataattaaaagattataaaagaaaagaaaaaacctcttaagtttgaggaggtgccaggtatataatgcctttttatggcagaagcaaacacaaattctttctagaattcaccttaaacccagatctcaatgaattcccacaaataaattacaggaaatatgaatgcacaatcaaaactcactgaacactaaatgcaattcagtattctgtactggatcttggaacagaaggaggaacattggtggaataactggtaaaatcggagtaataatactgtaccaatgtcaatttcctagttttaacaaatgtgccatgaccacgtaagattttaactttcagggaagctaggtgaaaaatatacaggaactttctacactaaatttgcaaagtctctgtaaatctgaaactattttttaaagttttaaaaaacagtaacaaaaaaactgaacacaagagaaaacaagccaccataagcaagaatcagcaaaaatcacaaatcatagaatcaaacccacagaaactacagacattggaattataagataaataatataaaataaatatatttaatatatttcaagaaattagggataaattaaagggtttaaccttccaggttaagacaaactaaaaagaaaaatcttgctacacgctatgtataaaataaatcaataattacaaagactgaacagtttgtatgatagttgatttctcacagtatactagttttacacagtggtcatttgagtttcattaatgtgtacttacttacccttaagataaaaatgaaacccattctcactcaaccagaatttctcttatgctaaagagaaggctctgggccacagtaaattcaccaaagtgatgaatactaactacactgtgagcactagcatgaggaagtctccagtcccaatccctgctggacatcaagggatcacagtgtttatacttgaaaagcaaatcttataaaacatacctcatctaggatttctctatttcattgcagcaattcaggcagttctttaatcaactgatcaacagtctggatgcctccctgttcaatcacagatctggatttagtcaatatagactgaggtacagtgtctccagacacatcttcaattgctgctggaagattaagggaagctagcaccctgaaaaaatgagatactatgttatattgaagtctaaaacaatttaactcatcaatatttattttatttaatttaatcttctataaccaaatcaacagcaatggagttagcacccagaaaaactggataagccctatcaatgaaaaacaaagcaaagattaacagaaaaacaaaaaaatcagtgattgatacaattaaaccaaaatcattaaaaaattaagttcacaattcagaattaaaagccaaaaaataggctggtgcagtggctcacacctgtaatcccagcacttgggaggccaaggcgggaggatcacctgaggtcaggaattcgagaccagcctggccaacatggtgaaaccccatctctactaaaaatacaaaaattagtcaggcgtagtggtgagcacctataatcccagctacttgggaggctgaggcacaagaatcacctgaagccaggagacgaaggttgcagtgagccgagatctcaccactgcactccagcctgggcgacagagtaagactccatctggaaaaaaaaaaaaaaaaagccgaaaaattatgaccgcattaaaatatattaggtatcgttggcttacagttcaaacttctttcagtctaagtaattaaaagtcaaaaattctatcctaaaaaagcagtcttttatacttttgattgttacagcatctgtaacgagtcagaaacaatacacaaaatagttatttttttcttttttgctctctttcaacagaatcaataattataatttcacatcatctaggcaaaatgtcaacagaagatagatgatctaagtcttcattacagaatcttcatctgttctcggttttgtagcacactaacaattcctcagttatttcatttacatgatggggaagggaggtacatatccctacctactatgtaaagaaaaaaggcaaatgaaatgatggaatacaatgaactcctcagaaaagaagctctgtaaaatctcagactgcctgtttatcatatgctagagtaaacttacattcctttcttgttcaagaaaaatgatggtaaaatccatgcattaatcaaaactaaacacatgaaaaggcaagccaactacgagagaaatacagctggcccctgaacaacacagatttgaactacgtgagtccatgtatatgtggacttccacctctttcacctttgccacctctaagacagcaagaccaaccctccttcctcctcttcctcagcctactcaaacatgaaatagacaaggacgaagacctttatgatgatccacttccatttaatcatagtaaatatattttctcttccttatgattttcttaatagcattttttctctagcttatttattataagaatatactatataatacatatacaaaatatgtgttaattgactgtttatgttatcggtaaggcttctggtcaacagcaggctattagtagttaagttttggggactcagaagttatatgcagatttgactgtgcaggggggtcagcacccattacccctatgttgttcagggtcaactgtattctcaattgtatgtatctgacaaaggacttgcctccaaaatatgtaaagaactctttaaatattaagaaaactcagttttaaaaactgagaaaaagatttcaatagacactttacagaaaagatatgaatggctagtaagcacatgaaaagctgttcagtatcattagtaattaggagaatgtaaattaaatcacagtgagattctgctacacacacactaaagcagctaaaactaaaaagactgacggtaccaagtattggtgaggatgccaaacaactgtatttctcaaacagtgcagataggatataaaatggaacaaccactttggaaaacaacctggcaatttcatgtaaaattaaatatgctaaccacacaacctaacaattccactcctaagtatttacccaagagaactaaaatatgtccacatgaagatttatacacgaatgttcatagaaactgaaatgtccattaacaggtgaaagagttaacaaactgctctataaccataaaatggaatactactccataaccataaaatggaatactgctcagccatagaaaagactcaaactgatacacataatatagatgaatctcaaaaacagtaactaagtgaaaaaaagcaaaacacattctaagtatatattgtacatactgtaagtactgtatatgtatatgctagaatgattacatgtattttaaattgtataaaaagtaaaactaaacttaagacagggagtagatcaatagtggccaggggccaggagaagaaggactgggaaaggggcatgagagaatttttttagggtaacagtaatgttctctatcttaatcatagtgccggttacatgggtacatacatttatcaaaactaactaaatagccaggcatggtggctcatgcctgtaatcccagcactttgggaggtcaaggcaagaggatcacttgagcccaggagttcaagaccaggagcccaggagttcaagaccagcctgggcaacaaagcgagatctcatctccataaaaaaatgaaaaaattagccaggtgcggtggcttgcacctgtggcctcagctacacaggaggctgaggcaggaggatcacctgagcccagaaggttgagactgcagtgagccatgtttaatgtttacaccactgcactccagcctggtgacagtaagaccctgtcccaaaaaacaaaacaaaacaaacaaaaaaatatatatatacacacacatacacacatatatacatataataattgaactgtgtacttagaataggtgtatttcgtgtgtgcaaaatatacctaaaatttttttaaaccaatgaattattttcttagtattcaatccatcagaaacaaaaattggttcagaacactaaacgtaccatgtatctgagttcatttctacttctcatttcccccaaataaatatctcttaaaatacaaatttttagtcaaatatcctcaccttgtttctataatttcttccaactatatttgctagagcttcataaatacagtgtccaccaaaaatagttgtaagtgtgtgtctacattttccattttatatactcttggcatttagctctaagctcagaaactaaaatgttcataaactaaagaacaaccaaacggaaaactttaggctctaaaattaagctctacctacccatttgccaaagtggtggcttctctcatctgagcaattgatctgttaacaaatcggctttcctctgatcacaggcagccaaagactgccgcactgacacaggcaccatcttctcaagcagatctaagattaggaagagaaattacaacaaaattttaagacaaaaacccgaactgtaaaagtgactattcatgttttctttccaatattcacacatctatacatatttgatatttaaagatcaaagtatcaatagtctattgacatttaaagatcaaaactaaatcactatttaaagcacaatgataaagagaatttttagatcactacattcacggacaatggtgacaatgaaaagtttctactttgaacttaattttctttaactttttcagatgtgttcatcactgagtttgagggatcttcagtgacg[133 bp omitted]gaaaccccatccctactaaaaatacaaaaattagccagtgtaatggtaggagcctgtagtcccagctactggggaggctgaggcagaagaatcgtctgaacccaggaggcggaggttgcagtgagccgagattgcaccactgcactgcagcctgggcaacagagcaagactcggtctcaaaaaaaaaaaaaaaaattgactgagtgggtcacggcagcaggattccatttctggctccaacacttcctagctatgtgaccttgaggaaattacttaaccactctgtgcatcagtatcctcatcaaatagggctaacaacagtacccatctcagggcacttgtgaaaactaatgaggcaatatttgtaaagtgcttaaagagtgcctggcacatggtaaacactttgtgtttgctaaataaacacataatcaccctttcccagtaacagaatattctccttgggatctcagctagaggctaccatctgttgtatacatctacttctacttcccttcaacctaaataattataccttttaaccatattgacaataatatggaaatatcactcaagaagaacctaacagaccatggaattataataatttaaaccatccttttatcaaatgacatggtcagaactggagaggaaagagggatactagtaacttttaagtcctctactaaggtttttttaataaaaagacttccaacccactagaaaatatgcttacatttgcacatactccagaaaaaggaaacattaaaataaattccccactatgaatgtgttatagtgttgatgtcctgtgttacagtacatgcgtgtcatgagctgtcaggaaatgtgtacaccatgcaggaggctggaccctgagtgagaatgactgcctgtaaaaactgcctggcaatgggaatggccaaagaacttttgtcaattggtatgtctaagattcaactttaagctgatttctatagtgaggtacaatccttcattattctaacacttaggtaatgaacacatgaaagagagagagaggagagcaagatttagaatcttgatgagaatctggttttttgtttgttttgttttgttttgttttgagaaggagtctcgctctgttacccaggctggaatgcagtggcgctatctcggctcactgcaagctccacctcccgggttcacgccattctcctgcctc[174 bp omitted]gccaggccgagaatcttaaaaattatgtaacttaagtttcttcctcattcttttccagattctgaataaaggggtgggtttgagagatggaaaaaaacttaaaatcaaaaggtagtctttgaaattaaacaccatcataccagcctgtgattttccaaacatagaaaaatctttttagcctacttccttcattaccaagagcaaaacaaaccaaaacagtagatgctaaggtataaacctgatgccacaaatgatacagatccaaacaaacacaaatatacacacacacacacacacagattcaaaaatcacaacactataaatcctaggaccaatgaatctaattaaatcccttttgtgtaatatccctattaatataggactagaagacatttcatactcaaaaatccaaaagtctaaatggcttccacatagtcaacaacacaggatttccactaactccaccacactaccatatgtggctttaggtagctcaaaactgatttccaaaatgaagtatatttttgagagtaacaactcccagagaaaaacaagggcacacatatagagttccatgctcctcaggaactgctaggtctgatcttggaccctctcttctactaggttcggccaggatgaatgtatctgatgagacccacataccttatcaagaaatggctggaaaaggctaaaatcgtttctcatgttcccattactacaaagtaaaagcatgacaagctctatacttaagtgttttgacttggtcaaacgctaacaccgggtttgctacagtgtaaaattaatctagaatgtaatcattgattccattttctttttattcttaaaaaaaaaaaaggtggttggggaagaaatcactgcttttccattgcgcaggtactttgtgctagagagcatgtgtcatttccagggtctcagaaaaagaacagatgtatctatgtgtaaacacaaacagtaagttacaagttgccccttagtactgaaggcaagaatcagcatcagtactcaaaaaagtgttttaaaaagagtgtaacttactcttactgacccaggctaaacgggctctgtctggtgcttctttgtctgcacatggccacccacagcctgtcttctaattaaatcaatgctccagcagcagaacaagcaaacaagttgcctcccatctacgtacagctcttcaggatacatttcccttgttcagaaggtggaaattcttgggagaggtgattttctctgcctcttcacaagaagaacatggatacttggttggatgcaactccatgaagcataactgtgtgtgtacacctcaaaaaataaaaaatgcagagaaacataaagactccataaacagctggaatacacagaaatactgaagcaccgctgggaatactgctaaacagacaggcaaaatagggtctttgaaatcatcaataataccaagttaagaaaaaaaaaaggaaaaaagagcacctaaggtcaaaactcaaatttcatgcaatgaaaacattgtaagtactacaaaagaaaaaaggtaaatcttctactttacatacgtagaaacacatcccactccccttacagagaataaaatatattatcaatggaagagaaaaatgagattttcaagggtggtaggtctaaaattagactcaccagccacattatagttaatgagcacttacataaatgtgagctaaatgcatcaagctgtctttccagtgtggtcagctgtactggggggcagggggtgctggggaaagagcaagggaccactctgcttatgaaaacataatttctacaaaaataaaaatgtacaggaaacgagatgctcgtttatttaaataattttaaacttcccaaatcacagaaacgaccttaaagtagatgcccctccttttttgcaataaaaaccaaatgactgaagtagggtagggagcagggtgtggttaagcatctgctcacaagaaaacttgttataagtttggtgagggaaaagggaaatgtatcagctctttccaatgtccccttccatcctaggtatgcccatatgccatcaggaagccacaccatctccatgaccactaggcatttcaaggactggcaggccttagaagtttcttctatccccctgaggcacacagacaattccagccagaagtataaagcccagggaagagaatatggcctattcctgcagctgcgcaagaggcctgcgctggggtcccctcacaataaactactcaagtgtgaccaacattcccattctggagatccctgacttaaagaaatgcagacctggctgggcacggtggctcacacctgtcatcccagcactttgggaggccaaggcagatggatcacttgaggccaggagcttgaggacagcctgggcaacgtggcaaaaccccgtctctactaaaaacacaaaaaaattagccaggtgtggtggcgcacacctgtagtcccaactactcaggaggctgaggcat[133 bp omitted]atatataataatataaatatataatgaaaatacctactttctttctcttacataccaaaatatcagtcatctgaacaagttattcttaaaggacttccctagagtttacaagcaagcaatatttgtattacacagagatccaaagacgatgaactgtttttaacagaatgactaaaaacttggcccaatataatctgccctataaacgctaaagcatttggacaagaaacgagttttaaccatgaattagcatctcccctgaccatagggagctttaaagcatgaattaagtgagtaaaaaacttcacagtccatttttaataacagaagttcaacaaaagatttttaacaaaggaacctgtataatttgccttttactacataaaacgtaaaagctattcctatcactattcttttttttttttcttttagacggagtctcagtccgtagcccaggctggagtgcagtggcgcagtctcagtgcagtctcagctcactgcaacctctgcctcctgggtcccagttcaagcaattcttctgcctcagcctcccaactagctgggattacaggaacacgccaccacgcccagctaatttttgtatttttattagagatggggtttca[139 bp omitted]ataatcagttttcagaatgaattaaccaaaatttctcaaaggttacaacaagatcttcaaaacctctgcgaaattcatcagttttctcacaaaagattataaattaccttccaaaagtctgtcattcatatttcacctattattactcattagacttttttaaaccaggtctttgtactttttaagaaaaacaccattgtgcaaaaggagcttcaggcagtattttataaatagttcattttctatcagaatccatgaaacactttctacttcagaaacaatcctaagaaaatggtggcatcatgactcacccagttctatatccaattttctcaaaaaagaaattcacattagaagttttaccatgtgaaatatgcaaaattatggtctggaatcttaaatccactgtcactacttgatccaaaactatttcaaaagcagccaaaaaagcaactggcattcaaatgtatagtcccaaatatgaagaccaaattctttcacaatattaatcttctctgctgtgagtgaaaccagagttgtaccatccagtgaacagaattcactttctcatcagttattaagataatctcaaaaaagctatatgaaacaacaggaatgaatcaacttaccaataaatcattaaaatatgatctataaactgacctttccatttccttccctacattttgaagataaacaaaatatactttggagtaatatcatttgcatttccacactgcagaaaacctctcatacagaagcagccaccttccctcccaaaattctaaagggagaaggtggtcaatttaatagataggaacttttgcacctgcccctcctttacttaaatgaagaaaacacctcattctgttgtccagaagtgacagtcttaagatgacatcacttgtctgtagtggtggtaaagaaaaataaaaccacacaaaattatcagtctctaagaaaagctaaaaaatgatatgtctgcatagttccctttagtgtgtgtggaacacactactatacacacacacacacacacacacatttcttttgccttgtctcttcctcctccactgcatggagttaagatcagtatacttttcaatatttgggaaaatacaaattatcacatttttaaaatatacggccagatactctttctaggcaataaagaccattaaaacatttcagtcatttcaatccacaattactatttaaggaattcatatcaatttcaatatctgcctaagtaataatataacgggcaagttttaaaaatatgtttatgtattgtttccttaagctcagtggcaagaacatcattttttaaatcaaaaagtatatcccaaagtctaaagagaaaagaacaatgactgtttgcatctgttcaataatccagacatgacttaactgaatagactgaccaaaactaagataagtgtttattctcaaattaaacataatgcattattaataaggctctccagaatttttctcagcacttttcagtattctgaaaggactcaatactgctacttatatttctctaagtacggcaaatattagaatccaatcttcttacatctttccattgacccaagctattacaatacttccccaactgaagtccatctgaaaacctatcctgttttaaggtaatgaatcacaattattcaaggtgagagaaactgcagggggcagtataagcatgatttgcaacataattcttaagatttaggaaaattcttcctgttagtgtaagcttaaccttaaactattaacatatatttcaatcaaagagtccatagaaaagttaattgttaaagataattgaaattcttccacaaatttaataatcaaaagttgaggccaggcacagtggctcacacctgtaattgcaacactttgggaggccgaggtaggtggatcacctgagctcaggagttcaagaccaccctggtcaacatggtgaaaccccatctctactaaaaaaaaaaaaaaatacaaaaattagctgggtgtggtggtgcatgcctgtagtcccagctacacgggaagctgaggcacaagaatcacttcagcctgggaggcagaggttgcagtgagccaagatcgcaccactgcactccagcttgggctacagagtgagaatccatctcaaaaatatacatatatgtaaaataaaataattgaaagttgaggtgtgggatgcactaaagtcacttggggaagaattctatgctaccattatccttatgacttattccaatcaaaaataatagaacaagaaattgttttcctttaaattcatatccacactcttaaaaaaacacaagttatccaaaactataagtccacttactcaggagaaactcattatttcaaaatgtattcttatcatctttaagtataaataagtaaaccccttaaaagtcagattcaacactaggggaaaatagaatgaaatattaaacatgatatataagtatgacttaggaaaattaaagttattctaagataaaaagagaaacttaattttattcagttttgcattcatggttgccattctagtatattctccagctactcaataaccttctttcccaaacctatgctgactccatgcaagtaattttcaactaacaattgaattagttaagttagatgaagccctctttgtgtgtctgtttggagtaaaggtaacatttggtggtaaatacatctatcttctttcttatgtcatttttctcctctgatcctcaacatataattaacctttctttgatgctgtaaaacttgtcattaatagttaccataaatattcatctcatacataccacttccaaagcacctcataactgtaataattgctaacagttatgggtgcttactacgtaccacacactgttctaagagactgtcctgtattagtcatatatgaactcagttaatcttcacaactctgtgaagtgggaattattatcctcataaatagggaaactgagtcaaggacagactgtgccacacccatggacacatggctaatgactggtagagctggcatgaaatgtatcagtcatattaggagggcatcacacatccccatgtaagattcaatagaactaggtgcccaccatatactttcaccttccttgactacattaggaccaatctgacattaccaagagaaattaaaatctacaaagcatgatcaaaagctcaggtccacaattaagcatgagaatatacagaaaacacagctaggacttttggtaaacacctgggcaattttcacaaggaaaggcatgaaagggtgcgtgccctggtatgagagcctgaatacaagggccacaacccagtcaacctggaaatgtcgcctttaactatcatctcctccctcaaactcatcattgtttcgtcatcatgtcttacttgattccctaaggagtattctcaaccagaaaaatatttttcacgataatcctctcaactgatagatacaaacctatcttctccaagtttgagcagcaagtcaatcttctgaagacctcaacatcccctgcacgaattcatcaagggtccaaatcaagagaactaagaggacctcactctagagtataaaaaattatagcaaacgtgagagcctccccactcaattattcgatgtccacagtaaactggggacaaacctaaccgtaacactgggacaaggcacacttcacagcacacaatttcaggacatacatctaaccgttaggttcgtgaagaatcttccccttctactttaggcactttggacagttggaatttatttttaaacaacagaacatacatcattttttgggggttaacttcaaggattttcctactgaaaatgagaaacttcagtatccaatcactaacttttgtattcacgaatctcacaaaaaaaaaaatcaagaaaagaaaggaatttaaccaacttttatattactcagaaaagtcaccaatgaaaataacaatatcataggcttcttcataactgtgctaatactggtgggcaacactggtcatataatttatggttgactaactcaacagtttcatgtcatttaagaacaacaaagataaactcactaatattttcaataaaacagagaaaagaaatacctcaagttccaccagtgctgcagtgactgcgtcagttgcaagagcaccggcctgcagcttttcaattgcctatgaaaccaaggggagagattattcattgcaaaatcacaacttctcaaactttccaaaagcttaaagaagtatgggagacgcttagattaataaaaattgaccactagttccattccatactttaagacataaactactcagagtaaaaacaagcaagtgtttatattcaggttaattggtaatatggctcacttaatattcttcaaattaaaacaataacatctagctattaaatgaaaagtacaaggaatttagttagcttaattcattgtaaggctattcaaaatagccacagaaatcgtatgacccagtttggttcaaatatcctgagaattcgtattttatatagataactaaatctcaaacgaatcatttctcctccccgttagtactctccatacctaaaaagaagtgactctgagtcacggggcgccagaatctgaggataaaagcacacatttgacaaaaacattttggatactataatgtaaattctaaatcaagatgtaacatattattttgtaatataaactacacagaataaaggtctataaaatcacctggccttgagcataaattaggagaggaaaagagagagaaggaaaagtcatttataaatgaattattaacatttcaatttagtcaacaaagagaaagctcaaaaactaagaactgtattcctaattaaacttttaagaagtgtattcattggaaatattaaagaggctaaatacacaattcaaatgtattagatttctaggactatagttatataaaatttattttcagatgacagaaaaatttcacactttgaaaaataagaaaaaatataaaacagcttagagaacttttagctttattattataaatttcaaaagaacaaaatccctgtaacaaaatattcttatttatagggcttcattcataagaaaaagcttgaatctctgataaagtataatctttttaatgttatgtaaatatcaatgaaaagagcagagagaaacgcatatttacttgatatacaatattcaactagattctatttgcataaaaagtaatggaaggtttgcctacaagactagtaagaatcaaaataaaaaacatttcttctgagtccattcctgtccccacattaaatattcaacaatttagcaaaacctcaaaaaccaatgggaaaaaagcacaactgagtacaagggcaaagctgaactctgcaatgacaatgaacttgctatgatacaaactacgtgatgaaaaacagaatgaaaaagtataggacaatctctcttaaaaaagcacccattttaatttttttatttatttttttcctttcatggaaaaacacactgactgccttcaagctgttttctctatccttctgtctacagaagttcaacatcgttgcaaagattaaaagagatatgattgtgtgcccacaattacaaaaatacagactttaatctgggaagtggggaaagagctaagcatcatgtggagaaagacacaaaacaacacaaaacgatcccctacaaaaacaagcaaaataattttgtagtccaaaccggaagactgccctagaaatgaaacttttaaatgttgaatttctttttttttttggagttgcatacatttttttaatccaaagaagtcagcctcctaagtattgcttaaacaggtttatcagaattaagtaggcacgacactcatactttcagaaaagcatttccagccaggggagtaacgtggcactcaccagcatgatatctgttttgccaacttgctgaggaacgagtaacctgaaatgaagaagcgagaatcccatcctcagccccccaacagcttcctcagcttctttttcttctgagtcactctgaaacagtcgctgcatctaagaccagcctcgggctaaacccagctggcctgaaggctcaactcacatcaaacagagctgggagttacttttgcgtgtgtccgcagtttgaagtgtcctctccgaaggtgaagtgggggaagcaggtgcgctctgggatgaagtgcagggaggcaaactctggctgggttcctgtaaacatccatggcagttgcaaataatcagaagacaaggccaggccatcggtgtgacgctgcaggcagatgaggtcttgggacgccccttgcgttcccccttctgtgggagcaggtgccttcccaacctcagcactcagtcccaatctctcttccactctcctgggtccaaacaggaacctctctgttggcacgaagcttttgaggggagcaggcaggcctcggaggcaggggagggtctcctcctggggaaccatccccgtccagatggtgcccccaaccagctgtggcgccatgatctgggcggctggtccagggcgtgggttgcggatcgtggagggaagaggggaacggcagtcgagaccctactccaagtacccatcaaagacgtcgagctccgagtcagcatcgtaaaggcccgagccggggtcggagagcacgccgaggtccacgagcgcctggtccatgtcctcgaacaggaagacgaggcccacgttgaggacgatgtactccatgaggaaggcgtagtacaggatcagcacattgacgaagaacaggcccacgtagaacatagagggcagcagcggcggcggcacgtaggggaccagggggcccagtgcgtccaggtgggccgcgacccgggcgccgagcatgcagccggtggcaagggcggcggcggcccggcgatcccggcgaactcagccgctgtggcgcccgggcggccggcgagggcacagcgcagccatccaggggtaccctggagcccgacagaagcagggccgggctccagatgtctcctggcaaatgcgccccgacccccgaaatgcgccgggcgggtcaccgcaccccgagatgtgcccccaaggctctttcgaccgccgtgaagtggcgggcccccttgaagtggccggcggctgcccggctccctcgaggcgcctccctggcgctcgcaggggcctcgcagagccggcggggatcccaccgcggctcagtgtctagggccggtcccggcagccctctctcccgcccggctccgcaggtcctagcgtccccctcccccccgcgcccctgcaggcccagcacccatggctgcggccgcggcgtcgtcctccgggtcgcgctcagagccactgctttatgttcaaaactgaaacgcatagatcatacacattgcgttgataccctctgacaagctcgtttgcatacatgtttatattccttggctttggattcagaatgataaactgcacctatagtagaaaataaaatccagttgttaattgttaaagtatcaagagaccttgcttatgttatataaatactccaataaactgatgctgtcctagtaaaaaacaaaactattgccctaactgtatggagttttatgacttctttctccaatgtaagcctttttaataccatgccttatctccgttttcaaaagctcttttcctgccaaaagccctaaaaatagctcatgtccccagaggcttcaccaaggtcacctcccctcttcttttcaagaagcttttttccaaatcaggagttcttttgatctggagctgacaacccagaaggtgtcagggacagggtccctccaggttcctctctgctgaaagcccctgccatttgggaagttactgtttcaaatccagaattcataagaataattcagaaagctggattgcttctgaacaacattggaagttgaggcatcttacatctcacatgtccacaaccaccaccaattgcaccattcctaagcaaacacttcacgtcctctcaataaagttgctagattagtctcatttcttaaaaagctgttttttgacaaaatgggagaaaattttcgcaacctactcatctcacaaagggctaatatccagaatctacaatgaactccaacaaatttacaagaaaaatacaagcaaccccatcaaaaagtgggcaaaggatatgaacagacacttctcaaaagaagacatttatgcagccaaaaagcacatgaaaaaatgctcatcactggccatcagagaaatgcaaatcaaaaccacaatgagataccatctcacaccagttagaatggcgatcattaaaaagtcaggaaacaacaggtgctggagaggatgtggagaaagaggaacacttttacactgttggtgggactgtaaactagttcaaccattgtggaagtcagtgtgtctaaatcctcagggatctagaactagaaataccatttgacccagccatcccattactgggtatatacccaaaggactataaatcatgctgctataaagacacatgcacacatatgtttattgtagcactattcacaatagcaaagacttggaaccaactcaaatgtctaacaatgatagactggattaagaaaatgtggcacatatacaccagggaatactatgcagccataaaaaatgatgagttcatgtcctttgtagggacatggatgaaactggaaaccatcattctcagcaaactatcacaaggacaaaaaaacaaacaccgcatgttctcactcataggtgggaattgaagaatgagaacacatggacacaggaaggggaacatcacacaccggggcctgttgtggggtgggggggagggggagggatagcattaggagatatacctaatgctaaatgactagtgaatgggtgcagcacaccaacatggcacatgtatacatatgtaactaacctgcactttgtgcacatgtaccctaaaacttaaagtataataataataaaatttttaaaaaaagttgctttttggtagtttatatgtaacactgtagttttatatgtacttgcaaatagctatagtaccagtaaaaaatgtgataaaatgaaactctttcacatgtgccaaaaatactttgatttagcgcttcattaagtgcatgattatctgcatcttttgatttacctttctatcttcacaattttcagctgagatacttagaggtcacatagtaaattaaggttttcttttgagagagtaatggggaagcagccccacttatcaagggacgtgtgcatgagttcaataaaaagtttcagatgtaaaaaaagttgagaaaaattataattgccctacatatacacatcatcaacaatttttcattcatggcatggacagttttttggtttttgttgtttttttgttgttgtttgtttttaaaggtgggattttgctgtggtcgcccaggctggagtgcagtggcatgatcttggctcactgcaaattctgcctctcaggttcaagcgattctcctgcctcagcctcccaagtagctgggattacaggcacccagcaccacatccggctaactgttgtatttttagtagagatgatgtttcaccacgttggccaggctggtcttgaactcctgacctcaggtgatccacctgcctccgtctcccaaagtgctgggattacaggcatgagccaccacacctggccacagccagttttgtttcacttatactcccacttcatttatatacattccttcttcctctgaattattttgaagtaaaatctacacatcatatcattttttaattaccgtatatgtatctgtagaagacaaggaatttttaaaaataaatatattcacaatgccattaaataccaaaaaattaatattctgaaaatagccacaaatccagagttcacattttcttgactttctcataggtgatttttcttctaggttttctatttaatcaggtaactgtttgctcatatttacattccttactgaacaatgtttaacttaaaactgacataaaacgcacaggatcttctgaccaaatgcttagtgcaagaaaaaacttcaaactgcaacacgaatccctccaaatatagaaaggaccagtattttaagaggtatgttaactaaaatgtggcaatgtaaggagcaaaacaggaagaacctttaagtcctaaacttacaagtcgatttcctagtcagtttccctggtccttccacaacaacctctggcatctgttttctctacaatggaggtaacaatagtagctattccagagcaggaaaaggcttagagcagtgctagaagagggtcgtggctatataaagtttagctatttgtatattttaacaaaccaccttttttgttgttgttgttgtcaataatagatttcttttcgaaaagtagcagcctcctgtctggggacacctgcagttccactaagtgaacattggtgtctgctcacctttgcctctatttctctcaataatatactgtcaagctctgttccttgatttagcaattttatgtacttttattttttttttcctttctgttttcctgagacatagtcccgctctatcgcccagtttggactgcagcagcgccatgatggctcactgccacctcacccccacccctctccggctcaagcaatcctcctacatcagccttcagagtagctgggactacccgccgggcccaccaggccccgctaatctttgtggtttttgttttgtttttcagttaagggactgggtttcgggccaggcgcggtgactcaggcctgcaatcgcagcaccccggaaggccgaggccggcgggtcacccgaggttaggagctggagaccagcccgaccaacatggagaaaccccatctcaaccaaaataaataaataaataaataagtagccgggcatggtggctcacacctgcaatcccagccactcaagaggctgaagcaggagaatcacccaaacccgggaggcggaggcccggggagccgagaccacgccactgcactccagcctgggcaacaagagggaaactccgcctcgaaaacaaaacaaaacaaaaaaacaggtttcaccatgttgcccaggcgggtctggatctcctaggctcaagcaattcaccgcgctcagccgtccaaagtcctgggatcacaagcgtgagccatgacaccaggccgatctattcctgtctgattaaaaattgggccgggcgtggtggttaacgcctgcgatcctaacacccagggaggccaaggcggtcggataacctgaggttggagtttgagaccagccttatgaacatggagaaaccccatctccaacaacaaaaacaaacaaacaaaaaacaaaatgagctgggcatggtggctcacgctgcaatcccagccactcgggaggctgtggcaggagaaccacccaaacccgggaggcggaggcccgttgagccaagacctcaccactgcactccagcctgggcaacaagagccaatctccgcctcaaaacaaaaagtgatcgggtttcaccatgttgcccaggcaagtatggaacgaactcctaggctcaagcgatccgccgcgctcagccgtccaaattcctgggatcataagcgtgagccaccatgcaaggccgatctattcctttctgattaataaactgggctgggcgcgctggctcacgcctgcaatcccagcacccccagaggccgaggaggcgggtggataacctgaggtcgggagtttgagaccagcctgatgaacatggagaaaccctgtctgtaccaaaaaaaaaaagagaagagagaccgggtttcaccatgttgcccaggccggtgtggaactcctaggctcaagtgatcgatcccccgcgctcggccgtccgacgtcctgggaccacaagcgtgagccaccacgccaggccgatctattcctttctgattaatcagttgggctttgtgtgctggctcacgcctgcaatcccagcacccccggaagccaaggcgggcggataacctgaggtcctgagtttgagaccagcctgaccaacaggtggaaaccctgtgtgtaccaaaaaaaaaaagaaaaaagaaaattagccaggcatggtggctcacacctgcaatctcagccattagggaggttgaggcagaagaaccatccaaacccaagaggcggaggcggcggggagccgagactgcacaactgcactccagcctgggcaacaagagcgaaactgcgcctcaaaaacaaaaaaaacaaaaaaaacgagagagaccgagtttcaccatgttgcccaggcctgtctggatctcctaggctcaaatgatccccagtgctctgccatccaaagtccttggatcacaagcgcgagccaccaagccaggcccatctattcctctctgattaataaattggcctgggctgcggtggctcacacctgcaatcctgtagcgggatttttaaggaattagatagactcatgggatttaggagaacatttattaattatttaggtgcacccgcccagtcggattaacatttaaaggattgagtactgaaccaagagttacctttcaagcattatgtggggcgaagggggagatctgtgcagggagaagcatattatagaagcgagaaacaaagatacttatttaattgaaacatacattatattattttttactatttaaggaaaaatatgttttgtgacttgagtttatttagtgaccttgcagttgcacagttagggaattagtcgggcatggtggctcacaccgcaatcccagccactcgggaggctgtggcaggagaaccatccaaacccgggagacggaggtcccgcaagccgagacctcgccactgcactccagcctgggcaacaagagcaaatctcccccttaaaaaaaaaaaatgtgactgggtttcactattctgtccaggccggtctggaactcctaggcccaagcgatctggcgcttgatgtctttaacctgtgattgaaagcatattaagatcttgggtgtatcaacagtccagaggtcaagaaggaaactcctggaatgtgaaatattctgcaacaagaaaggcaattggagaggtgactacattcactgcagttgttttgccctcttctttctcctctctctctttcctggaagtcccctagtacaaagtaaaagagataatggttttggagtgcatgtttttcctggaattggaaggaattttaacaaaggagcccttcacaatgaaacccccccacacccctgcttttcacctgaagtaggacaagatcggcgcccccaccatcattctccacgtgaccccaggtggggatggggggtggacactactgataacctcttagcaatttccttctttatggactctgaagctccttagcttgacaactgatgaataagttttcttttgtgggataagagtagataagaattttccccctgaattcccgtcctcgggccagggaagagagcccaggatcccttctcttggccttcacactgcgggaaagagtacctagagttaaaagcctgataaatgccctcaaacagctttgaaaatcacgaggtcaggagatcgaggccatcctggctaacacggtgaaaccccgtctctactaaaaaaaaaaaaaaaaatacaaaaaattagccggacatggtggcaggcgcctgtagtcccagctactggagaggctgaggca[156 bp omitted]aaataaaattgggataaaaaataacctgaaaatcaggaaacaggagaaacagtctaaacatttagttttgtggtcttgcctaattatttttcttatggtcaataaggaataatttataatgaccttattcctgagtacctggagacttctaagaagtttttaagaatagttttatgttgaagaatcataccacgaaatacttccaagatatatctgtgttgccatcctagttactataaaccagagaaaaatattttaattactctttttaatgaatatgtacaaaaatgcttcattataaatctagaatataggaatatgttcagtaattgatttttgcaaaagtctgttattattatttttccctaaagcagggagagaactgtagcttcataatctgagatatcaggtaaggaagtcctcccctattctttcttaaggaataaactttttatattcctctctccagtctctcagagacagcatcaaataactcccctatcctctgttggctccatcctcgggggcgagtgctatttcacatcttactcttaaatcacttttaagaaatagacatagcttccaccaaagaggagccctcccaacagacctctaataacaccaaagggtttccatgtgtgcgcccttaagtgaacatacacaaatgaaatgaatctacagattggttatgaagccagtttttatgtgacacatgaatatcagtcatattagacacactcctgccgagtactgtaacaaatctcttcatttttaccacatacatgaatagctgtcccatatattcataaaatataagaatttttttcttgattaataaacttcattttttagagtagttttagactcacagcaaaactgagtggaaagtagaagagttcccatagactccctactcccatacacacacagcttcccccactgtcaacatcctgcaccagaatgatgcatttgttataatcgatgaacctacactgacgcatcactatcacctagagtccatagtttacattagggttcgataaaataattttttacaacttaaatcccccaataaacttaacattacttctctgggccatacgtttttctgcatcagtaaaatgggataagaatatttatttggagctgggagtggtggtgcatgcctgtagtctcagcttcttgggaggctgaggtgggaggattgcttgagcccaggagtttgacgctgcagtgaaccatgattgcatcactgcactaaagcctgggcagcagactgaaaccctgtctcaaacaaaacaaaacaaaataaaacaaagataacaaaaaggtaatatttatttggaaggttttgtgagtattatttgggatacattatgaaaagtgctagcacattatgagtattcagttatggttagttaactttatcattaagatcgttataacctgtaggaactgaccctgctaccccaatcctgtctttgaaggagcaaacccatatggaaataaaaatgaccggctcccctccctgccttgacctgtcatttgagtctacctaattataaaatgaacagggttttaagttttgaacctattccctgtcatggtgggtagaaaatcaatcactacacccctatttatagaacaatcagaacagaggaaaagacccgattttgaattccagccatacattaattgtgtgcctttaggaaaatcacttaagcctgttaacattcattttattccactgaataataatacacgaaagcactttatatacttgaatgaactatgctcatttacagggttctgcgcatgacactgcatctgtaaaacagaaaccaacaaagtgagggcagaatgaaaaaaaaaacttccagaatgttcttcctttcctcaatgccatgcagtttgtgcagtcagctgattggctgaaaagagtcagttttgacgactgatgcttcctgcttatgtttagttggtttaggaagctcattaggatgctatctcggagatgagtctggtgggtagaatatctgatgactgtaaggcaaatgtacttccttcagctggtgaattaatttctcaatagactcaatttgctttttaccaactgtctggcaatatccgatatttgcaatagtctttcaaacacttgcaataaaatctggctcacacacacaatctgttagtggtgaaagagaaacattcatcacattcaaaattctccaaacatgagagcagctgaatgtgctttaagacagtatacctaatgatacatctctattttccccttcctcttacaatcatttacacagatatatgagaggtaaatatgtgtttagaaagtattagtcatcatagatgtacctccagtcatctattcaactgtaatcatggtaaaatatgcacttgtacaactttatactatcaatgagtataggtaggtgaaaattagtgttgccagaaaaaatccaaaccagaaaactgaaagtatagaaaaattatacgttatgtcattgataaaccatttaaaaataatgtcacgtatagaataaaaaattccgtgaatatatacatgcaaattatacatatatgtgaatttaattttattgaaaggtaattggcatctgcaatttcatgcagtctaagtgaaacccataaagaaatgtgtatgaaataggaaagcaacaaaagctcataacattttaaaattagaaatcagattcaaaaccaatcatgatctattttaaatttctccctataacatttcaattgagacataaaacacactttatacaacatgcctcactattttatttacagcatgacttccctttccccaatccccaaaccatgttcccatctacaccgcaccccacccaactctcacctcttccattagcattattacaaacatattttacaaatcttatatcaagcttttccactctgtctcttttaaatgtagaaatatcttatatataaacccgaataccacaaatcttcacatttatattttctaaagcagttaaatcgttatagacaattctacctaaaaagcaaaatgcgcttgacaatatgtcatgttatgttaagttgaccagacacagaagtcatttctgtcggatttcttgtcgatgtttgcattaagttggagctttctgatctcggctcctgttgtgccagtaatttgaaaggtcacctctctgtt[147 bp omitted]cccagtctctactaaaaatacaaaaattagccgggtgtggcaggcgcctgtagtcccagctactcgcgaggctgaggcaggagaatggcgtgaacccgggaggcggagcttgcagtgagctgagatcgcaccattgcactccggcctgggatactgagtgagactccgtctcaaaaaaaaagaaaaaaaaaaaagtcttgtaaatttgtacatagaatattgaagttagaagaggcttttcactctctgggctctaatactgcccagaggttgtttcttgttcccataagaaaatcctgtatgtctctccattaccattcctgatccttacctccaattcaaaatgtggccagttccaccttctaagcctttataccaaattgactgggtaggtttattatgaatctgtgtccttgtccaaactctacattagacctcccaggagagttcaaactaaaaactaatgagtaagtgcaatattacaattgaaacgggagcaaacataatttcaagtaggactcataaaaactgtgggaccaaaagaggaaaagtgcacgccgaatgttctcagttctgaaatggctcttgtgaaatatctatgtgaaaacacttcaaggacctaaaaaaaaaaatggtgaaaaagcgaacaatcttccttgcaaaacaactccagagttaatgccagagctttctatcaaaacatccatgctaaattcaccggaaagattcagaagatcaatgacaggagtaagggaaaaacaaggacattttgtgagtggaacatataatgaccctgtagcaggagacccagagagggggaaaaaagaaacggagggtgtaagtaaattaattgcctgtaacatgtttaatgaaataagtagacgtgtgatgcaaacttcttaatagtcaaacattatgcaacatatgatgcataagaattgtactatctcaaatttttttaatgtgagattttcttgatgccactttcatttacctacacacacacaaatggcacaaatcacatatacatatactgacacgaaaatacatatgtgggagggagagaaagagggaggaaaacgttaatcatgatacattgccagtgtaagaactcccttttggccgggcgcggtggctcacacctgtaatcccagcacgttgggaggcggaggagggcggatcacgaggtcaggagatggagaccatcctggctaacacggtgaaacccagtctctactaaaaatacaaaaaaaattagccgggcgtggtggcgggcgccggtagtcccagctactcgggaggc[144 bp omitted]ttattcaacttaccaaaattttaattgccaatgacacagaaaccagcacaaataagaacttgtaacttacccaggtacaagtgaatttctatgactgaaattcaggggcattctaagcaagaatagttcaatagaaactaatctcattatttttcatttttatgaagtcatatttattattcgtagtgtggtttctcatcaaggagttatttaacatgccaaatgcctgcacctctttaactaggtctttatgcatagggaatgtttaaatatccacaaaagtaatacatactaaccaattttttagattttaacatatatatttgaagatacgttttccccaaatgtacagttctttgtggcctggattgcctcaggaaactgcctctgccttttgtgggtattatggcaagcaagggcactggtaatttactgctgagaaaatgcctagccgtttgcctgattatgccacgtcatcttcctgacactacagagcacggtaacctcatttccaaaatcaaagaacaaatctgaacggctactgttcctgaggcaaacaagtgaataaattccaaaacatgccatggactaattgaagatgaatttcagacaattcttttttttttttttttagatggagtctcgcactgtcgcccaggcgggagtgcagtggcgcgatctccgctcactgcaagctccgcctcccgggttcacgccattcttctgcctcagccttccgagtggctggggctacaggcacccaccaccactcccggctaattttttcgtatttttagtagagacggggtttcaccatgttagccaggatggtctcgatctcctaacattgtgatctgccctcctcagcctcccaaagtgctgggagtacaggcgtgaggccctgcgcccggctggattttagacaattctatgtcgtctgttgaatctatcatctgttgaatcagctttctagtaaccacacactatagaagtgaaaccaacctgtactaccaagagtgtattaattttgcatgcatttcctagtaaacaatgtagacagtattaatttttatgttgccaaggtcatagttttgtccctcaagtcatctgctaaattttgcctcacctggctcagtcagaaggaacagaattgacaatattaactggtctcagttatctccactgacataaaaaaaaacgtgtattttccacacggactgtgggaatcagcattttctgttattaacttagatttttttcttgccatttctctttatgatcccaatgtattgatgtatttctaacactacaacaagatttgtgtcactcaactgtatgtgttgtaatcattatcttttaaccatttatctccatgaaactgatgtcattgaaagatagaaaagagaaacaaaaagcatagaagggagagagggagggagcaagactttagtcatgatacaatgccaatgtaagggctccttttaagaaagattttaaaaaatttcttcttcaaaatttccattgcctccttgaatgaactgtgaaggattgcaaattcctttaaaacttggttttggcaatgactctggatttccttcattagccagctatgcagaattcattttccaatgctctattaaaaataaaaggccgggcatggtggctctcgcttgtaatcccagcactttgggaggctgaggcgggcggatcacaaggtcaggagatcgagaccatcctggctaacactgtaaaaccccgtctctactaaaaatacaaaaaattagccgggcgtggtggtgggcgcctgtagccccagctactctggaggctgagacaggagaaaggcgtgaacccaggaggcggagcttgcagtgagtcgagatcacgccactgcactccagcctgggtgacagagcgagactccatctcaaaaaaaaaaagaaaagaaaaagaaagaaagaaaataaaataaaaataaaaaagggaagattcccttaatgtttcccagtctattaaaggtttccttccaaaaggagctcattctgatcccatttagtactacaccctcgtgtatgccagatggcacaggcatcatagcttcacaaatgtcattctgattctcacctttaaaatgaaattcccttagtctacctttctttacataaactacaaaattgtagacaaagatatgccaaattaaaagcctcttttgctaaacattctagaaataatttgagaaaaatgggcacaatttgagaccttagttgtcttggaaagggggtaggtgggtatttgactatgattctggtcgctatttctcctgataactatttaaatgtgtgaccttaaaagaaaatcattcagtcttgttgagactaatgtctcatccaaaaaaagtacttaaaatttctcctatgtgtcttatagcgcaaaaatgttcaattctgtttcaagccattctaacatttggtttataaacaggtattacatcatcaaggcttactgcaggcctctgcgatctttatttcaatttcattcctttttaggctagatgtaattttgggattttaaaaatggaattatatgttgttatgggttgaactgtgtttttcccgaaaatatatgctaatgccctaacccccaatactttagaatgtgaccttatatagaaacagagtctttacagaggttgtctagttaaaatggggtcattagggtgggtactaatccaatattactagtgttcttataaaaaggggaaaattgaacacaaggggaacatgcacagagggaagactatatgcagacactatatggaagactgggctgacacatctgtaaactcagaaacaccagtgatttccaacaaaccaccagatcctgggagagatgcaagagacacagacagcctccctcatatccttctggaggaaactaccttgactacatcttgttttcagacttctagcttcccaaaccgtgacacaataaatgtgagttgttttaagccacccggtttgtggtaccttggagagcagctcctacaaatgaatacattgttatagactaaaaagtgcatcaatcataagtgtacaatttttataatctttcaatatggactcagtcatgtgaccaccataaacaagagcacctcagaagcctctttcatgcctcattgattttcttctaccgaatagaacacttttctgacttcctctacaatagattcatttttcctgaggaaatttctatgaatgcaggcatatttgtgacaccacagatgtagcagcagttctttaattgctgtattttattccactctatcaatgatccataaaatatttttacattctgctgttggtggacaattgaactgttttgagtgtctgcatataaaaataatattataatgaaagtcttttggtgtaaaaaattcccagtcttatctgttgggtatatacttaaatgtagaatggttgggtcatagataggtatctgtaaaaccaaactgtgttttattaatctactcatttttcttttaaatattaatgtataatttacacataacagagtgtacagatcttaagtatacacctcattgaattttcacatagcttcatacatggaacaact[134 bp omitted]tctactaaaaatgcaaaaattagctgggtgtggtggcaggcacctgtaatcccagctactcgggaggctgagatagaagaattgcttgaacccaggagacggaggttgcagtgaacccagattgtgccactgcactccagcctgggtgacaagagagagactccacctccaaaaaaaaaaaaaaatcttacaaataccccataaaccttcttcttgccatctcagtcaactacaacccaaaaaaagataactcctatactgacctctatttatatagattcattccattaatgaattaatgttaataggctgttaatgagcttcataaaaatagtatcatgcagtatatatgctcctgcatatggctgattttattcaatattaggttttcaaaatttatgagattcttgtatatacctatagttcatactttataattttaataggggtattccattttatgaatatataactgtgctattggatgattcatctgtttctaattttgggctactataaataatgctaattgaatatgttatatatatcttttgttagactgaagtactcattgatcttgagtatatatacccaggagtggaattgctgggtcaaagggtatgcaaacatttaacttcagtagatctcgccaaaagaattttcaagatggttgttcagattcacattcacacaacagtctataagagtggtagttattccacatcttctgaaacaatcttctgaaacaatcttctgtattaaaattctggatttaatctttaaaattctggatttaatatttttatatttgtactatctttttttattcttatttccttttttggctttttttttttaatcgctctgttgcccctgctggagtgcagtggtgccatctcagctcactgcagcctccgcctcttgggttcaagtgattctcctgcctcagcctcctgagtagctgagattacaggcatgcgccaccacgcctggctaatttttgtattttttagtagagatggggtttcaccatgttggtcaggctggtctggaactcctgaccttgtgatccacccgcctcggactcccaaagtgctgggattacaggcaggagccacttcgcccggccttttttccatttttagaataattatttatttttcattttattaaaatacttgtaattcctttttagtacttttagttatcctacagaatatttattctagactattgtggactaccttaagtaccttagttatcctagaggatataatatttattctcaactattgtggactactatttctgaagtatgttcgtactttttccacttctccaacaatgtaaggaccttagagcagttgaacactatttagctactcccactctttgtcatatattttattcaacatttaaactttgtaaaagacaagttaattatatttatccttacttctcaggtttattttcatggtgaatattctttataaattacttttctttaatatctttcggatttttgtgtcaatgattactggcttcccacaaaaaaattaaagtgttctttcttttgtattatttcctgaaaatgcttgtgtaagactagttcaattagttccttaagttttggtaaggattcaccaggtaatccacatgtggttggaattgtgtgtgtgtgtgtgtgtgtgtgtgtgtaaaatgtgttaatcataaatatagtttctataatacatacagaacttactcagatctttagaacttcttgtgccaatattttaaggcttttatttcagttaatttcattgcttcctctaattgtatgcttctctctgggataattttttcttagtctgaagaactttccttagtatttctgtagttcagttctcctaggcaaacattctctcaacaattacttgtctgaatatattttactgcgcttcacttttatgtgttttttcactggttattaaattttagactggcaaatttgcccctcagcatgttaaaatgccatttcattgtctccagcttctattgtttttgttggaatacttatttgtgctcttttacttacttttgagagttttgttttggttcagcagcttataatctggataggtaaagttttatttgtattatattccttaggttttgttaagtttcttgcaagtaggttgatattctttatcaattttacaaaatttttgaccaacggctcttccgatattgctgcttctccattctctctcacttgtctttatgtccagtttagttatagtagatgttgtgacagtgccttatgtcttttttgttctgctttattaaatctcttcagttgagattatttctatagatcaatttatattatttctatgaatctcttttcaggttaacttgttttactacatttattctaaagcaaacctattcagtgacataagttcaattattatgtttctgttttagaatatctgtgtgactttttacagatatttaaatcttcgctgcactctccatcatttcatccagtttgcctacttttattatattagcaacggtcattctaaatttgtctgctaaattctgaactgtgaatcagtgagctgtgcttattgtgcacatgtgttttgattaatacaatttttgccacttcacatatctagacgttttttgtatcatgctggacattgtgtataaaagaataataaagtattctgataatagtagttttagaatgtattcccacttttctctattaagcagatagtgttgggagaaagtcattaccaatacaatcagatattggagcagtcaggattcagttttagtttcagtaagactggcatctttggcttatctctgtttctgaagtttgttccttttgagcttttgattgagagctggttggaactacttctcattagtctcaaaaaatgttgttggagattaaattttaatttcaggggtattgggcttagctctttagcatttcaccctattcagcttcaaaatcttagaaatgtgttgaacaagggagttggccatgcttttggggcaggctctcttctttgcaatgagtttgtctcccagttgctgtgatactcttgaagattttattctgtctcttgaaatcttctggaataactcctcattcttgcatatatcacaataattcagtcaatatgcctcagggaaaatatcttttgtgtgccactgcttattttacccctaatccatatctgggccaggcccaatcctcagccttcacccataattataaaagacactcagagaaacagtcagttcacattggaaggttcattaatctatacatttttgtggacctattttgacctatgcaactttcttgtcattcactttaagtgctttatgcctaatcaaatggcctttcttcaatatttttcccaaagcatctcaatatttataaaattatacatctcatgaagtttttaaaggactaaagagatctttcaaacgtacatatagaataaaaagtcatgttatctttgtttgcatgctcatcttgggaaggaatgtactactcaagatttctttttttttttttttttttttgagatggggtctcactctgtcaccaggctggagtgcagtggcgcgatctcagctcactgcaacctctgcctcctgggttcaagagattcacctgcctcagcctcttgagtagctgggattacaggcacatgccaccacgcccaactatttttgtatttttagtagagatggggtttcaccatgttggccaggaaggtctggatctcctgacctcgtgatctgcctgcctcggcctcccaaagtgattggattacaggcatgagccacggcgccaggattacttagattaaaagcatgctggaattggttcaacaaggatttaagatggctgttctaaacaggttttgctaatgatattccgagtcctctgacacagtaatgaaagtaaaaagttcttgttagtataataatcattctgagctattagtaatatatattattgagaagctaccctacgggtatttagaaaccctggacaagggagaggcagtagatttcaaccaacatattctgaggaagcagcttaaaatgtgacagcatatcttgtgtttaggtcaattggtctaaggtaactcaaatgtataaatcataaagctttagagatgttcttggagagaaatgtgtaataacataggtgtcaggaaaactactatggaccactctgtataaaaggtgctgggagagtaatttactttggcccataaggttcaggttaacagagggaggaacagcaaacaaatcctgagaaccatataggagtgaatgacagacagggataccagcatctattatcaaaggacccagaggaaacggggaagaatagagaagagctgagtaagtcagtgttcagtaggttttaaaagaaggtaactatcaaaggagaggaatattgatctcagaaacatcctttcacctggagagtaaagatggcatcagaaggagcacaggcaaatgaaaaccttggtccctccagcattgtcttatttctttcttcacaaagtaaaattttgttgaagactcaaattagcccaataatttcctggcctggtgtacattgtgaaagataatatttcacagtgttctatgggtgtatttgtgcttttttctttaaaaatacaaaaaaacagtttttaatttccacatgaataattcattatcattataaaattttagccaatatagaaaactttgtgattaaataaaaactttatacatttcaatgttaaacatccctcatagggcttttatccctgtttactcacaatttgttcatgtccctgcaccaggcatgtgcccttagacagttgaaacctacttagatgtatctgctattctagacctatatctggtgtttggatgcttagttcggctcttctaattcaaggaatattaatctttaatgcattgaatcctgagtaccattatgtatgtttctgcttcttgaaccctgtttaagagacccctatttagttctatcaggagagaatttaaacaacaaaaggaacctggtgatgtttttaaataattgatttttttaaaccccatataagttcaattcatattttaaaagttaatattctaatttatacgttaagtaccagtatcttttgatacatatatacaagaggcagcatgaaaaccagtgtttacttttggtgcaaactggcttccttttagggctgctctcacctgctttcactcatgctttcatccaagtgttcagtatcatactgttttttagctgttccctccagctttcctagaagtatgcaatcaccccccccttccattataattctttctcaatcaatactacttttccttctgagtaacttatcctttctaaccattaggaaaaaattatggccagttgattaaaccacttaagagttgagtggaaagacttatttctccaaaattgcacttaaatattaacggaggagactgtcaattcagagccatctaagcaccacgatggcctcctcttctatattgtaccctgcatttaaacagttttcatcacatacacacaaatgcacacagatgcatacccacatgcacactccaacttttcctttccatttctattgttagtatactacttgtttaaggcagtaacaccccatatgttttaatgagttttttttctttctctctactcaaatccattttatgatgtagaccagggattgagaagcgtttcctgtccagggacagatagtaaatatttttgactttgcaggtggcacagtctctgtcaaagccatagacattacgtaatgaatgaggacggctatattccaatgaaactttgtttacatgaatgagctgcagactagatttggcccatcggcagtagtttgttgagcctggatctacataaatcttactgattgcagattttctcacattacttattacttaaaaataaaatcaatcatctcatttcttcaacaaacttaaataatttgtcctaagtgcaagacatctatttacttgtcctgtgatttcactacagaataagatgttaaatttaggctgacattgagacacattttcccgttgtctttttcatatgcttgcaatctagtgaaaataaactattgacttctttatatgtctaatgaaatattttgcttcctttctaatgctaatctctgtatgttactatccaaagtccaactcacatatacctttcctcaaatgctaattggatgaatttctccattaggaaaaatttcacaacattctactttgcactataccattttgagggcgtcaccattttgagggttcatctcagtgtctagtacagataacataatgtcttacacatcacagttgctcggaaagtaattgttaatgcttaaataaaacaactctgccagtggttttcctactgacttgaactaaaaatcttgttcatttaccacttctccctctccttttctctctttccccctccctttctctctcccatctctctatcctcctctcacccctattattggtaggtcctataaaatcttaccttatagaatctcacattcttttacatcattcacactgctaccatccaaattcagatctttcatacctcttcattggactattaaaatagtcgaattcctttctgtcattatctccatgccaaaccatctttattatttatctatttatatgtaacatatcacccccaaacttagcattttaaaatacacattatttcaatttttgttggtgggaatccacatgtggattagctgtggcctctgactctcactcttttaaaagtctgcagtcatcttaaggctggacagggaatgatttatttgcagactcactcacatagttgttggctttagttttgtgccaggtgttgtgctgtaaactcccttggttccttgtcacgtgggtctctccacaaagcatcacacaacatggcaactctctttatcaaagcaagcaagcgagagggcaagaggaaatgccagcaagagttgggggtggctagcaaggggcaagacatagttccttgttagctaaccaaggaagtaacaccgcattacttttgttgaattctgtttcttagcagcaaggcaccaggtccagctcatactcaagaaggggagataatacaagatatcgggaggtggaatcagaaacatgggagctgtgtcagaagccacccatcccaccactccagatagttatcactttcttctattatgttatttttttccccttaaaatacttaaatgacctagagtagtggtctctacagttttttttttatcctgctcttcactcccagagtatattagttgatgcagcagtttgtctctcttcattatcaccaaactcacacacaattcatgcatgtggtagagatgctctgtgtatgcataagtctgactcttcagaatccctgttattgacatgtgagtgactgttgctatccatgagccattgaatttctactatcctcattctcagtggtcaaaagggttgattgctttctactctctacttctcattgtcacctggcttctgtaacaatgttcctgcctatacttttttcctttttgcaatgtcattttctgctttcttgtgtaatttcaagtaaaaagaacttttttaaaacagtttctaccgtggggtcctcctgaacagtgtgacttctctgcccaaaacagttgtaacgtccagctgttttcagtaatttttcctagttggagctcaaagaataacacgagagaactaatttttttttcattctgtccagactaagatgggagggctgataattctggaaaactattgcagggattgctaagattttattgcatgaatacgtctgtctttctttggatgcctttttttttttaaagcacaaagttaactgtaataaggatggttatttatattgtttatttatatgtacctttgagatttcaatttttgttaaatgaatatttattaagtcattatgcactagaaaacagagaaacaaaactgaaaacaaaaacctaaattgcgaggatttttcagtactactgtaactatatgcaaactcaaagcagtttttttgtgttcggtggcgctctgaaatcctcttctggatatcttgccaagtccagtattgtggaagatggcgttatggtccagatcactgcagagaacatggattccttgaggcaggcactgctagagacgagggacttcagcatcacctgtgggaaggcagacgcggaggatccccaggagcgcatgcacatccagtgagtggatgatgacaagaacgttagcaagggtgtcgtaagtcctatagacgggaagtccatggagactataacaaatgtgaagatattccacggatcagaatacaaagcaaatggaaaagtcatcatatggacagaggcgttttttctagaaaacgattcccaggatttcctagaaatcctagtgctgggattacaaggaaacgatgaccggcacaattgcctcagtgatcctacagatcacagtagattgactgagcatgttgccaaggctttttgccttgctcctgaagcttctgaaggaggatggaatgaccaaactgggactacgtgtaacacttgactcagatcaggctggctatcaagcagggagcagcggccagccccttccctcgcagtccatgaatgatttggacagcgccttggtgccggtgatccatggaggggcctgcca[148 bp omitted]cccgtctgtactaaaaaatacaaaaaattagttgggcgtcgtggcgggcgcctgcagtctcagctacttgggaggc[132 bp omitted]gttaacactattaattgggcggggaatagggttggagtgggggtttgggggatgggtgggaaagggtggttggggggacagatgttccataattctaagtcttttttctatgcactctccaccaagaagatctgggcagcttctgttcctgcacaacagttatgctatccttacaggtaatccccttctgttactgtttagacaataattccgctcctctctcaagatttacttacggtcatgtgccccgaaatgctcagatgggcacaaccatcaccaagggtgggatgggagagcagaggggaaataaaatatgaagcatcagttaaaaataataatactaataatttgaaaaatgtttaatgaagacataactttgtagaaaaaggcacacctaaagaaggttattcaagacaaaattaagaatatatttgctaatatatgctttgaattaatttttgatgtttcttatgtatatatttaaaaagcaaacgtatgaattttaatcattttttattcataggaaatgtataggggttcataaatgttgtcagtatacttctctgaccttatatattcagttttgtccccttgtttacaatctgactgagctgtaaaggtgtaaccattaaccaatcaaagtgaacattaaaaggtcagtgcattacatattttagctgcttcccaaaaaaatgggtaagacattcaaattttggcgtatttttgcaagtccaaacttgtaaaataaatctgtgattacataaatgagactctggctccctgtaaaatttgtaaaaaacatgagaaggaagttcaattccctgtctttccctttttattatattttaaagtcagtctccaaaattccagtaagttgatataggaagtactccagttatcaatgtcataacaaccttataaatattttccaggctgcaagtttcaaaataagaacttccttcctatttacaaattagcacatggacatactttggaattgtttgtgggtatcaaataactttttatttttgcaaatatttgtatcaataacttctttcctgcctcagcctcccaaagtaactggaattacaggtgcccaccaccaaaaccaaagagtgtttatttattttttatttttttttatgtagagacagggtttctacatgttgaccaggctggtctcaaactcctgacctcaggtgatcccacctttctcggtctcccaaagtgctaggattacaagcatgagccaccccacccagccagtgtcaataacttctatcatgacaattatccattttggccatcagttatttgtaaataagtgataagacattttgccctcatatctgtttgtgatcaaaggaaaaccagtaccaaagaatatttattttctgcatgatcaatgtgattggaacatatatagtgtctatattctttgttattactgtgaaaaataataagcaaataatttgtgttttaaatcatttgtaaaaattttttttgttgccaatatattttaaccattctgaagagaaggctaaaaaagatttttgcgtttttttttgaga[259 bp omitted]caccgtgcccggccaggtttttgcctttgtaagaacgaatgtaaggaataaaattagatggctaaaaatgggggattggggaggggaagactggcctattgattaggagaaggccaggagtaaagtctgccagtaacattaaagatatgaaaccataacctttgttatacaattttatccattgcataacagcaatggatgctgtttctgtgctgaatggaaggtgaggtcatagcaagaaagctgcctacaaggcctcatttacagggaagttttgagaagctggagaaaatctgagaaaaagcatatatgatggttggaattaaaccatctacagaaagtatgttctaatgtgttaggataagcacctaattaagcaccagcaggctgaagcaagcagaggcatcattggagctatgtgttcacaccgtgctgtgactgagaagaagttgaaggcggtatctcttcagaagtttcaggcatccgggcatttgagaggccaagaagtctgtggctgctaaaagcaaaagggccagcagatttaaataaataaataaataaataaaaataaaaaacgttgatttttaaaatctagaaaatgtcactgcgagcgcaaggtaaattgtcactgcaaagataaaaggcaccctcatttcctaagcttcctgttctccacatacaatttattttttaagatttctgggcaaaagtaattactgcttgatctgcattgaaaactattttaattgctatatttcagtatagcatgtgacatgtggaacattgctgctatcactgggcgaatgtcagagtccgtagatgtgtgatttgttgcaagttacttctagcaaaggctgaactgaagtttctttcttctctgaccttgattatgataattgaatgaggtaattggatgaaaatatccttactttcatttcaaccttaattttttccttaaaaattttataagcaaatacatttgccactttcctgacctttcagcaattttttcagaaaataacacactttccatttggccactatcctatttaaaaggagccatgaatatcttgcgaatgagagaaaaggaggtcaggcacgaataagatgtgatgacatttggaagtctgaaagcgaatagaattgtcctgacagtctagctaaggagaagagacacaccactctgagtactcacaatgccaatgtagtggcagtttttccaaaaatcactatggatgataagaactgggaagagaagcagaattcaagaagattgaaaagttgcatatggcaacagctatgtgggtcaaccttccacatacttcccctatcgcttccgttgcctatagcctttgcacaaaggataaagtcacataaacattcttgagaacaacacgatttgtccagaaaaggctcagtgagacatagctgaatgatagttagatttgacgggttaatttagcaattacttgtgtgacttctcatcaaagagcagatgtgagttacagcatcatcataaatgatggtgaacagatgcagacctgaaccagaacttccacccaacccccacaaacgtgtctccccactgtgtgactaagcccatcgtctctggaacaactggtaggaaagtgtgagtgggatcatcaaatcaactacaagaaaatcgaacaaaggattctgaagagtagaactgaggttacaacagaaatgtattcaataatacggaaaataattatgtctatctttttaaaaagaagaaatactagttttacttggacatatgtggttgaaggagaggggctgtgggcatctatcctccccttcaatggcaaggtatcagtaactgctcaatagaagaactagtggtcttttcagaaactttactgttgggattaaaaagtatgctagtggacaggaaataatattaccacaatgatttcaagatgaattaaaaaggcaaatgttgaaagctaaatttcaaattcatttgaatatgaattgatatttacataatctggagtgaggcagagcctgcatagagctggacaccataagggaaaggactatagattaactagataaaatttcacatcgcaattttccaaacaaaattttatcctgtttagtaaacatcacttaaacacaattttaacattataaatatatctgcacatatacatgtacaaatgtgttatttatgtagaaagagttaaaacagatcaacagcaaaacatgcatttttgtacataagtgattaacaagggagggtaatgtgctttttttttcaaaaatagtcactagcttgggcacagtggctcacacctataatcctagcactttgggcagaagtgcttgaatccagaagtttgacatcagcttgggcaacatagcgagacaccaactccacaaaatttttttttaaaaaagccaggcatggtggcacacacccgtagtcccagctactcaggaggctgaagcaggaggattatgtgagctggaggtcgaggctgcagtgatcaatcaggccactgaactccagcctgggtgacagagacttcatctccaaaaacaaaaaatagtaattaaaaagaaaggccctgctgcaaaagaagaaaggcagtggatttgtcatacagtctaacttttatgaagagtttacttactgctacttttaaagggtatcttacagtctgtaaattggcagatggaataatgacttgtacttccctcttatgagtaattaaagcaacttatttttgttcagtgcttcaacaccttcatttactgtctgattagacaacttttctagaatctgctatctgcaaaccctcctctcatatgcagatctacaacgtgtgaatataacattcctgattatatcatgaccactcccagtgggctctgctggtagcttgttttgtataggtatagatccagtgctttttcctctttattctttttattgagcgctcttatacatatatggttatgcagagataacacactgtcaatacaaagattttcagaatttattggacaaaatgacacaaaactaaaaatatcatttacacatgaaattcaaagaacgcattatttttccttacaaaattgtggaaaaattaattcagatagtaacatagaactagttctaaaactaaaatgctagtgtgaatgtatacaggagatatggtttgactgtgttcctacccaaatctcatcttgatttttagctcccacaattcccacatgttgtggcagggacacagtgggaggtaactgaatcacggaggtgagtctttctcatgctgctcccatgagagtgcataagtctcatgagattggacggttttataaaggggaattcccctgcacacatgctctctctcttgcctgccacaaagatgtgactttgctcctcattcaccttctgccatgattgggaggcctccccagccatgtggaactgtgagtcaattaaacctctttactttataaattaccagtcttgggtatgtctttattagcagtgtgagaacagagtaatagaacaggcaaaatgaaggagtttattttaaacctgctttaaagtatttcgtggttaaagtatttaaaaccttttcttctatttttaggaaaacaatgagaaagctaaacacaggtctaacttgttattcaactaaaaattattttaaaaatatttgagtacagacttctggcaccagccaagacaaagcatgctcaccaaggcctatttctctttctgactgaaattaaaactctggacataaaaagcaactatcaaggactcttaaaagtaaacaataacagatggattgaaggcaaaatcaaaataccaatagtgacctgtaacaggggtgggtttaatggctatttttttttctaacccaggtgtgcaaaatttctactgtttttagctagagaaccaagaatgaagcctctgcaagatggagcatatgtagagtgttgggagcaggccccccaaaatctggccataaactggccataaataaaatctctgcagcactgtaacatgttcataatggccctaacacccatgctggaaggttgtgggtttactggaatgagggcaaggaacacctggcctgcccggggtggaaaaccgcttaaaggcattcttaagccacaaacaatagcatgagcgatctgtgccttaaggacatgctcctgctgcagttaactagcccaacctattcctttaattcggcccctcccttcgtttcccataagggatacgtttagttaatttaatatctatagaaacaatgctaatgactggcttgctgttaataaatacgtgggtaaatctctgttcgtggctgagctctgaaggctgtgagacccctgatttcccacttcacacctctatatttctgtgtctatgtctttaattcctctagcaccgctaggttagggtctccctgaccgagctggtctcggcatagagaaataattcttttgtttttctctttcttccccacccagccttgcctggaagccagctctggttctgaagctgctgtcatgatactagctgtgtagtggcagcaatgcacaggcactgagaacttcaagacagacaatctctctcattatttctctttaaagaaaaaaaaaggggggtacagacacttatgagaaaacaaaaacacatgaagacaaatataaaaatacaatactaagatatcaaatctggcaatatttaaaaacaatactttacaaacaagtgatttataccatgaatgcaaggctggttcaacattcaaagctcaacagatataaattgcaacattattaggtagatgaagaataaac[148 bp omitted]aaaaatacaaaaaattagccgggcgcagtggcgggcgcctgtagtcccagctactcgggaggctgaggcaggagaatggcgtgaacccggaaggcggagcttgcagtgagcggagatcgcgccacagcactcccgcctgggcgacagaacgagactccgtctcaaaaaaaaaaaaaaaaaaaaaaaaaaaaagcatttgacaaaattcaatagctattctttataaaaactctcaacaaaatgagaaaagggaacttatcctgatagagggcatctacaaaacaaacaaaaaaaaaaacaaacaaaactaccactaaattacacttaatggtgactctccaactgatttaaaaactgggtccaaggcaagaagtcagctcttttaccacttatattcaactttatactgatagtcctagccagatcagtaatgtagggaaaaaaatcagtgacatccacatcagaaaggaagaaataaacctgtttctattttcagacaacagtctatgtaaaagtattcaaaataacctattaaaattctcaatatgcgagtttagtaatgtggttatatgcaaactcaataaacaaaatcaatcatatttctatatattaccaaacaacgtttggaaatagaaacatacaaaaaattatttagaatgacataaaaaataaagcgtttatgtataattttacaaaaatatgtgcacaattggtatttttcctcccaagtagctgggactacaggcatgcaccaccatgtccagctaatttttgtatttttaggagagctggggtttcaccatgttgcccagcctggtctcaaattcatggtctcaagcaatccacccgcctcagcctcccaaagtgctgggattataggcatgagccactgtgccggactccctatttacattattttaaaaaacctatttacctttagataaatgtttgaggtgatagatacgctaattaccctgatttgatcattccatattatacacctcaaaatatcacactatacctcataaatatgtacaattatgtgtcaattaaaaaaaaccaaaaaattattttttcaaccttcatagtagcttttttttaattaaaggaatttatctctaataataaagtcaaatagaacaaaaattacagactgaggatcattttgtggaggaaatacaaatgtaggcctggaacagagggcataaaaaaataacatcatcctcttaagtatatactttaaaagaaaaaagaaagttgtagatatcaaaaaaaaaaacaacacattttacttttaactgggcactttcactacacttatatcacaatgctgcctggataacattttaaagaattgtttattacaaatgagaggaaatgccagctaaagtcaagggagttgaacagttttcagttttccctgccaatctaaaccaccagtgccagtaaggactactcagtgaagagtgcagagcaggaacccaagcgtgttgtgatgtcaaaaacagcagttattttatatcatgggttttgaatcactgatattctatttttgttgttgctttttattgatataccagaaataatgttattttttaaatgttacatgttctgaatgacctgttcttaatactttcctctttagagcggtcttcatttatttccccagaagtgtagatgaggtgattgtttataaaacttacatctttaaatgctctcaattgttggagtgtttgacgttcttggttgatccattcttttttcttttgctcctttttatcttgtctcttttctatatttaagcagatgtatatttgtaaattgctcaacattacaaaaatgtcgtggcatacaataaaaatgtcttgacaaagaaagaggctgtaccccaacattaccaccccaagactgcaaccagactgcaggcctggaggtgaattggctgacagctgcaggtccagggcagcgcaactccagtttccacaagtctaggcctgcatgtcacgctacacaaacatagaacattttccttcggaggacactcaccatctgaatactgtgatgctgacgagaatatcttatgctttcttcagcctgttgcaatctgagccaatgattttcttcgcactgatcctggtggaataatacaaatcacctacatggtttttagtgttaccctggtatagcataaaaggttaaaagaagaaagcactgcatttgggcgtagtgtaaggcattcattaatattagttctggtgcggcccaatggtactctcctccacagtctatgatgagagttgcctggctgcttatggaaataatttattcccagcagagtgctttaagaggtgaaaacaatccgccaaccatgagaggacacacaggcagcccccattcttaaatgggatgtgtcccaacaatgttttaatgtgattgttttaaacacatttccccataacattataaatactaattacatttccaagcatacctacaaacgcagagcaactgaaaaattgttataactgtgtttcacctgtgcttaaccactcactataccaatatataatatgctatatgtacataaaatccttaatctatgtaaaaaataatacagtaatactcacagataatactaacatttattgagtaggttttagcttcaatgataagtacttttcatgccttatgctactctatcgtcacatgaaatttgtattattaccactatcttttttttttgagactgagttttgctcttgttgcccaggctggaggagtgtaatggcatgatctcggctcactgcaacttccgcctcctgggttcaagcgattctcctgcctcagcctcccaagtagctgggattacgggtgccgtgcctgatctatcatcctcttttaacagaggagaaaactgtgagcccaaaagagatttaagtaatttgcctaatgtcacatgactactacctaagtggccagactgcgatctgaacccaagttgagagctcacctcaactaccattctattaaccgagtgccttccaaattccaacatttccagaatcagtggaaagagctcctctaaatggggtagggggagtgattatatcttgagagtgaaggttaatgctccaagtctggataagagaaggcacaggagcattttatatacatatacatataacactgccaaggaggtggaggcatctgttcatccacagcaccatgggagtgccaaaggagactcctcttggggctcatgggttttctgaaatgtggagcaaagggcaaatgcctgtagatcttcaaatcctctgaataacagttcctaaatccagaagtacaattcttaaacatgaacatgcaaagaatatactcttctaacaaatttttttatttttaatttttattagagacagggttttgttctatcaccctagctggagtgcagtggtacaatcacagctcactgaggcctcaacctcctggcctcaagcaatcctcctgcctcagcctcttgagtagctgggactatacatgcgcaccacagagatgaggtctccctgtgttgtccctggtctcgaacttctggccttaagtgattctcccacctcaacctcccaaagtgctgggattacaggcataagccacagcacctagccaagttttttttaagtatttgtatttacatggaagagtaattaacatttttgtaagctacgaaagtcacaa[136 bp omitted]catggtgaaaccccatctctactaaaaatacaaaaattagccaggcttggtggcaggcacctgtaatcccagctacgcaggaggctgaggcagcagattcacttgaacctgggaggtggaggttgcagtgaaccgagatcacgccactgcactccagcctgggagacagagcaagactgcgcatcaaaaaaaaaaaagggagaaaagtatagtaaatatgagtaaatacacataaaagtctgtataaaaatgatatatagaagcttccttttctgtcagaaaaaattaaatttcttagtgttatctttttatgtattcatggatttttaaaaattaagaaaaaaatcaccaaatacaaggtctgaggtgagctgaatattgttatctgtaattgttttgtgtactaaaatatatttagaattattatagctggttattagaaatagagtttctacctattgtggtttttaaagtacctgtggtccgggggtggtggctcacacctgtaatcccaggactttgggaggccaaggtgggcggatcacttgaggtcaggagttcaagacgagcctagccgacatggcgaaaccccgtctctacaaaatatacaaaaattagctgggcgtggtggcacgtgcctgtaaacccagctacttggcaggctaaggcacgagaattgcttgaacctaggaggcagaagttgtagtgagccaagatcatgcctccgcactccagcctgggtgacagagcaagactctgtctcaaaaaaaataaaaataaagtgcctgtgtatgcagtgggaattcaacaaatagttgttgaatgaataaattaaaaccttgagatttgctaaatgcttaaaacccaaaagaaaaaaataatatttttaagaaaaatattaaaaatcattttaactatagccatggataagttcataagcacacaaaaaattaatcactgtgttggtaaaaaccttatttcaatacctctttatccttcatacaagaataaatctctggaagagaaaagaaaagaaagccgctctgagcgtacccacctttctactctggagagaagctcttttgacacagatcctgccccgtttaatagactccagctgctggcactgccttctgagttctttcacttccgaattcttatcgtcctgcagccccaccacagtcaatgactaagttcctctggactttcacatggatcgtaatagacaacttcatcctgtttttctaaaaaggtattaatgattgtttaaaacatattttattatttgtaaaaatacattgaatttttttaaatgtaaggaaaataaagatcacttgtaatcccaccactgagaatcactattaacatataaaaaatctgtgtataaatgtaatatacatatacacatgtgtatatatacatgactatacacatgtatgtaagtagcatgtgtgtatatacatgtaagtagtatatgcatgtatatatacctgtatagacatatgtatatatacacatgcacacacacacacatactacttacatagctacacgta[148 bp omitted]atggcaaaaccccatctctactaaaaatacaaaactagttgggcacagtggcgtgtgcctgtaatcccagctactcaggaggctgaggcaggagaacagcatgaacctgggaggcagaagttgcagtgagccgagatcgtgccactgcactccagcctgggcaacagagcaagactccatctccaaaaacaaaaaaaaatttaaaaaagataaattttaatggcagcatagtattctctaatttaagcaatccatgttgttaggctgttccaatgttccattattattcatttcactgtgatgaacatctctgtataaatctttgtgtatgctttttatcacttccttagcagataagtgtttaaggatcttgatacccattgccacactgccctccagaaaggcaacttatattctaccagcaatatattattaagatgccttagtgatatttaatcttgattacatattgattttttaaaagtcatgcttactgtaacaaattcaaacccacccgaagtacatcaaataaacagtgaaattctattgctccttccccaaaccttctgagtcattctcagaggaaaaacattatgaacaatttggcatgcatccttccagattaacttcttttttaatgtaatttttttcctaaatatgtaaaatgcttataacctgaaactactgaaaaaaattctgaatactcaggattaaactaaaagttcaggatctatgtgaagaaatttattaaacttggaggaactttaggaaaaaagatttaaataaatggagagagacataccatgttcttgggtaggaagattcaaaattgcaaagaccactattctccccaaagtaatctctaattttaagcaaaatcacaatcaaaattccaaagagttttttgttttgaacttgattctaaatttcatctgaaagaataaaggagtgaaaatagtcagaaaacttgtgaagtaatgtggggggtacttgccttaccagaccctaaaatgtgcctccaagacagttgtgggaacagtatggagccagtagcagaagccactcacgaaccaatggaggagaacaactcagaaacagaccaaagtcaatctaatgtttaactggagaaatgttaaacatttagggaaaatgtttttaaaatcagtgattgggactgtttaacaatttgagggaaaggttcaattcctaccacaatcaaaataaattccacctggactaaagaattaaatgttttaaaaaataacatcataaacatactgaaagaaaacataagtatatattgacataattttgggataggagactattgccagacataatactaaaagcagaagccataggggaaaaaaatcgataaacacgacttcataaaacttaaatatttctgaaaggcaagaaaacgcaaatgacaaggagagattatttgcaacatatgacagacaatagaggacattattcttaatgttgaaaggaaatattccaaagaaaaatggacaaagactatgaataggcatttcataaaataagtacaaatggcttgtaaacatacaaaattttgttcaataatcactcataattaaataaatgaaaattggaagactgccattttctctgtcaagtaagcaaaaatgcaaaagaatggcatgagtctgggaaacatacacactcatattctgctgatgggagcgtcttttttcttttcttttttttttgagacagagtcttactctgtcgcccaggctggagtgcagtggtgccatctcagctcactgcaatctcaacctcccaggttcaagcgattctcccgcctcagtctcccaggtagctgggattgcaggcacccaccaccacgcccggctaatttttgtatttttagtagagacagggtttcaccacgttggccaagctggtcttgaactcctgacctcaagtgatctgcccccactcagcctcccaaagtgctgagattacaggcgtgagccaccacgcccagcctgggagcgtcattttaaatgtacgacctatctagagggccactacatagtatgaaatttagaaatcagaaaataatacagaggtgaggaaaaatgtatctcagatgactgctgtattgttacatagcaaaatgtaaaatatacattgcccttgacccaataattccatccttagatatttattccaaggagataatctgtcctatactcaaagacatgtgtaaaggaaagttcactacactactgttcaaaacagcggaaatttggaaatcacggtatatccatataatggaatactatgcagccattaaaattttgatacttttattatttctgaaacagaaagacaattattatgtattaaatgaaaaagagactattatgcattgtatgcctgtgtcaaaatatctcatgtaacccataaatatatatatctgctatgcacccctaaacattaaaaaattttaaaaaagatgttactgaactggttatgtagttttggttaaaaatttatatttttacatatcagcatattttgaaatctacaaagttatacagcaaattgttaccactaagtatctgtctttttttttttcttttttagatggagtctcgctctgtcttctaggctggagtgcagtggcacgatcttggctcactgaaacttccacctcatgggttcaagccattctcctgcctcagcctcccaagtagctgggattacaggc[134 bp omitted]cagcctcccaaagtgctgggattataggcctgagccactgtgcccagccaaccattgagcatctctagatgatgggattggggtaataatcatttttctttctttgttttgctatgtgctaacaatgaatatattatttgaataataaaccactgaaggaaaactttaggaaattttcagatgttacagtttacaaaaagtaattgataatatggtctgtatttccttaaatttataaacattgtaatctatatacttaaataaaaactttaccttttataagtctttcaagagagtccaactgtgtagtaagcagtatttctttgttttttaatatctcaaatttaacttcatatagttctaactgaatttcataaaattgtattgctaattcatctacaacatttatatttttttcttgttctggaagatcttccatcttattttcatagaaaaaagaaaaataagttaaaacaaatagtatattaaaaacaaactttagaagcattctagctattttctattccttgttccgtactaaatataaaagagcaaataggaaagaaacactttttcatttcatctagtgatgctaatactttatcccatccttgaaacagagaaaaacatttaggttttgagaaacataaatggcaatgaggtattattatgtattgcatatcggtgtccccccaaaattcatatgttgacactgtaactcccaatgtgatgttatttggaggtgggtcctttggaagtaattaggttcagattatgtcaaaaggatagcacccccatcatgggattagtgcccttattagaagagaaagacagggatcactttctttctctccaaacatacacacagaagaaaggctatgtgagcactcagttaagaaggcagctgtctactagacaggaagaggatccgcaccagacagtgaatctgcaggcaccttgatcttggacttcccagcctccagaactgtgagaaatacatgtccattgttgaagccacccaatctgtgacatttaatattgttacagcagccttagccaactaagacaggtgtttacagtgttttctgctttaaagtcataagattataggaaaaaacttaagtgtctaagatccttcagggaagtatctctttgattattttaaagctgtactgaaaacattgctggattgattttcaagtacagtacccacttcaatactgggcttggtgttactataaagtgaatcctacagtgtggtattttgaaacatcttaaccaaaggaaaactttatgtctaaccttccataggagatggtgttggaataagtgaagaaaagcagctctttaacaatgcctggaaagaaaagtgctatctaaaaatacaagtgtgctttaccacatggtctcacttataagtgggagctaagtagtgtatacacagacagtgtggaataacagacactggagactcagaagagtaagagggtgggaggggggatgagaaatatttaatgggtacaattacattatgtaggtgatgattacgctaaaagcccaaacttcaccactacacaatatatccatggaacaaaactgcactt[223 bp omitted]gaggcaggagaatggcatgaacccaggaggcggagcttgcaatgagccgagatcgtgccactgcagtccggcctaggcaaaagagcgagactctgtctcaaaaaaaataaaataaaataaaaaataaatacaagtgtatttttaaaacaaagttatgtttatctttgtcttacctttccctgaatttcagctcttttgtgatttaaacataactctttcgctctcatgagttgcagagtctcttgagctagcattagcttaagtttttccaacctgggaattgctgtggcccaggcagcctggccaaatctcttcacatcctgttccatttctttctgcattcctgttagattataaaaataaaatataattacacctcattaaaaagggaaacattgatcatgagctaattctttttttattgcctccatactacctgcagaacatcttttttaaaagaaattttgttttattaattttttattattataaaaataatacatggtcattaatatacaattttaggtattcaatttttaaaaggacaataataagtcatgatctcacctagttgaggcaagtgcttcttatattttggcacacttgcttccatattgtttctatgactagctagacagacaggctcatatggatagtttgaccaaaaaaccaggatcatcattctgctttatatcttgttgattctgtgcaatatatcagaaactcctgccatttataaaaaaaaaatcaagaatcatgcttaatagctatgtagttttctcttttatgaatgtaccataacttaacaaactgacagacattaagttgtttcctatttggtgtttttatcaacaattatttaagactgaaaaaaagtccttcacccagcccgcaagcccctgcacggtctgatccctgcctgtcttgccagcattctccctcataccacattgtcctgcactctctgcgatccagccccgcaggttttctgtaagctcctatttgccaacttccctcaagccaggggaccttcgccagtgctattccttccgcccagaacactcctcactttttctattctctcaatttccatttacccttcagatattggggcaagcgccacttctcagaggccttcagtgaccaccctgatcaagcccaatttctctctcacagaccctcagagccccatgtctctcttctttgtgccatttattgtcactgccattttctgtgtgcttcagtgaatagataattaagatttctctcccttcaccagactgtacaatgtctcttaatgtttgacactgaattctcgccacctagaaaacacagtgcctagtgcgtaagagggactcaaatggtatttgaataaaatgacaatcaattacacgtatctgcgtatagcattttttagattatcacctgctaatgcttttactgtctccttaaaataattcactgtgatatcttgaatagagacgacagcttctccagcccgtctggtccattcttcagcttctttctccagggcaactacccttctaggacctaggtcatcctcatccaaggacttctacagacagaagggaaaattatcttagtaagagctaatagttatgtagaaccattaggaaattgaaaggaaattggtcacatggattaatttaactacactactactcagtcagttaaattttcattcattcagcagtcccttactgcacatgaataaggctctaagctgagcaccacctggaagacaaaaggaccctctggggcataaagtggggggaaaaaaaactactttcacttcacatgcctagaataactttttctagagaggaatgttgtcaacttatgcttctctctattaataataatacacaattgtttaaatgagtgatctgtgttgtcaaacactcagcacagggcctggaaaacagcacttaagtgttagctgttgttatcatttcttttagggatatgtaatattatcacctaaaagacagtatctgtatattcatgcttataacatgtactggtattggactgaatgtttgggtccccccaaaatgcatatgttgaagcctaaatccccagtgtgatgggatttgaagatggggcctttgggaggtaattaggtcatgagggtggagacctcaagaaaattgggattaatgcccttataaaaagaagaggagacacaggatctctctctctgctcttcaccatgtgaagacacagcaagacagtcatctacaaattaagaaactggccctcacaagacactggatctgccagcaccttgatcttagactacccagcctccagaactgtgagaaaaaaagttttgttgtttataagccactaatctacagtactttgttacaacagcctgaactaagacatgtacagctatgtcatccaatatgcaatttttcttctacaaagcataagaaatatgtacaagttagccgacaaggaattacaaatcaaaaccataacgagataccacttcacacccactaggatggctgtaaccaaagagacacacaattacaagtgttggtgataatgtggacaaattggaaccctcatttacttcttctgggaatataaatgatgcacccactttggaaaaccatctggcgtctttcaaaaggttaaacactgggtaatcacaggacccagcaatcctactcctcagtacgtacacaagagcaatgaaaagatatgtctacacaaaaactcacacacaagcattcatagcagaattattcatgatagccaaaaagtggaaacaacccaaatgtccatcaactgatgaaaaaaatgcaatatatccatacaatgaatatcactgagcaataaaaagaaatgaaatcctggtatttgctacaacatggattagccttgcaaacattgtgctgagtgaaaggaccacatattcaataatgctgttgctatgtccagagtagggaaatccacagagacagaaagtagattggtggttgcccagggctggcagtgactaatgggtacagggtttcttttgggggtgaaaatgtcctgaaattacatagtaatgatcattgtgcaactttcaatatactaaaaatcactgaattgtacatctttttatatatgtagatatattttatatatatatatgcatatatatacgtatatacgtatatatatatgtatatatgtgtacatatacatatacacatatatacatatatatatacgtatatatacacatatacacatatacatatatacatatattatacagattatatatatgtatacatatatacacatacatatatacatatatgtatgtacatatacatgcatacatacatacatatatatgtatacatatatatatacagattatatatatatatatatagtctgtgaatggtattttaaaacagctgttacttaaagaaaggaaaattatagactgggtgcggtggctcatgcctgtaatcccagcacaatgggagcctgaggcaggcagatcacctgaggtcaggagttcgagaccagcctgaccaacatgaagaaaccccgtctctactaaaaaaatacaaaattagccgggctggacatggtggcacatgcctgtaatcccagctactcgggaggctgaggcagaagaatcgcttgaatccaggaggtggaggttgccgtgagccaagatcacgccattgcactccagcctgggcaacaagagcgaaactccatctcaaaaaaaaaaaaaaaaaaagaagaaagcaaaatatatgcaagaagtagactctccaaataatagactttcaaaataatgaacagaacaactttatccacaggttagagtggcatgagtttcatctaaatgtgatactatttttatagtacaatcatctggcaggggcatgagattatatgtggaaagatggcccagtgcagggggcagaaatcaagagatctcttaggtgtcttctgattcccgttgttgagacccaaggcaagctatttaacaactctggactctagattcatttgtaacactggaataagaatgcctttcctgaatggtgtcacaaggatgtttgatggctcaatgaagcaagagcgataactgtatttactaaaatttaagttactgaattacaatctagggtcctgctatttaaattttcatcctattttaagaaatctgcatgagtccttagaggaaaacaactgaagcaaataaacatcacatcaaaaacaattcatcaggctgggcgcagtggctcacgcttgtaatcccagcactttgggaggctg[136 bp omitted]tgaggcagaagagtcacttgaacctggaggaggttgcagtgagccaagattgtgccactgcactctagcctagctgacaaagagagaccctatctcaaaaaacaaaaaaaaaattcatcgccagaaaaaacatttaactctttaaaatctgtaggaatcttaagctattaagatgaccaacataaatgtcttcattttctatcaattttaaatataaattcaatatttaaacacgagggtgaactaggcatagtggcttacgcctgtaatgctacgctttgggaggccgaggtgggcagactgcttgagctcaggagttagaaacgagcttgagcaacatggcaaaacctcatctctatcaataaataagtaaataaacataagagtaaacccaaacaaacccaaacaaagtacagagattgaagattaagtgtaaataaagaaataatatatgacaaatagtaaatgtgataaaataaaaattttaaaaaaataccaaaatatcaagcttacataaagttgcaacttctcgcatagccctaaatggctgcagtaagtactggaagaacgtggttgccacggtaactaattcctggtaggcttcatcttcctcttggtaaactttcattaatgctaccatggtgttggcttttcggtgtccttgaataacctagagagcaaatgtgaataaagctcaagtcaggacagtgtaatacatacccaacaaacaaagctaaacaaaagaaaccttcatgttctcaactttcaatacatcaatttaaaatattgattaaatacgaaaatgttatcatcctccatcaaaaatgcccaataaaacaagaattgttaagaaaattatgatatatccatggcagaatattattagtgtagtcattcagcactgtgcttctgaagattgtttaataatatggagacttttggccaggcacggtggctcatgccggtaattccagcactttgggaggccaaggcgggtggatcacttgaggtcaggacttcgagaccagcctgaccaacatagagaaacactgtctgtactaaaaatacaaaattagttgggcgtggtggcgcacgcctgtaatcccagctactggggaggctgaggcaggagaatcgcttgaacccgggaggcggaggttgcggtgagccgagacagtgccattgcattccagcctgggcaacaagaatgaaactccgtttcaaaaaaaaaaagagacttttataattaaatggagaggcagagtataaaatttaatctcaactgtgcactaagtatgcagcgaaaaggacccaaaagaaggtttgaggttgtggatattttttcatttgacttttctgactgtaaaggttttgtgaggctgtattcctttttaaaagctcataagggccaggcgtggtggctcacgcctgtaaccccagcactttgggaggccacagcaggcgcatcacgaggtcaggagaacgagaccatcctggctaacacggtgaaacctgtctatactaacaatacaaaaaattagccgggcgtg[135 bp omitted]aaaaacaaaacaaaactcaactaaacaaaatctcataaaacattacagagctgtctccaagtactttagcatgttgattctcttaatgccccaggttaatattcccatgaagtccttagcagtcaactcatttacagagcctcagctgtggttccggtctctgctggttattgcttgtgctgcagggcagaaaacaaactgaacagtgtataatctaggtggactgatttggttggaaattattttactcccacaagaagagaaataaaatcaaataatatagatttttttcaaccaatacattcttaaagtcttctatttccatccttctgcttaaggctaaagtgatctactttcagctgtattttttatccaggtaataatattatcattttttttaagtgaaagcctcactgaacaaaattaaaacacacaagcaaaagtcaaaaggcaagtggtacatttcagccttctttcttagactattcagaaaaattccagagttaaaacattcagcttcattttatatatcctagcaatgctagcaattggtctaattctagaatcaattgcttttctattctaaatataaagtaaatattaaaattatatatttggacatgttgtgaattttagcttcccctctcaacccctcatttttgagttccagataaatatgtgaactacactaacgtgaacagctagctcaacagaatgaactacattcatgctatagtaccccagagtgaacttaaatttgggaaaactaacttttctgatagcaactacagtaaaatacaccatataaatgttcgattttaaggagaaaccacctatctctgtgagaaaccaagtgtttaaaaaacaagtctgatacaaaatgataccatttttgaaactcccctgtgggttcctcatatcctaaggtgaaagttataaagttgaagatgaaaagctgactggcctgaaactcccctgtggtttcctcatattctaaagtgaaatcaacacgttaagtgggtgtgtagacatttacacataaagctcacagtacaaaaatgaccccactaacaagctccttttataaaaccattttaatttagaaagcttattctatatttagcttaggctgaattcttctcttcacctccccttcctcaaaagaatgcacagaaaaatatcattcaggttaataagagcagtgagccgagactccagcctggctctgcttagtaaactgtaggtgtggatttagaaggcatactttctcctaaacccttctatgaacatgtacttccccgtccccttaagttcagtaagtttaccactcaaataattactctctcaaactacctctttcaagcttaaaagggcactaatgcggttattctaaactgatgaataaagctcactttctaccggctttccatttgaccaagtctgtattacttaaaacaaaacaccctaactcctaaaagccatttcttcctttaaaccattttatcccacttgcgacgtccccgcagacacagacttggaattgcttacgtgtagtccgtgttattctttcctacatggatgggttgttttcagttttgcttgcagtatttctggcatttcccgttacaacatcctgctctgccagcatcttcagggcaaaggttgggggcctagcccagctcccagcggcaagtacactaggctctaacttcgcttgtcctctctgcaggccctgccgaagctcccgctggtttcccgcagcgatcccgcgcaggtgagggtactggggagcccgtggccttctccgcccgccggctcctccccatcagccgtcagccagggctctcggcgccggggaagcctcccaccgggtcccaggccacccaagcgcggtcaaacgccggcggcccggcctcgcttacctgacgcagccgcgcgtccgcctcgacccatcaggcgcgcagggcccgctcccgaaactcgcgcgggctctcgcagtcggccgcgcggccgttagccgcgaagagagcgtcgcgcacggtggcgcagccacagccgtgggccgccgcgcccaggtagcgctccagctgcccgcaaagctcctgcagtgccgcctcgccggggcccacgcgcgccggccacagcagcgcccaccgcccgagccccagacctcaggccccgccgccgcccacgtccagctccggcggcagccgtgggaagcagtgttccagaggcggccacagcgccgctagctgccggcgcgcgccgcggaaccccgcggccgagagccggccggcccagctgggcggggacacggcggcctcgggcttgtgctccagccccagccgggcccctcgcgccgctgcggctgctgcgcggtgcggtcgtgacaagtcacagcaaacttgccctccgcgccgttccaagccaccaggaagcgcaaccggtgcccctggggatcggcgaagaggccctcccggagcggcgcccagccctccaggctgtcgggctgctcgtcctccatggccgtcggcggcagcggccctagggcttggcgggcgcgggcctgacctcgtcgcaccgcctgtcaggggacagtcccaggtgaagcatttttcgctccacaattggtattttaacaatatgaatgaaaaaaaaaacctcaggtgttttgatagaaataacagacgtgcctaggaatcatcttccttgaagggagaggagggtcttattgaacttgaaaaaactaaataagcaaaattgatacataaggacacccttctctttacccttacctattcttaacaactttaattcatttctgacactgtcaccaactgaaaaacggtccaactaaaaaaaaaatcataaaggtgagaaaaattgtgacgtgttctatcctaatccaatatatctaaaccaattttactgatagagaaaatatattaagtgaatgatgtaaatacattaatataggtaacaactctttgaaagtaaagtttgcacataacatgaaatacatagagaattactgccgtctcgaaggagagaacccttgatggggagtggtagtcaaaaaggtgtacgagcaagtcatctgttgcaaggtgatgggaggagatatttttgcaggcattcaatatcagtcagaggttttaatgatttttgttttttatcttgagagttggagactagaagatctaaaataggaaaattttggcatatccatagatagaatggaagctcttcgccaaaaaataacgtgctccaagtcatgaaaaatagcacacatgcacaattaactacagagttacacaagatggtgtcttttcattcgattttatttgaactcttattcttctctatcttttacgctttgtatccttgttaattaactcttccattttttcctcatcctatgaggcactttaaacattttattcaataactcttaaggcaatttttacaattctattcacatataaaattgtcataagcatgttttgtgagtgaaaaattctaatttgtaatgcatatcaagtgaaaagcctcagttcagcactcgtcatatccaaaatctgtgttatataataatgtaaaagacatattttcacacatgtagctcaaatgagattcttacttaacatttctctctctttttttttttttttttgagatggagtctcgctctgttgcccaggctggagtgcagtggcgcaatctcagctcactgcaagctctgcctcctgggttcatgccattctcctgtttc[222 bp omitted]atgtgcatatactgcctgttcaagtacttaatctttttatttattatttgaaattggaggtccatctttttagattgttagaaggtcttcacgtatttgaatgagttattaagttgatacaaccattttggaaaaataattatcattatctactacatttaaacacataatatatgaccagcagtttcaacagaaacacctggatattcatcaggatagaacggattggaaagctccatattcattcaacagggtgctacacaaaacaaaaaggaatgaatcactggtccataacataaacagatttcacaaatgtaattttgagtgaaataagccagaaaaaaataaataccgtatgcttccatttatatgaagacaaagataggcaatattaatctatggtaacatatgagactgacttctttttctcagcatcagctgagagcctgaaaaatatttttctggggtgctaaaaaagtgccagatcttaaaaatatttgtacaaaagataataatttttttatataaataggtacaaaacacaaatatgtacaaaaatgtatttataaatatgttaaacaagattactatttatacttcaatataatttttttcacttttgttgacattagtaaaccatcacacttaataaacagccatttggaattgttcttgatttaggtatttccttgattaaataccaagtaggaacataccttgattctaaaatataaagaatattattccatgaaagtttccatgaaaactatcttgcattctaaaatatttttaaaagtacttattttcaaagttcagtttcctattttaaacaaaagttgagctaaattacatataagctagtccccagaatattcagtaaatatcaaatgaaggtgtgaaagttaaagatttcaattttttactagttaatttgcagtgctctattattttgcttaataaacaattttatgctagaaataagcagatttccctattcacattatctttaccaagagcacttaaataaataccattgattacttgcaaaatacagattgtagattcagagctcaaaactaaccctctgaggatgtaattcaattaaaacaacccatagttgtgaattcacctcaccagtgtccctaagacaagaagctctttctcacatcaaagtgaattattttaattcactttggatgttaggaatatcctaactcctttgtaattaaaaaaaaaaaaacaaaacttctgatgcttctttatatcttaacaatcatgaggtctataaaaatatgaacacagaagtttgggtcagttcaatgactgaactaaaacattatttcccaacatgtccatgttgtacaagatgatggggttgttatctgtgatgccattgcaaagatcttgatggttccaaaacactaagcatcacataagccatgttatagctgtcgccccaaatttaccaaaccatttggattaaaactctcagtaaggacctctgaggcacaaagatctatgagtaactccttaacccctttgctcttactcttcaggtacaatttcaaattttcacctttccctttctgcactgaccttgggaaagtcactttatctctgtgatctaattttccacatcaataatgtatctatacttggcatagagagttatgagaataaaataataacatatatgggcaatttctgtgaataccaattgtacaggtggatttttaaataatagatttagggccgggcgcagtgactcacacctgtaataccatcactttgggaggccgaagcgggtggatcacctgaggtcaggagtttaagaccagcctgaccaacaaggtgaaataccgtctctactaaaaatacaaaaattagccaggtgtggtggcgggcacctgtagtcccagctactcaggagggtgagacaggagaattgcttgaacccacaaggcggaggttgcagtaggccgagatcacgccactgcactccagcctgggcgatgaagcgagacaccatgtaaaaaacaaacaaaccaataaatgaaatatatttaggaaaactattataagaaaaaaattgaaagcattaagaactctattatggactgaacaaaaaaaggagaattggtaccataccttggtaagtttattttaataagcccaatttctattagttcttcagtgtttcctcttgctccgtgaatgtatgttccttgcctctatcttatcccattttttctattgttaacagagagttgtcgcaagttctattctcaatgcctattgcattgggcaatagatgactctggttcccaactcagaaaaacctcatttttaagaaacgtttgagctttgactttgatctcattcagaatattttggttcaaaagttttttgtttttttgttttttttgagacggagtctcgctttgtcgcccaggctggagtgcaatggcgcgatctcggctcactgcaagctccgcctcccgggttcacgccattctcctgcatcagcctccctagtagctgggactgcaggcgtctgccaccacgcccggctaatttttttttgtatttttagtagagacagggttccaccatgttagccaggatggtctcaaatctcctgatcttgtgatccgcccgtctcggcctcccacagtgctggggttacaggtgtgagccaccacgcctggcccaagagtcttaagtttgtgtaaataagcacctttgaaaactacatctacaaatgggaatatggaataaaaaggacaagccaaaggttatggaacaaaataaaacatgaagaaagagaaatagaaacacaatattactatatacaatatagtaatatattttaaaatacaaaaaacgctagcaaaaaaagcaatatgtaaacaaaagaattggagtaaaataatagaatttgaaacagcacaatctgctgaaaatatacaaaagacaaattagggtattcctgagctcactgtttataatattagaacatgtatataaaaaggaaaagtgactttaaaatgtctgggggccaaggaatatatagtttgttacattttatttacaaacagtttctttgactagggaatcaatttaaattttctgttttggaaataatataaatatatctttattttagactttttgctgtaaagtttcttaaatatttacaactttaggataatcagtgtacatttcaatatataatgtcctaaaaatcaaacagctaccaaacattgaattgaagttctgacttatataaatcatttgcataaaaactgatcattaaaaacagtatctaatgaacattttggccccaatattaattaaaactgaaatgatagcattacaagctaaagattaatttcaatgacatgtcattcaaccattttgacataattgacttataataatctaaaattgactatttttatgacatatttgacctaaatgaagagaaaaaagctttgactcattcttaattactctttctaaccaattgatggccaataactgaaattaatttcaaaccattttttgttattttaatcttttaaacatgttttactttcagtgattcattttctaacattcatagccaaagcccaggctctacccatctttgtctaccttaatgactttgtcaattgttggcatacactgggtcttaaaaacttgtgtttcttccgaattaattaatgaagtagaattgctcttatagggtttcatataccattacctccaaaagagtacatcagaagtattagaaaatactgatatttataaacagatatttatcttatgatacaaagagctagagctgttttattttctgtaaaactaagaataacttcttgataacgtagctttacaaaaagaaaacccaacacatttccataaataattctctgaaataactatgtgagtttgtgtctttttatatacatgtagatatacatatacttacacatctatacatatatatgtaacataaaggatatgaacattaggactgtttaatgtctatttgtcttggaaagaaaaatatacttaaaaatatttcttaattgggatttgtaatcgtaccaacttaattgataaacttggcaactgcttttatgttctgtctccttccataaatttttcaaaatactaattcaacaaagaaaaagctctaattttcattggaaataatttatatacttgtttagagcagagaaaaattaagaaaaactttgaaatggtctcaaaaaattgctaaatattttcaatggaaaactaaatgttagtttagctgattgtatggggtttctgaacctttcactttttgtttgttttacctatttcacaactgtgtaaattgccaataattcctgtccatgaaaatgcaaattatccagtgtagatatatttgaccatcaccctatggatattggctagttttgcctttattaagcaaattcatttcagcctgaatgtctgcctatatattctctgctctttgtattctcctttgaacccgttaaaacatcctgtggcactcttatttattaatcagttaaataaaatcatgaacatatattcattttacatttgtatgagaaccattatttttcttttctttaaaaaaattaattatcctttgacattgggttgacattttcttaagacatgccataaacagaggatatcaagtttctcaatgtcagttctagaggaaaaaaaattccttataaaaatttaacctcatgtgtaacagtttccattcccatagcaatgacatttgatatacattgtatatattaatctgggaatgatgtaaggttccaagtataattttatcagtgaactcaactacttgattactttcacttatttaaatatctagttcaatgttgtccagtggcattgtggatttaggtaattttaccaggcagccgttcaatttctgcactttctatttgcccatgcagaacataacacattttataagtcaaggtataggcatctggtggcataattttaatttgttatcaaataaaagcctcatcaaatttgtctagaaaataactcattatttactttattttaggactgtatcactatgtaatgagatacaaatatatgtaaatgtaagtgcctaagaggcatgcagagagcctaagatgtatgcagtatgcctaacaggaatgcagagagcttcattttcattgtcagctgctcagttgtttctcaggaaagaaatgtggccaacggacaccatttaagagatatatagcaacaagttcagaaaattctcataaatgggagtggctaatgcatagacaatagcattgacctttgatccatatatatatatatataaaatatacctcaaatacatttggatcaatttaattgtgagtgctataaactacaaatgaaagtaaaaaagcaaacctgttggtattttagaagaatgaaagattattaactcatggcctgtatgtgtttggaatgagaaggacgtacatagctttctttggacggggtggaattgaaattgtgatttacagtgactaaaacctgactgctttcacatttttttttcactgttgggggtgaaattcttgattgatttgtgcattgggaactttttttttttttttggagacagagtctcgctttgtagccaaggctggagtgcagtggcgggatctcggctcactgcaaactccaccttctgggttcacaccatcctcctgcctc[134 bp omitted]acctgccttggccttccaaagtgctgggattacaggtgtgcgcctgcctgagccactgtgcctggatagagaatgactccttatgtgacatgcagaaaatattttgtgtcattcgtggtacatttatcatattttctataggtttgtactatgttgctccacttcttagaattccaagtagttcaaagccagcagggactggtatattatagcatatttaacctaagcaactctaaaagctaacgaaaccaagtatctacaaactttagccatagctaccatcaacatgaagaatgtaataggcaaaatgttttacatgctgaatatgcactactgaattctgtatatattttttgcagtttcaatttaaaagtatactagttagatatttcatctataccctggtatagtaataaaaattcagatactgctcaacgaggaagcacattttcaaagcaacagacctgaaaactagtattttatttgatattttaaatgcttatttcattttctggttaaagatgtttgtgaaggtaaaatttaaaatagatactttatgttattctagtatataacattgaaattaaatttttagtaaatgtagaaaaggaaagtctgaagcattgactgagaaagatttagtaaatggagaattttgactattaaacatcccattttaacaaaaatatgcataaaatattcttaggatgatttaattaaccttttaataaatacgaaagacattatgaaaaaattaaagaatacatcacattgcagaatcaaaagtaataaaaatcactcaaattctactgctcagaaatgaaaataattgctgaacattaggtggcagtatttcagacattcctatataaatatacttgaatgaggcccagagcagtggctcacgcctgtaatcccagcacttttggaggccg[134 bp omitted]gaggcaggataatggcatgaaccccggaggcggagcctgcagtgagtggagatcccgccactgcactccatcctgggcgaaagagcaagactccgtctcaaaataaaaatataaataaataaatacacacatgcattcttcatttataaaatacatttaatatttttaaataaataaaagtcaaaataaaactgataaaatgactgtagttatttgtatgaatatatgcatgtgtgtacagatgcattaagaaatcttaatcttcaaaatgatgaacattttagaagaaatactaagaat[137 bp omitted]tgcctcagcctcccgggtaggtgggagggactacaggcgcccgccaccacgcccggctaatttttcgtatttttagtagagacggggtttcaccgtgttagccaggatggtctcaatgtcctgaccttgtgatctgcccgcctcggcttcccagagtgctgggattacaggctgagccaccgcgccctgccctgggatctgtatctttctaagtaggtgattcagtatctaatgagaaaattatcacttaaaaattcaaaatgttttagtttgttgttattattattattatttgtattatttttaaagatggggtcttcttatggtgcccaggctaatcttgttaatatttttatattgtcatggtgtcttaggcagctcaagctgccgtaacagaataccagagactggtgtcttaagcagacatttatttctcacagttttggaggctgggaaatcctccacaaggtgccggcagattcagtccctggtgaaagcccccttcctagactacaggctcctgccttctgacaatgtcttcacatggcacaaaatagagaaagacagagagctgtggtctcagtttctcttcctataagaacactaatcccatcatggagatgcacatgatcttaaccagataaattttttttggatattttgaactgatcaaataactcacattgattcaaaatatcacagttattaaaactcaggcacaaaatcaagttagttcatcagtaattgaggcagataattttaaatcaaaatatagctacacaaaacaccatttcctaattatcttagactttaaaagtagttagaggaagagaaagctcatctctgtattacagtataacgggtttcccatcctaggtgtcttaatctatttgaacagctataacaaaataccataaattggtagattataggtaatagaaatttgttgttcacagttctggagggcgggaagtcctagatcaaagtgccgtaagatttggtgaggacctgcttcttgattcatgaattgccatctcttccctgcatcctcacttggtgaaaggggcaggagtctctcgggactcttttataagtgcactaatcccattcatgagggctctaccgtcatgatctaatcccctccctctaaggccccacctgcaaatatcatcatatgggtgttacttttcaacagctgaattgtggggggcaccatcattcagcgtacagcactgtgaaatccctaatatcgggttttctttttattttattttatttttgagatggagtctcgctctctcacccaggctggagtgcagttgtgtgatctcggctcactgcaagctccgcctcccgggttcacgccattctcctgcctcagcctctggagtagctgggactacaggcgcccgctaccacgcccggctaatattttttgtatttttagtagagatcaccgcacctggcccctagatgaatatttgaataaaagttgtatgtatgatgataaaacaacaagaaactgaatttttgcagaaagtaaaaataaaacttgtcactctttatataggcaaatcagagactatacttgaggttttagaaaagacatcagtatgttccatataaagcatgtactgggaccccgtcagtctttttcaccatataatatcagtgtttttaatagtacctgggatggctgggcgtggtggcttacgccgtaatcccagcactttggaaggccgaggagggaggatcacgaggtcaggagatcgaaaccatcctgcctaatacggtgaaactccgtctctactaaaaataacaaaaaaattagccgggcgtggtggcgggcgcctgtagtcccagctactccggaggctgaggccggagaaaggcgtgaacccgggaggcggagcttgcagtgagcggacatcgtgccactgcactccagccagggcgacagagcaagactccatctcaaaaaaaaaaaaaaaaaaaaaaaaaaaaagtacctgggacatgatatgaactcaatgactatttattgaatgaattacttgaacaagtttatgcaagaaattgacataaaattaaacattgtctccttataccatatagtgtctacaaaaactaagttgatacagaacctgtattctaacatgattaaatttgagccaagtacatttctctcttaagaatttataagtttataaagaaatcagggcctgggaactgaatcattaatgaaagatctcaaaggcaatattcttttcattgtaattaatattaagtcgttaaagtaataataaataactaacatttaggttcctgaaaaaaatggttaaattgaacatcaaatagtttgcatttatatcacactgtacaatttatattttttatgctgctttactgtaagatttcattgaacaaatgcatcttatgatttcaaggtaaggtattcaaatatgcctttttaaaatgtaatgctgtattagtgattttaaaatatgtaaaaaaaatgtgtgggaaatactagaaatgttatttgaaattaaccaattctgggtttgcttattttttttttttattttatttgccaaactgagaacaacagcctttacacattttctatttttctggacttgattcttaggaactttaattttgcacttttgcattcctctataaatgttaatgtcttagccaatgacatttttctagataaattcaaaagcttaacctaagtaatgtaatggtggcatttatgaaattgactcctggttctctctttaaattctttttattgtttatttctatggcaccattacactatgctatcacattgttcttgttttattccccatgtttaaaaagctgtatattctttgctgaatcttaaaggtcactttgaaacctcaagaccatgactgaaatacagtgaagattaaagataaaaaggagaaaaaaggttaaattataaaacctctaatatcattactcatatatatgatatacacagagatgcatcacctaggtcctccctgagagctgtgtcagtagacaggactcagctgtgagccccttcagacgtcacctcagctgcagagcttccccctgcctaaggtcctgaggttcccagttgtggtgcatatgcaatgactgattgaggtgaggcaaggaggcaggtgaaagaggtggggaggggacttggggcctataaagactcagtcatgtcattgcaatgtgaaaggatgccagtgggccattttatcttcaaagtcccctgtgagatgagccaaagctgtggtccaggacttcttttcagcccagctttttccctttccctcaatccagcttccttcttctccttttcacagtgccttggattcaagggcactccctagtatatatctccatgtccaagtctgcttactagagaacattgtatcatgaatgataccattcttcaaaaatatggggtactttgagtgaaaggagtggaacggtatagaagaacagctttggtagagtagttagaatagaagctactctacattgggttgatgcatgaatgggatattaggaagtaaagtagcaaattgaaaactcctttcgaaagaaga[131 bp omitted]tgtagcgagaccccatctctttaaaaaaatgtagttggaagctagagaatagcataacaaaaaagagggtgattttagaagacaaaagggcccactggagctctctcacattggagtgaaattctgaaattaccctctttttggttatgtcattctacctcaatcattttgcctcaatcatgtttacaggcaaaataagagatagagaagtggaaagggctgaaggcagagatacgagacacaataacaaatggggaaagatacaagatacaatgaaaggcatgagctagatcaattctacaagtgaaaaattatgcaagtgaaaaaattacaaggtgagaggaaggatgactcatcacccaattataggtaagtttataggagggtgggactggctacataaaggtagatgatactttatgtccttattttcattaaagagaatatgtcatttcctgaaaatgaaagatgtgggtgtgaatagagagttggcaaaatttggtatttatttgaaatcggcatttatttgggaagataatgtagggtaactaatccacttagatgataaatacttattaactataaactgtgtaccaggtactttgctataatataaaggcaatggaaaaaccaagattcagtcttgatttgacatccttaacatttacagtgtcgtggtggaaactatgtaaagaatccagtgtgatagaaggtggtagatgtggaaacaggaggtttagaaaaagctccaggacacattgctgacacatctaactcaggatcagggcatttaagaaagcatcacactctccctcaatctctctattctgtctttccatggaatccttttaacaaagtatcaagatggccctcagcactaaggaagaagtgttatttgaaagcatgtttttgaatagttgcatttatctaaacagaatttttcactcctgtgtggattttgcttggaattggtatattctggcattccatgttgtaaagcacttgaggtgcttaagagatatttggttggccgggtgcagtggccgaggtggttggatcacctgaggtcaggagttcgagaccagcctggccaacatggtgaaactctgtctctacttaaaatacaaaacttagctgggcatgttggcaggtgcctgtaatcccagctacttgggaggctgaggcgggataattgtttgaacctgggaggcagaggttgcagtgagccaagattgcaccactgcactccagcctagggaacagagcaagactccgtctcaaaagaaaaaaaaaaagaaggagagatatttggtaaataactgaggcaaaggtggaagaaaatagtgttctacaggaggtgaaataatgtgtgaagagaaaataaaaattttaaagaactaaaagaatcaggtattgaagtcaaaggtgagagggccactgaaattcaaaaatacaatgtgaataactacagaagatgtcatcattcctgatgaggcaatgaatgtgggtgcctaaattagagtagaaatacatgttattgaagataaggagatcaaaaggtgtaaggccagggtgttgaatgtattttgcacaaatgcgctaacgttacccagaatgttggcagggggaaaaacatctgatggcctgtagccagagttttccttaaaaacgcagacgtgtcctcctggaaaacagacatctttgaaaaaatgaaggaaattagggtctcacagcatgactctcatggagatggtgaaggactgatttgagagcagccacgcagagttaggacaatgccagcaacatctgacccatgtacatgaagctccagataacttaggtgattgctttaatgcaaaaggccacacagtgtgaattcgtgagagactatcttttatattccagaggttggaatggaataattcactcatttgaaaggcttgctggatatcctctatttcagggctctccaaacccatactagtccatggctgttaggaactgggctccacagcaggaggtgagtggcggctgagtgagcgaagcttcatctgtatttacagctgctcctcatggctcatgttaccccctgagctcctcctcctgtcagatcagcagcagcgttagattctcacaggagcatgaaccctattgtgaactaagcatgcaagggatctaggttgtgtgctccttatgagaatctaatgactgatgatctgtcactgtctcccattgcccccagctgggaacatctagttgcaggaaaacaagctcagggctcccagggattctacattatggtcagtcgtataactatttcattatatgttacaaagtaatactaatagaaataaagtgcacaataaatgtaatgggcttgaatcattctgaaaccatccccaccaccaccagctctgtgaaaaaaattgtcttccacaaaaccagtccttgatgccaaaaaggttggggaccactgctctatttctcttcactgcttagagaatctgttcttccactcatgatctacaaggattaaatgtttcaaacagttcaagtcttcaaaatatgttttttgtaaacttgagtttttagaaatcattcacagtatccatattatattttatttgctgcaatgccctatacatttcccatataatgctcttgaatatacttttacaacttcagtaactttaccctttactgaatctcaatctgtctctcaatttctctctctcagcaaatctaaacaaaagagaaacatattgacttgtgctatggtctaaatgtttgtgtctctaaaattcatgtgttgaaacttaatctccaatgcaatagtattaagagatgaaggctttggaatgtgactggcagagccctcatgaatgggattggtgccttcataaaagaggcctccaaaatctccctagccccttccaccaagtaaggacgcacagaagtcaccatctatgaagtagagagcaagctctcgccagataccaaatctgctgacacttcagtcttaaactcccaccctccagaactgtgagcaataaatttctgttttatagttgtctaaattatcctgtctaaggtgtttttttatagtaatgtgaatggactaagacaacttgaaaatgcaaggtaccacaccaataacaaggaaaatactcatgttttgtaacatttattttataccaaagatatgccaattactgtatacaaatatatgccaaatgttgggtaaaatactttacataaattatattaatcctgaaaacaacctgaaggtagatactgttgtctgcatttaaagatgaggacgtggggcttgaattaagtaacttacctcacatctcatcatgctaaatggcaaagctgggattcaaaccctgctcagtcggactcccatcaggctgctcttagcctggttatattttgaagaaaagaagttcagaaacttatccatagacatggccaggtagggccagagtccagactcaactgactctcagccaagaccagcctcaactcttccattttacctccagcctgaacagcttaaacattttttctcttgccatcttattagaatacataatgcctataatgatgggatccaaatgatatagcatgacaacactctggtttaaaaaaggtgaaatgtaatttttttttttaattttaagttctgggatacatgtgcaggacgtgcaggtttgttacataggtaaacgtgtgtcatggtggtttgctacccctatcaacctatcacctaggttttaaggcccccatgcactagctatttatcctgatgctctccttccccccagccccccagtaggtcccagtgtgttttgttcccctccctgtgtgcttgtgttctcattattcagcttccacttagaagtgagaacatgcggtgtttggttttctgttcctgtgttagtttgctaaggacaatggcttccagctccatctatgtccctgcaaaggatatgatcttgctcctttctatgactgcatagtattccatggtgtataggtaccacattttctttttctagtctatcattgatgggcatttgggttgattccatgtctgtgctattgtgaatagtgaagcaaaaaacagatgcaataggaatgcttttacactgttggtgggaatgtaaattagttcaaccattgtggaagacagtgtggcaattcctaaaagacctagaaccagaattgccatttcacccagcaatctcatttctgggtatatactcataggaatataaatcattctattataatgaaacataatgtaaaaatacctcgagtgtatttgtattttggtaatatctgaataagacataaaatataatgcacacatctttatatcgttttatccatatctctctttctttaaatccttctggttaaaatttgtcattgcctcctgactatgtatatattttttcttttctggaagaaagctcacctaggccttactcaaatgcatgttctcaatctttacctaccacccctcctgcctttttgttccagtttcctcttatcattgtactgatgtggagatacgaaagagaatatcactgtcagccaccagcagtgccttttcagagaagagcaatggggaagaaattgagcagacaaagccagaatccccattagcaaacagaaagagggagctcaggataaccacatacattaataattcttgccccgcaaagggaagctctgtaaaataagttgtattacatctgtacatagcagtactttaaatataactctagcttaagtattttaagcatctccgtgatatgaacctaagggaataaactcaataaatcaatatttataagctctgttcacttatgtcttgtggtttcagccactgatttcagaatatgcatgaaaaatatatttcttctgaatatttgatttcatgatcccaagtagacacatctctgtattgggtttcaacaagtccacaaaagttaaatacctacttttagccagctttgattttcagaagtttaattctgacatttagtgatatacaatatgtaaaacaacctggcactatatctgttatatcataagtacttggcaaatatttcagtttactctttctcataattgaataatggctcaatagtaaaactctgtagggaaaaatttaacctcttatttatcaattacaaatagtttaagacagataatacccctttccttgttagctttaatgctgaatcattaaaattgtgagcaatgtatttattttgaggaaactattttttactaaggattttgttttttttttagaattttatgagtcttcaaaataactagaaaatcttaaagtgttaccaaacagaagtggacatttaataaacacctcaactttaatacttacagaaaatcatttgaaggctgtcactcctctgggtattataaattttagccttggtcaaatcaaatcaccaggaggctacaaacttgaactacactgccttagtctccaacagtttctttccttgaattaagttttcgggccatgctctactccttttaataaaagaacaatacaacaaatagtcatatgaaatccattttgttgcctaatacaaaaatattgttgaagagtatcataattcaatggcccatatatataaaatgtctcagcaaatgcacttatgtcataattcagtactaggaaatgatttccttcaggcaagctcccccttaattttttttttttttttttgagacggagtcttgctctattgcccaggctggagtgcagtggcaccatcctggctcactgcaagctccaccacctgggttcacgccattgtcctgcctcagtctcctgagtagctgggactacaggcgcccgccacca[136 bp omitted]cccggcccctccccattaattaaggtgagaaatgcataaatgatgatggtagtcattggtgcaccagttacgaaagagtgaggccgggtaactggatgacacctgcacagggctctgaggtctcaaggaaaatgacaggtgtttgtgtattccaaaaatgtggacatgatggcatgaggcccaatgaagaaggggtagattatgaatggtgttatcctgaacataaggagactaagatagtgtagttttaaaaatggcagcatgaaaaaaggtgaatgctaaccccaccccaccttatggtaagtgtctgaagaataatctttctagggactactagtgggtattcttaaaggacagaggcagctttctgtttgagtaggaaggtattggaagcagtatatgaaggaataaaaatataaaagagagaaatattggagcaagagtgggaagtatggttaaagataaagaaacggcagggcactttagggaaatatggtatgagacggaaaagacgcatttttgagtgatgaaaatactaatcatggctaacacttacatagcatttatcttatgtcaagcatttacgtgtgttaactgttatgatgctcacattaaccccaggaggtcaggcctatcactttacaggaagtttaagcaacttctgaaatattaacaattcttctgaattgcttctctggtgacaggaataagagtcgcagtagcatcaacttgctaaaaagtttaaaatggtgctcagaataaaggtattttactgctttttgagactcattgtaaaatggcttgaaatgtctttgccctgaatctctgccagtgggaaattggatgagttgctaaagaatatggaattaattatccaaaaacactttagatatttctctttgtatagggtattgtaaatggtctttagctaattataatttaatatctcatttgtctctctcatacataggtatatatgatatatacacgtgtatgtgtacaattcaatacatctatgtgtctatgtagctacctatgtatgcatgaatgtatgtatgtatctgcctatctattaatctatctctatgtatctacctacctatctatatctgtgtctatcaacttcaggaatgcttggcattcttctaacctctgcggggtatttagggattaggcgatgatgatagatttccagcttcatttctttttaaaatcttttattcttcttgctcattttccttttcctgtccctaaaggacagtttctcctcaatttaggacttcttccttttgctctcttatcatttgcacactttctgttctcagccagaacatcccttttgtgcactgtacaacctgttgacactgtcacagttgccacttgatcattgcagataaaggaggaagtagcaattctggaatgggtggcttatctcttggctttataactggatatcttcatctgccattcagtcactcttttttattatggagacatgttttctgggaaaatgctaccatgaagcaggaccaatctccagttcaaggcacctcttgatttgctcattccaaagcatcccctcttaggaattagggctcagatcatggggtcatctattctgtaagtaaaaggctgacaaaaagtctgttacttcactgctctttacattattagggtaatattaacaatggaaatccagtttgttcaataaaacaagtgtcgatgaagagtcaaactcggtaaaatattttaagagacttattctgagccaaatatgagtgaccatggcacatgacacagccctaaggagatcctgagaacacgtgcccaaggtggtcagggtgcaggttagttttatacattttagggagacatgagacatcaatcaaatacatttaagaaacacattggtttggttcagaaaggcggaacaatttaaagcagggattggggggggctttcaggctataggtaaatttaaacattttccaattgacaattggtttagtattttccaattgacaattggtttagtttgtctaaaaacctgggatcaaaggaaaggatatgttcaggttaagctaaaagattgtggataccaaggttcttctgaagtcttatagtggctgcccttagagataatagatgacaaatatttcctattcagacctttaaaaggtgcttgacttttactaatttcttcaggattgggagggcttggaaggaaaagatctagttatgtcaatagagattctttacagatgcatatgtcccccaacaaagggcagttttgcaggaccatttcaaaatatggcaaagaaacttgcttttgggataaaattttttttactttcttctttgtcacataatgttatgccagagtcagattgcaaagtaagccatgatatatagggttaaataaaatccatctgatgagaatttatggttagtaggggatgactccccagaccccttagataggaatttgggcaaaataaaaaaatcagagcttagtcttcacaagttattgaaaaacaatgagttaccaattttatttatttatattctttcagtggtcttcaacaggtggctcatgaattcacatatttgacaattttaatgtgaaataaatttaagatatttcaacaacaatcatataggaaaagatagataaataagaaactataaaaattatactttcaaacctttccctatctaagacacagggtttatctgatctcacatagatattggacatacgatttaatttttaaaattaatttttctcactttagaaaattggcatcttgaggccgggcgcagtggctcacacctgtaatcccagcactatgggaggccaaggcaggcggatcacgagatcaggagatcaagaccatcctggctaacgcggtgaaaccctatctctactaaaaatacaaaaaattagccaggcgtggtggtgggcgcctgtagtcccagctactagggaggctgaggcaggagaatggcgtgaacccaggaggcggagcttgcagtgagcggagatcgtgctactgcactccagcctgggcaacagagcgagattctgtctcaaaaaaaaaaaaaagaagaaaagaaaattggcatcttgaaacaaaagaaagtgtctgctttccccttaaagaatcataaagaaatataatcaattagactcagatagcctagaatttaaagcttaatcaattttattgattggcttcaagaattttattgaaatgtcatatatttataaattaagactaagatgatacatatactatctactgattttaaaatacaacaaatcatttaactaaataaaattaaagattgtagtcttttaaacttaccaaccagaaataataagccagtgaaataaaagatgttccaatagagaaatcctttgtcattatatgacatacattttaatatgttacacagataatctgtgtatttaaaattgaatgataaaaattatttgcaacatttaactgaaaaatttttattcagaatttatcttgagacttgacatgtattaatataattaatgtaccttataagtaaatattgattatattaaatttttagaattgggtcgaatgtgtatctcctctcctctgataacttagttcattctatgaaatggtgctagagactaagaaatacagaggttctgttatcaagtgtcatgaacatcaagtgcctttttctccactaatgttagaatgcctctccaattatcctctttagtaaactgtgagctgaaaatagtgaagtctgatattgcaagcaatgtctccagtataaagtttgcttgagatgagaatcttatctaagaacatttttcttgtcacataaagtatgtcacacggtggcatattcccacttaaagttaacgtgtactaatataaaggcctcagcggaatgtattaagtggatttcttttggcattgggtaaaggaatctttcaaggattctgtggatatacaaacaagaaacaaatttcaaaagaggcatatgcacaaaatttttataacctgttagaatcatgatctggactaaacacaaataagtgaaccgaagtacaacacaatacaaagcaaaaataaaaaataaacaggaaatttaattctatacgatgcagaaactatgtgccaatactcagtgtaaacatacactattaggaggacgttgctgccacacaagcagatggcagagtttaagcaaagctgaagaagttaggtagtggcgtgcggagggatcactttgattattggcgtagttcctaccctcctattattctggttaccatacattagtgaggtgtctccaatgggtttcgagggttacaaataccttcctgcatattagtctaccttccttagaacttcttaagatgggccattgtctcgtgatactcaataattcaggaaaatcaataattgggattaaaataaaccaattaattacatacttctttatcacagtgtgacataaacatacattttcagacaagttttcattactgggcaactatgatatctacccaatgttgtggccaaagttggaatattcacagttcccccatacttatgccctccgtgttttggttttccagatacatgctgttgcttgtacttcaaatacactttccctatatctctgtcaattcacgtctttctcaaaaagaacagagaagtcaaatggctcctctactaaacctctaaacatatatgatttctcctgtcttgacatttttaccaattcctgttctcattataagctatggtatccgactttcacttctcttcctctaacacccctggctttcttaccccattgtctacatagctcaacttcttgcaagttgtccattcttgctctctcctctgtctacagcgatttgccttctgctcccactgttcacaaaacttctgtcctccatgtattcatttacaatgttttagccttgggctgaccatacaccagctgttcacaaaatttatgttgaactgaatgacactcgaatcaataaatacaggaaaaaaggggaacagaaggggaagcaaacaacatccttcttcacatgatggcagaaggagaaatacagagcaaagagagaaaagacccatataaaaccatcagatctcacgagaactcactatcacgagagcagcagcatgggggtaacagcccccatgattcagttacctcccactgggtccctcccacgacacatggggattacggtaactacaattcaagatgtgattagggtggggacacagccaaactagatcagtgctgcaactgacttcactgtaaatgagtttacaatgggtaactccatattatctgaaccaaacagcatagagagacctcaagaagagtaaagaaatctttgtctcacgtacatggtataccatcaataatgaaactgaggaagattcacggagggaagtcaccaccctgcagcaggcaattatatctaaaccagtgagatatgaacagtgcaaagaagaactagaacaaagatactgtctggcatagaaagtccagtattaaagacacagaaggccctacatttgtccagtaaagccatgcttgattaatgccttggaaaccctggagactggatcagaaatctgtatataaaatggttcttcctggataaagttgagagaaaaagaaagcttattgtgttcaagtagaaactgggataagctgtgggccatctggcttttctgttgcaaaaaccagggcttaaatctacatctttctatagtcatgaatgagcaaactgatgttgaacaatcatctaacaacgaaatatttaggattcaaaaagaatgtacttatgaaaagaatgtaacacaagaaatctgaaaattagaaaatttcccctttttacactaaaaaagacagaagagccatgactttttaaaaaactggagcagtaagcttgtagtgggaaaagtgatggtgagaaatgcaggcatagaaaggaagcaggtttaagtaagaagagaaaacacaaggaaatccaaaatcccaaataaaataattttgccttaaattttattatgtttaatagtagactgctgttttcttttgtcaattgctgtcagataagttttgctcttt[132 bp omitted]aggaaccctgtctactacaaaataaaaaaaattagtcggctatggtggcacatgcctgtaatcccaactactcaggaggctgaggcacgagaatcacttaagcgtgggaggtgggggttgcaatgacatcaccacagcctgggcaacagggggagactgtctcaaaaaaaaaaaaaattagtggccgagcatggtggcttatgtctgtaatctcagcactctgggaggctgaaatgggtggatcacaaggtcaggagttcaagaccagcctggccaatatggtgaaaccccatcactactaaaaatacaaaaattagctgggcatggtggtgaatgcctgtagtcccagatacttgggaaactgaggcagaagactcgctcgaacccaggagacggaggttgcagtgagccgagatcgcaccactgcactccagcctgggcacagacagagagtccgttacaaaaaaaataataataataaaaataaaattagcaaaaaattagccaaaaattctttaaaaataaatataaatatatttatatatacattttattcattcattttatatacattttattcattcattaataaaatcactttattaatcattcaataaaatgaattcattatatataatgaatgaataaaacgtatttttccattagggatttaaaaggagcattggataaattaaaaattttttttgtcttttcttttgaaaaaaatataaatttaatgatgtatttttggactttgattaaaaataattcaattttatctgtcagcataaatattagaaatactcagagaaatttagcagaaggataagcatcattttgtaatgacaataattaagtagggctgcataagtggaagaatggacatataaatgccttttttttttttttttgagacggagtcttcgctgtgtcgcccaggctggagtgcagaggtgctatctatgctcactgtaagctccgcctcccgggttcacctcattcttctgcctcagcctccggactggctggtactacaggtgcccaccggctgattttttgtatttttttagtagagatgggatttcacagtgttacccaggatggtcttaatctcctgacctcgtgatccgcccgcgtcggcctccaaaattgctgggattacaggcgtgagccaccgcgcctagccagattttttttttttttcagaggctccctctgtagcccaagctggagtgtagtggcgcgatctcggctcactgcagcctccgcctcccgggttcaagcaattctcctgcctcggcctcctaagtagctgggactacaggcacgcaccactacgcctgtctaatttttgtatttttaatagagacagggtttcaccatgttggcctaggatggtcttgatctgacttcgtcatctgcccgcctctgcctctcaaagtgctgggattacaggcacgagccaccgcagccggccgacagactttatttcatctgtaaagttctataatgtcattcacaataaaataaaaagatattatgcaaaccaaacaaaattttgcaagatatgtgatacactatacatagaaaattcttgcatatcagtaagaaaataactataaatagataaaatccatgaatagtaacaaaagtataggatattagagaaaaagtatttgacagaatgaaagaaaaaaatggttgttttaggatcagtggtctgagatgcattcatgtgttacttcattagcttgtatgtatttaatatattctatatgtgttcaacaattgatgcagattcaaaaacaaaaaaaagttcctttagtaaggagatacacaacaacaaaaatttcctataaaagtggattacaataatgaaagtatctagaaatctaattttaaaaagtggtactcattatctgggatcatctgggaagaactcatttaacagaccatttgcgtagacacttgaggatgaagataaattttcaggcagattaataacaatggggagagttttcaaggcagaggagatgacttttataaaacgaggaaagcatgaagtttatatagcttgaaaagtgtgttgtattcaggtagtaatgcactgactccatcactcttgcattttgtttgtttgttttgaggcggagtctcgccctgtcgcccagactggagtgcagtggcgcgatctcggctcactgcaagctccgcctcccgggttcacgccattctcctgcctcagcctccagagtagctgggactacaggcgcccgccaccacgcctggctaatttttttgtatttttcttagtagagacggg[143 bp omitted]gtctgcttccacgtgtgttcagattgttatacacacttagttccttgagtgggtattattgcagtccccatttccttgctggccgtcagctgggaccagcctttcctcctagagactgtccctgttccttcttatgcttttttcatgggcctttccagcagcacgaacatttcaaatatctctgcctttccctcctgccccgtctctcagaaatcaactgcacatggtctcagcttttaagggctcatagtgattagattggactcatatacggtcctcattttaatattcataattctaactgcaaagtctcttttgtcaggtaatacagaatattcaggtctcaaggattaaagtgtgagcatctttgggggtttttattctgcttacaacatttacctagagtataaattcaagacataaggcagaatcttatgagaaaaagaaagtactattttgaacatacctgtggcaatcctaaatgggaattagattcagatttggcagttcttgataaaagtcaaggctgaagaaataatttggtagtcatcatgttatacattttgtaaatgaagccattattatatatgagagggttagcattcacccagggagacttcaagtcagtttacaaagttaatattctatggcacgttcaatagtagcaccaccttttattcaattggatagtagcctggggtgaagattaaaaagaaagaaatataactatctctatatggagatgccatgaggtataaagaatttgtatatagatatacatggaaaaatatttatgcatacaggaaatcctaaggaatccacacacgcacgcacacacgcacgcacacatgcacacattaagatgataaagctgtgatatttttaggcataactttgtagtaagatgttacatcaggaacaggaaactactatagcaaagcacccagaatggtctaaatagtcttgaaacagaaaattttctaccaaactgtattaattcggtgttgcattagcataaagatagacatataaatttaatgaaataatattgagcattaatcaataaaccttatatttatgagcaattgatttttaaaaggatgccaagaaaattcaaaggggaaatagtagtcttgtcaacaaatagtgttgggacaactgtacatatgcatgcaaacaaacgaagttggattctgaccttaccttacacacaaagttgatcaaaacctaaatgtaagacctagaagtaaaaaactcatagaagaaaacataagcaaaatcttcatgaccttagattaaacaatggtttcttagatatagcaccaaattacaagcaacaaaagaaaaaaaagggggctatattatgcttaattaaaactaaattttttcttcaaaagaaaaagccaaggaagtgaaaagacaacctacagaatgggagaacaattttgcaaatcatacatcttctaaaagacttgtattcagaatatgtatcttacaactcaataataaaaaaacatataacctatttttaaaatggagaaatgatttgagtagaaaattctccaaaaaagatacacaataggcaagaagcacatgaaaagatactcaacattattggtcatttgagaaatgtgaatcaaaaccaccaggagataccatttcatactatgatcaaaaagaaaataacaaatatgtttgagaatgtggaaacaatcccacataaattgctggtgggaacgcaaaacgatgcagccatggtaggaacaattttgcagttgcactttgggaggccaaggtgggaggatcacctgaggtcaagagtttgagtccagcctggccaacacagtgaaaacccatctctactaaaaacacaaaaattacccaggcgtggtggcaggcacctgtaattccagctactcatgaggctgaggcaggagaattgctcgaacctaggaggcggaggttgcagtgagctgagaccacgccactgcactccagcctgggcgacagagtgagactctgtctcagaaaaaaaaagaaaaagaaagaaagaaaagaaaaaaaagttaaacagtgttatcaaatgactggacaattctactccttaggaatatctcccaaagaatgaaaaacatgtctacaaagaacctggacacaaatgtttatagcaacattatttgtaatggccataaagacaatgcaaatgtccatcaattgatgaatggataatcaaaaagtggtatatccatacaatggaatataatttagccataaaaggaatgaactactgatacatgatacaggtatgaatcatgaaaacattaagtgaaaaatgccagacacaaaatgtcacatattctataatcctacttatatgaaatgcccagaaaaagcaaatctatagagacagaaggtagatcagtgattgccaggggctagagagaagagcaaacaaggactggctaataagagacacaggatttttttgttgttgttcagtgatgaaattattctggaatttgcaatgattataccataaccttctgaatatactaatcactgagctgcatccttgttaaggacaaatattatggtgtatgaattatatcttaattttaaaaagtacagtaaagtaaaaaccaattgtgtttcaataataaaatattattttaatatcactatattaacaatatggaagaaaatctcatctcaatggatgcagaatatattttttaatattgcaaacaatagaatggaatgtatttaatctggtgaaagataatcataaaatcttacaaaaatattataattaataaggaaatatggaaagctttccttatgggatcagaaaaaaaattccctagtcagttcaataagaaaaaaaaagtaagaattagcaagaaagaaatacacaggtcattatttgctaaggacattattgtatatgtagaatatctaaaataaaatattagaacgaataactaaatatagctatcaggatcactggttacaatatgagcacataaaagtctattttatttccttacactaccaataaccaattacaaaataaaattttataaatatatcatttagaatcaatattttgttaacttcataaaattaactggaaagtttttctttttaaatatattttcaaaaattgaagaattcttcaagtcagttaaatggttttaaatatttctggcctgcaacaacaaggttaaatctgcatgtgataatggatctctctactgatattagagctatcccattattgaaaaccatttttagatataaatggcaggcacctaagaatgacttaatttcctgtggtgttcctttaaaacaattttccaaaacaggcaaatcttgctctctccctctctctttctctttaaaaagtaacacaggcttatttttaaagttgcaatcaaaacagacaggtaaaaagtagaaaattaaaatgacccatcaggcttgtcttaaaattaactactgataatattttggtatatgtcctcatatgttttagtgtattttttcaggtttgttctatcaaaacctaatttaacaaaatctgagcaaatcatccacttcctttcctaatatccttttatactgtgtgtttatacatgtggttatgaatatatgttcacaagtgagggtatatatacacatacacacatacatgtgtgagatagagacataggcagaggcagacagaaaggcagagaatagctaggaaagttgagctcaatttaatattgtaattataatatgcatgctattttaaaattgctttcatttctgaatttagacagcatatagaacttgataaatacagtaattagaaatccgagagttatttgcatacttacacatctgaagtatcttcctatgtacagataaacattaaccacaattatctacacatgttgcttaaattttttcctccagctgtcatgttaaagccatgattgacacttgtttgcatactatttgagaatttaatatttggttgaaattctctgatcctaaaacatactgcttggaaatacacattttgttttcatacacatgagatgttgcatgcataccgaaattaaagaattacaattagttggtacccagcttgcatccttaagcaatctttgtaaatactatttttcttattaacgctgctttctgttctcattaagtttcaacagagtactctcagtaatttaaaacatattgttccttcagttaaataggcaatttccctctcaacaaatgcctggaccttaaagtaaggtgtggaaatggacaaaatagtcccaaatattttaaccagcaatataaacttttgcaatgcttttataggatgtttaaaataacaagaaagacttggttctcgtgattttcaccaacggtggttacaaacagtcttcttctttactatgtttgaatggcatatttcacttcacatatcctttacttgctgctagagccttaatattgctagggggaaaagcttacctagctccgtgtttgtaaatgtcagctagccaaaagatatttggaaacctataaatgttcgcctttctaacatttgcttaaagctatctggaattaacgttctcctctttcctcttctctcacctcaagaaaaaaaaatctgtatacagaagttgacacaaaatatattaaataaggctggtattcagccctcttgcattcaagcaagaattacccatgtatgtaaaacagaagaaaatgtcttgatagtattctgtacccgtgctgtcaaactaccctttgatatgtctgcaattttctcagtaaaacacattttgtttattttggattaggagcaagctcttgcatgtctaccaggatttattagcctggtaaagaagcagcactacacagaaacaacgaatataatgtgctctttgctatggttttaaggtccccttcaaactcatgtgaaatgtaattgccattgaaacagtattaagaggtgggggctttaagaagtcatgcaggctgttgtcggtttttttcttccaggttttttctatcaaaacctaatttaacaacatctgagcaaatcatccccttcctttcctaatatcctcattttcactactctctccttcagccgcaatgatccattccatcatctaacattaatttagtaaagatttactaaatcccttctctgtacaaatcattttataggatctgagtaaagatacagtgattagcatatggcagcccttgtcctttaacatggcaagaacaacttttcctattttcaagagcttgagtattctgtcactaacagatctaaaactatccaagtttacctggccaactttttcccttaaacttctgcctcccttttacaaaacttcaaaaaaaaagaattccaaatttaatcatgctgttaaaacagattttcacatcatcccgtagttacataaagggcagtctccttagctcatacttaaaatcatatcttttcaacccttgagtattgttaccattacctcaaacgatcatacagctactgtctttcaggttattcacaatacaataatttgaatatgcaaaaacaccacagaatttaaatgaaaagtaactaacgcaccctactcccctcaaaaatcaattaataaaatttgtaatttcaacaaatatttttgaatatttacaaatcagaaacaaaaatggctaactggaaacacaaaacagataaaagatttggtaaattaacccaacatgcaattttgaaaaatgtaaatttaatttttacttaataagtgatttctcaaaaagtaacattaataaagggcattgtcagaaattttgagtcttttaagagtgaaaacatctgtttgaactaaaactaggagacacagaatgataagaacatatgaagttttagctaaatatccatgaattacaaggttattctctgttggtttggagtactcatttacacactaatactcagctttaggaatttagggctcattaactttgctaaacatggaatttagggtttttttaaaaactacttatttcttcactatttttatatccaagtatactcttctcattactcacaaaggacaaatcttcaccaagcccctgcccctacagtcaggatagtaatttcattcaagcatcccttgaaagcaattatttatgctcgctgcagaaattagggtaaatttgttgtggtcccatttattttctggagattggcgattacatgtaaaataatttgaacgcttgataga[140 bp omitted]ggtgaaaccccgtttctactaaaaatacaaaaaatattagcagggcgtggtggcgggtgcctgtagtcccagcaacttgggaggctgaggcaggagaatggcttgaaccagggaggcggagcttgcagtgagctgagattgtgccactgcactccagcctggggaacaga[142 bp omitted]taaaaccccgtctctactaaaaatacaaaaaattagctgggtgtggtggcgggcgcctgtagtcccagttactgcgggaggctgaggcaggagaatggcgtgaacccaggaggcagagattgcagtgagctgagatagccccgctgcactccagcctgggcaacaaagggagactctgtctaaaaaaaaaaaaaaagtagttattttcttcttcatccctttcagtgtggccactatttataatgcagtttggttcattagtgtttgtattccaaaaacaccctcagccttcctatcctagttttaatgaattattagtgtgaaacataataagggtcggagctatacagaaaggtctactcagaggtgctttgttccctcctattctgttcccaccactcctactttccactactttttccactgaccctgtgagcatcatatttattgttaatggcagttacatttttaccaagtgcttactatctgtaggcacttggtgtgtattgcttcttctggtgttcacagcaacctcttgaggtaggcactattattatccaccccaccccgccccgttttttgagacagagtctcactctgttgcccaggctggagtgcagtggtgcgatctcagctcactgcaacctctgcctcccaggttcaagcaattctcctgcctccgcttcccaagtagctgcaagtacaggtgcgagccaccacacccatctaattttgtatttttagcaggggtggggttttgccatgttggccaggctggtctcaaactcctgacctcaggtgatccccattttttagatgagaaagcagagtcccagagagcataaggagcttgtccagagtggcatctctgatgcataaccagtactcaaaccagtatttttctgacaccaaggcctgtgtgtaaactgtaaaagggctgtttggtacctgctttcctaaagttgtctgatcccttctcagtccaggtcttcctgaagcttggcacttctgaagtcacctttctgaaaacattctggtaactgttagatcccttgttgtagctattcatatgttctgtgtggttaaacaaggttcacagtgggccacctggcctttggaacttggctgaagaggctgccttcagttcatcctccccacccccattttcaaaacatgggtttccatgtgttagttgtaaattaggaaacataaccatgttttgaggcttcatagaaaacaaacgtctggggtcacacaggttaaaggaggaaccaaattcagcactatcactgttctattcagcaggcaattctggggccttcctgtgtctcaggttctgtactagttgtttcaggactttgggataaacacaaactatccctgccctcagggggattaaggtcaggtgtacaaatgactctaatgcgaggcaaggctggattcagtgctggaagaggagggcatacctaatgctatgggaattcaaagaggaaatgatcagaatgaggagggagagatgggtcattccaggagaagcttcagggaaaagcaacacttgaaatgagactttggagagtgagggaggtttgggcagatggatagagaggatgcaaggccaggggaaaggtttgagccagaaagtcggcttgggcaagtgcatgggtaaaaaaagaaaatccactttgggaggccgaggcaggagttggagactagcctggcccacatggtgaaaccctgtctctcataaaaatacaaaaattagctgggcatgatggtgggcacctgtaattccagctactcgggaggctgaggcaggagaatcacttgaacccaggaggcagagattgcagtgagctgagatcacaccactgcactccagcctgggcaacaagagtaaaacttcatcaaaaaaaaaaaaaagaaagaaagaaaatcacaaggcagtgtggggaatggtgagtaatctaatttggttgttgcagagaggatgtagaaggaagtgacgagagaaagccagacaggtggcttggggtcatcttaagggcctttgtgccagttaggatgttccagactttagtcaggctgcccagctcagactggctcagacaatgagggggtttattggtcatgtaattgggaagtccagaggttctaggactacagaaaattattatttagtattagtttgacagcaacaccttctgttttctgggagcaggagatgcttgtcaagctgtaggtcactgagttgaatattagcctgctttattaaattgccaagggcacggtaattgttgagaggggagaagtacacaggaaaaaaacatgaccagcttagaaacgtcaaatgattatgacgttgttataaagtattataattctttgagcgtctactataagtagagaaacttgagttccaggttgtgggcttggttccgccaacaatcaggaacgtggttttgcatgaagcccttctttcttctataatcttcagtgtcctcacctgcaaaatgaggcctttatatatatatatatatatatatatatatatatatatatatatatatttttttttttttttttttttttttttttttttgagacggagtctcgctctgtcgcccaggctggagttcagtggtacaatctctgttcactgcaaactccccctcctgggttcacaccattctcctgcctcagcctcccgagtagctgggaccacaggcacctgccaccacgcccagctaattttttgtgtttttagtagagatggggtttcaccgtgttagccaggatggtctcgatctcctgatctcgtgatctgcccgcctcagcctcccaaagtgctaggattacaggtgtgagccatcacgcccggccaaggcctttattatattacggttcctactgttttttaaaatacttttattaagtccaacatttttattaagatcattgcttttatacatgcctatttatgaaaggggtttttgagtgtttaccactttttattagaaatagagacagtaagaatgtttgacttaattgacacaggcataattgaatgggtataaatggcatgccatagaaagagaaaattaagttgagctactctgttggtttcactgatgaggggatacatcattcaaacagccaggaattaaatccgtccaactcacaaatggggaaaccagctgtgtctgtacccatggccagccagattgaacacaaatcaggaaagtcagtaacttttcctcagttctgagggacttcagtggctgcggttcattttccttttgcttctgaaacagtgcaagttgatgctcgcctggacagagcggcagtgagtggtggcatctgaaggccaggtctctgttgagatgactacacgtcgtctcccagtgcccaatgcatagaaaagatacactactaagtgtgagatcctcagtgaaaaataaaatctggggttgaatcatcatgggggatactgcatactctgtttcccccctgcagatttccaatgctcattagtttatagagactctgagaattcctacagcaaaggcacctgccgaggtatttacaaactagtttagctaaaccagactttcaacaattggttactaaagaccactcaaagtctgtcaacactctgtcatctctacgtaatgatagaaacatagaaattcagggtaaatgtttagaaatttctatagaaacttgacattctcccagcatctgtatgtgacatcaggggacttgtctcaatgagcagttacagaccaactgaggttttgtcagactcaatggaaagatgcagaggctgtgagctgcaaacgagtcacatgcacaaggaccacattgcaagctgcgttctttaaggttagtttatcaactatagtataatctcacacatctgaaaaataggaacatctattctataaagtcttatatttgcaataattttaattttaaatcaagccaatgttagcattattagtgaaaacaaaagaaagttgtattatttattattaaacctaatttgagagtgaaataaattgtattaatttttttaaccaataaaagatgcaccttgtaaaccaagagatgattatgaaagtgattctgaggacatgaagaccaaaggagtttgtcctcgttttactcagaagtactatttctaatggacagatgatccctgacatacaatggtttgacttataattttttgactttatgatggtgtgaaagtgatatgcattcagcagaaaccatacttcagtattcaataaattacatgagatattcaacactttaaagtgggtttgtgagagataatttttgcccaatggaaggtgaatgtaaattttctgagaatgtttaaggtaagctaggctaagctatgatgttagtttaggtgtattaaatgcattttaatttaatttaatttaattttatgttttgagacagtgtgttttgttcttgtcacccaggctggagtgcaatggcatgatctcggctcactgcaacctctgcctcttgggttcaagcgattttcttgcctcagccttcccagtagctgggattacaggtgcgcaccaacatgcctggctaatttttgtatttttagtagagacagggtttcaccatgttggccaggctggtctcgaactcccgacctcaggtgatccacccgcctcagcctcccagagttgggattacaggctgagccactgcatccggccttaaatgcatttttggcttgtattttcaactgatgatgagctataactcctttgtgagttgaggatcatctgtcttgaatttggttttacaggcataactgaaggtgaaaggacagaatcaccgtgtgttactggcacaggtgcatcggctagtgaagaaagaagacattcaaactgtaagttgcattcacgtgggaagcacaaagaattaaattcaaaacaatgaaacattagagaaaagcatggagttaaaacacaacagaatcagatgtttactatttctcattttaacactagtgctttgcgggcttctaataaagttgtactccaggaggctaagactgaaaagtgacactagtgaaaaatagcattgaaatagttccgtagaaaagttgggtgaatgtggggcaaagatgccactaaactttaattttccatcgacacacaaattcaaagttttccagagctggcaagtaaaatggaagatccactcacaggacacatgcagcgtgtgaggggaatgcttttcagcacttcttgatggatgcacaaataatgccaacgtggtaaatgtctttggtaaacgtgcaatggaatgtagtggttgtgtgaaggaagaattttgttttcagcttcatttttgataaacacaagcagctctggactgtgtgaaaccatggagcactgcacagttaacagaggtggtttggagttttttagctttgcataagaggatgttctgatgcagaatctacagtgacaggaaaccgttctggacaagttacagaattaaggagcttgtgccgggatggaaataaatcaatgacttctgtctttgagaaggtttttctctgctcctctgtgatggttaatttttttttttttttttttttttttttg[131 bp omitted]cggctaattttgtgtattttttagtagagccaggtttcaccatgttggccaggatggtctcgatctcctgaccttgtgatccacccgccttggcctcccaaagtgctgggattacaggcatgagctaccatgccccacctttttttttccttttctttcttttttctttctttctttctttttttttttttgttagtccttccctccagtgtcatggagataattggaaaatgttttagagcaaaaaagtttatttctccttcttgttgttagcaaagaaatttatttttccttcttgttatttattggccttggagacatacaccaaatagctcattctacttctgaaattttgttttgatttccctggccctccccacgaagtatttcagattagcagggagtcaagtattgtctgtctatctgtgaataaaatatttcaggctgcttttgcataatatacatgctcttgcctttacgagtcacactcacatcttctggttttgtaaaacaccaggtaaagaagaaaacaatgtttctgaattctgctttatcagcccagtagagaactcttcccttccctgaactgagggctacatctaaggggttgaaacagggccagtttacagtgattataaatcaaatgcctgaagatgctaagcttaggacagtgtttgctgtacaactttgataactgaacatttttaaagctgaaaatgtgactgtgtgtgtatatgtggcatattatccttagatgatccttacttcgattattaagaattttttcccctagtaatcttcaactgtctcaatattcagcaggaaccccttggagacaaagatcagtacgaatttggaacacctattgacaaaatgaatgtaatttaatttaggacagtagtaaagtcaaccacttttaggtgttgatgctgctgaaagtatatataagtgcagagatgacatccagaacttgtcatgaatattacaaaaaggtctctaagggctttatggaggtctgtaaattgacttcatgtgaaagagtgtaagaagtgaaaatgtgaagcatgactggagagccagagtgataaagcaagggtccctttttccagatcctttgtaacagtgtcatgtgacctcttctagatcattctgaaagacaatgccagctcggaacctaggaaagcatccagtgggtttctgcatgttaggtggttcaaatcctcattagcacctttgttttctctgcctcagtttgcttacagtgatgttctcagtagctgtaattgctgtctgtctttgaatatttaagcatttttttttagatcacagggtatatgtgcatttttattttaccaagtgttagaatttttaccctgcctttgtgggctctgggttagctacttggttgtttcatcgtaaaatgattagcaggaaaaactgtgtgtgtgtgtatgtgtgtgtgtgtgtgtgtgtgtgtgtattttaagtttcttaattgggttgggacatgtaaaccatttagaacagtgcctgctgcataccacatccccatcagtattcacgtctctcatattctaccctcacacttgattgatagtttgcttgattatgtatttctaggttgaggataattttaccttagaatttcaaagtctgtactgttgtcttctaaccagtcatggtggtgaagcctcatgccatcctgagtttcacttgtttatgcatgactttctccctggaagctttaggagttcgtcttttccttggtgagctgaaatagcacaacagtgtacttagtgtgggtcttttttcattcattatgctgggtacaccaaatgaacaggcctatggataggctctttcaaagttggagtcttgaatcttgtcatatttttgttgttaactttctcttttccattttatttgttcattttgaagtgtctgttaattggattttagacctcttgtcttgagtcttgtatctcctgttatttctaaatttttttaaaattttaagttctggaatatttccttatctttcgactttcaggaaattttatttggactgtcataactttaagttttgttttggttatttattgttgtttaaccaattatcccaaaacttaatggcataaaactacacatctgtctatctgtcactactgtatggattacctggggctagctggacagtttttctgctggtctcattttgcagctttcactgtgtggttaaacagtgtcagggactggtcatctggatgctcagctgcagtggaatgtccgagacggcttcttcacccacaggtctgctgccttggtaattcttgatgtggcctttctctctgcatagcatctcatcctctcggatctcttcatgtggcttttctttctccaagaaggtagtcaattcttatttttggcttccagaagcacagaaatggagctgccaggagttcttaaggcttagacctggaacaggtccagtgtcatttctaccacatgctataggttaaagtgagtgttggggccaacccagattgactatgggatgggcctgtctaaggacatgatgacaggaggtatggctcattggagaccaactcccaagatgaagcatgagttctaagaactttttcttctctgattatttcttattcatattgttttgttttatgcatgtaatatattcacaagtgtctttatgaagtgattttgatactctttgtcttctccctggcatctccttgttctttaataatttttttccttggtttattttggtcttatttttctttttaaagcctttccttaaatatctattctatgttgcttatcatttgttgtctttttttttttttttttttttttgagacccagtttcgctcttgttgcctaggctggagtacaatgatgtgatctcggctcaccacagcgtctgcctccaaggttcaagcggttctcctgcctcagcctcccaagtggctgggattacaggcatgtgctaccacgcccagctaatttgtgtatttttagtagagatgggatttctccatgttggtcagtctggtctggaactcccaacctcaggtgatccacccaccttggcctcccaaagtgctgggattacagacatgagccaccacgcctgacctgtaatcttttttccattcctttatttgttcattcatatttgagagaggtactaaaagactgggagccggggtgtggtggctcacacctataatctcagtgctttgggagaccaaagtgggaggatcacttgagcccaggagctcaagactagtttgggcaacatagtgagaccccacctttaaaaaaaaaaatagctaggtgtggtgacacccatctgcagtcccagctactcgggaggctgaggcaggaggattgcttgagcccaggaggttgaggctgcagtgagctctgatcatgccactgcattcctgcattccagcctgggcgaaagagcaagaccctgtctcaaaaaaaataaataaataaaaataaaaataaataaaaattgattgggagttctttgtggccaagacttgtcaactgatagctttaaggggaatgtatgctgattcctaattgttatcctccatccctctatcttatctcctggtgcaatcataaatgatggctggatgactactccattcctctggatgtaaaatctacattctcttgcctgaggtggatacgtttgcttgggttctgtttaaggagatggggccagcagtgtgtttcagggcctgtgaaatgtgttctctatccgggcttttgcttaatctctgttttcagtcttgcctatcagtcccactgtcgggggtacctcgtgtctgagtctagaacctttccaggttgctgtgggacagattagcctccttgtcctcagtatccccctgacctccacctttgttgctttgctccatgaattaaccattttccatgtactgtcattgtgtaatgaagatgaattctcttctgttggtaaccccattccttttttgtaattgtgtgcttatacaatgtttattcttcactgtatttctattggagcctcaggacaaagagcagatggtgagaatctatgttcagtgttaagttttccttctgtaagacatgtgcaacttgtgtttttcactgaatagatcatggacttaatgcatatagagctactttgtttttcatgattgtgccttcaattatatgtagaaatataatttgtgaattgcctgatgaaattttcataattttgaattgtctttgcattcctataataaacactgttagaatggctatggtaatgttttatttttgcattcttctgtattaaataagattatagttttgtttgtttcctttaaggctgttatttcatttcagtatcaagggtatgcagggctgagttgggaagctttacatcttttttctaagatctaggatgtagatctggtttacacagtaattttcaactgcaggagtattttgcctcctatgggacgtttggaaatatctggagacatttttgtggtcacaactggtcatggtcgggaggtcttattggcattctgtgggtagagggaatgttactaaatgcccgacaacacaccaggagaaccctccacaaagaattatctggcccaatatatcaatattgctgaggctgacaaattctggtttaaataaatatccaatttggaggatgagtctttgtctttttccttcttctgcatattggtctccagatttcccacttcttcagttagttttcgtaac[157 bp omitted]tacaaaaaattagccaggcgtggtggcgggcgcctgtagtcccagctactcaggaggttgaggcaggagaatgttgtgaacccgggaggtggagcttgcagtgagccaagatcacgccactgcactccagcgtgggtgacagagcgagactccgtctcaaaaaaaaaaaaaaaaaaaaaatgaacatgtcatccatacttctaaggtgttgtaaagatgtgtaaagttttcactttttgcatcatattcacatgtggctatatgcccttttctcttcaaagttttctttatcttgattacttatcagaggtttgactgttttattttcctcagtcttttgaaagaatcctccttcagttttattttttaaatctagtggtttttctttttcctttttccttatgtcttaattatttccccctttttgtttgttttgcttttcctagtttagtggatcaatgtaatttaaattgctttttaaacaaacatgtaagggtatacattttcgttgggtgctgtttgactttgttgcacaagttttaaaatctattttttaatagtttgtattttctaaattattttattgcatcttttgttcacattgctcttactattaattttttatttttattaataaataaataaattaattaattaattgagatggagtcttgctctgtagcccaggctggagtgcagcagcatgatcttggctcactgcaagctccacctcgggggttcatgtcattctcctgcctcagcctcccaagtagctgagactacagctgcctgccaccacatccggccttttttgtatttttagtagagatggggtttcaccgtgttagccaggatggtctcgatctcctgacgtcatgatccacccaccttgggctctcaaagtcctggaattacaggcatgagccactgcacccggcccaaaagctttgtgtttttacagatattagacatgtttcttgtttaagaaaaaaaatcttaacgaaaacgtaggagaataagagaaacatttttccaaaaaagagaaatcattgtgattattttatcttattagaatgttggataatatagtctgcttcattaatcatcaagcatgctatgcattttccatttttataggatctgtatctcagttaagataatactggtaatttttatactgtaatcaaagatgaaaaatgtaggccaaaatcatagaccttgcatagaagctggataatgaagacagctatagagaaaaacacagatacacacacacggacacacatatatatataaagtatacacacatatattttttaaagttttaaagctgttaaagcaaaagctggcccctcttctcttccagagtgggaggcctctcccctctcttagagtgggtgcggagagcggtcgcatgggcagctttccttgtgagccacagggccctctggacacgctgctgtctggccacgccccctttccctttcatctttctcattgaccaatgggcttggagcattaaggccacgcccctattccgcattctactggggccctggttacgcctcctctggctcagtcacacagctgcctggaaggtgactggaggccttgatcggttctcattgcgattttgctgctgtggccccaaccctgcctccctccccaccctgcgatggcagaagaaactcaacacaacaaattggctgcagccaagaaaaaggtaaaaacgcactaggtcatagcccctcaacccagccacagatcccctctgatgacaagacccctgccagagtctatacgactcctgaggcacactggactgttccccccaaccccggtgccttgggctacccccatcaaagttttgtcagtcagccccaccccttcagaaagcagcccagtccttgccctcgccaatcaccccagggtgactttgggtgggtgactcctgggacttcccgctccgttactgggccctcatctcctgccgccccaagcttgatctccctgggctctttgggctctcatctccaaggagccaggccccaccctcgccaatcatccctgggtgactttgggctggtgactcctgggactccctgctgcagactctgccctcccctcctgctgcctcaaggtcgacctccctgggttctttgtgctggcgtctccaaggagctgggtcccaaccctgtgcttccctcccccatcgtggagcggcgacttagacatggtgctgacacggtccctccccctgaccaggaggattggaatgttgtgatgtcacagcccacctagtaactgccgttactgcaagactggcctttgatcttatgacccagtcccctaagcgttctcaccccgtttctggttcctctggtcacaggacaaatttccagctggaaggggaatggagactatgggacctaggagcaagaggttccaggctgcctcactcccttacagatgttgacggtgggaaaagcctacacttcccccatgaactcaaaacattgacagtatctctgggtggcaatgagagaatgggtttggtttggttttctcccaggcttctactttccagagagattttaacattttttttctgagttctccacctcatattctaattctccatggttctgggaccagactctccttcagtcagtggtctctgaagtgacatttgctcatcttctgtggaatagatcttgggaaactgaacttgacaccttgaatcttcctcatattatctcaaccttgggtactttgagtgccacaggataaatgtgggacatctttctgaagcatcagtttcccttgattctcttgagatcaagagaaaaaacatgaatatacttagggatgacagtcacataggtttctaagagtataccagccctctctctgaaatgaggcttgggttgtcctctttctgatgaattctgatttaagagaaaggctgccttctgccgtgaggacacattgatataaaagtttgagaggtactggtgcacttcttcacactaacagacgtgtgaggatgtatgactctaaaccacatggcatacagttcctgcctacttaatgtttacttttctacctctgcctctggttttggtccctggcagctgctgattcttggcaaaacctcagagcttggagtcagaagactgagtttcaaagtgccagtattgcctttttctttttttttttctagccatgatatcaatccttctcagtcactaaatgagtgtgacaacaccttgtacagttgttggtgtcattaaatcagatagtgtgtaagtgtattttgtaaaaactgtaaaggaggatgtggctgtaggggctgacggttctcatgagtattactgctcttctttccaacagttaaaagaatattggcagaaaaacagccctagagttccagcaggagcgaacaggaacaggaaaacaaatggcagtatccctcagacagccacttctggtggttgccagccacctggggatgtgagtcttggctgaccaggcttctggggacagggggcccaaggggcaatagagggtaattgttaagattgtggatggactgctgggtacgggttaagaattctggctttagccgggtgtggtggcccacgcctgtaatcctagcactttgggaggccaaggcaggcggatcatgacgtcaggagatcgagaccatcctggttaacacggtgaaaccctgtctctactaaaaatacaaaaacattagccaagcgtggtggcgtgtgcctgtagtcccagctactcagaaggctgaggcaagagaatggtgtgaacctgggaggtggagcttgcagtagccaagattatgccaccgcactccagcctggtgacagagcaagactctgtctcaaagaaaaaaaaaaaaaaggaattctgggtttgaatcctgcctctccatctgctctgctagggatatgatttagggcaagttgctagacctcatcgggcctctcttttcacatctgtataatagaggtgttattgtttcacttccatttgtgaaattttcatgagatttgttattgttgtttttatgttaatccctagtacatggcctgctgtaaacactcaggacacccaggatatggtctttgctgtttgattttcctcatccccagtctcaaggggaagccaggacaatgagaacagccacttgccatcaggagtcactgaaagggccccaggatgggatggtggggagataagaaccatgagagaagttggcacaaaggagttatgggacaaagggtccaagataggcagaaaagaaaatgttgccagttgatggggaagaaaggaagtcagagggctcagacactgtgggggacagaacatctccatgtgcactctcatctcttgtagtcagcaacaggttttcacagggaaggccctacatcatctgctaccctgaaagatctggaggtaagaggctctgggcagaggtgcagtgacccttcgggtcagccctccaacctcctcctccaggagggactgggtgcccctctgccagctgagacagcccacacaccccagccctaatgattgttctctctacctctcccccgactcctgctccacctcctcctctctgcatgaacctcagagcccgtgccaagaacgagcagtagtcctggattcaaggtccgtagaaatcagtcaactgaagaacaccatcaaatctttggtaagagtccggtggggtcccctgattccacgctgccaatcctgggctccagtttccccttggggccctgaagaaaggggctgggggtccctggtgcccgggacaaatagggagcttgggtgcccaggcctcacctggagggaccccagagcatgcagcatggctcttcttttgctgccctctttgccgactctctcctctccagacacccctgctcgagtccttgctacacacgccctggggttgttgcctcttggggaagtgctagcctgactggttgtcaagggccccgtatttctgccatgactcagtccctaatttgctctttgattctggacaagccacctctcctttttgggctcgtgtttccagaggaggtagtgagtatcaaaggtctctgttagctctcgagtctgagatttaaaggcccccgagaatggaaacctcagggctaagggctcctgtctgtccttttctatcctatatctgctgtgaagaaccgtacctggcccatacgtgctcagtaggtgtttattgaatgaacccacttttctaaatcacaagctgccagaaggaggggcctttctgaaactccatctctagaggtttatgttgctgtcctctcaagagattccagattcagactttgagttctgtggctgtgggcaaaagcccacaaagacccaaatcctctgtccttgggagcttgaggagagtttaccagttcgtgttcccattatgtctgagaactttgcctttaaaatccattcctggcccctgcctaccgcttcctggtctggggaatagagttgagggggccaccctccatcaccttatttgactctccccacagaaacaacagaagaaacaagtggaacatcagctggaagaagtaacgtgatttcgtttccttgcaacatgactgctggaagaaggctcacccttcagattccaccccatcccctcagggccccgataacctggtcccatgggtgggcctgtcctggggcattggtggcattctgggggcatgtctcttgctgtgccatctctgcctccccctggtaagagctctgtcttcctcttcctacaggaaaagaaagcaaacatcaagaaacagaaagccaaaagggtgctagaggtgagtggagggtgtgcagtttcctcctgtcctccggagaaggtttctttccttctctttcagcacttgcttggcttttctcccaaaggttcaaatccagacattgaacatacagaaagaggaactaaatacggacctgtaccacatgaaacgttctctcagatactttgaaggtgggaatctgggcaccctgtcatccttcaacctggcactttgacaggtcttcagggggagtcctttgggccccatctcaactctctcattacagaaaagtccaaggatctggctgtccgcctgcaacattcattgcagcgtaaaggagagttagagagtgttctctctgatgtcatggccacacagaagaagaaggcaaaccaggtgagtccaaccacctgccccatcccctgggagtctgcctttgcagatggaggagtgagcctaaaggtcccttctgcaggatggcgtgtcctgcccagaaggcagcatggccatttcttgctacttttttgtatggtttttagtggcagcctggggctgagtcagctgctgtgggtgagttgggggtcactgtgtggagtgagcactggacgcagagcttggaggccaagtgcctgccccgcccttacctggctgtggtcttgggcaagtcctaggtggggtattgggtacttgtactgtgaaggtacagaagagtacctttagtatgttaccatttctgtagaaagaggaaacgtgtgcatgtgtgtgtgtgtgtgtgtgtgtgtgtgtacatactatgataatatacataaaacatgtctgcaagggttcataaaaaattcaggagagagcaacaagatggccgggagatacttcccttctgtaccttctgagttttggactatgcaaatgtatcatcctttcaaaaagtgaacaaaagattaattttccccttcctatctgtggttgtgaggattaaatgggattgctagcatggtatctggtgaagcactccataaaagttcaaacagtggtaataataacggtaataacaatagcaatattatctgatctctctgggcctctgttagccagctataaattcaatctcattccctgtccgttccaactttactgtgttcttttaaaaaccagaccatgggcttggaaatgccatgatctttactgaccgagttgtatattgggcctagccctagccctgttaaggggcactgtgtggaaatgcccaggctctccagattgaaacttctcactctttgccatccagttgtccagccccagtaaagcaggtacggagtggaagttagagcagtccatgcgggaggaggcactactgaaagtgcagctgacacaggtgaggttttctgagggagttatgtggaaggaagatgaccccaggtggccaggagcaggtgaggaccagtgacagcccttcctaacttctgtgcccattcttgcagttgaaggagtcatttcaacaactccaattagaaagacatgaatatgctgaacatctaaaaggagagagggcccggtggcagcagaggatgagaaaaatgtcgcaggaggtgagatctgacccttcagcccccccacattagataggtcactggatctttctggtcatctgtaaaatgggaatagtacagccagaggtggtcatgggtctgggctttgtggaggtgggggcagagagggagagggcagcctgtccagcctccagcccctctctccagggccctttccccttgtgctttgggcagatttgcacattaaagaaagagaagcagcaagatatgcgtcgggtagagaagctggagaggagcttgtccaaactcaaaaaccagatgggtaagatggggctggcatgacctgggagcaggactggcatcagagggctgtgagggtggcttagagtgccccagggaggtgggtggatggaagggctttgaggcagagggaaagaggtctgtgccaggagacggcaagtcttgtcatctcaatgagcctcagtgtccccatcagcaaagagggcccgttgtcagccacccgcagtgctctttctctgaaagtgctctggaagactggctaccatctgggtgtgaggaatcattagcagtgaggccaagtttgaggagcctgagaggagctgtggaccaagaggaggttttttcttttccgagaatccagaggcccttattatctgcttcctttctcagctgaacccttgcccccggagcccccagcagtgccctctgaggtggagctgcagcacctgaggaaggaactagagagagtggcaggagcgctccaggcccaggtcaaaaacaatcagcgcataagtctcctgaaccggggacaagaagagaggattcgggagcaggaagagaggcttcggaagcaggaagagaggattcaggagcagcacaagagccttcagcagctggccaagccacagagcgtcttcgaggagccagtgcgttgccccagctggggagcctgccctcctccctagccctccgggcctttgtttccccacctctaaaatggggcagtgtagccctcacatgaaatgttacttctaaaggcacctgtgagccaggtggctgtgggagagagggggtgatttttctaacctgtctccagccttcccagtgccatgggaggcagacaccaagttctggggtctccagctgcagtgggtggctgctgattgcttctctctgtccagaacaatgagaacaagagcgcactgcagttggagcagcaagtaaaggagctacaggagaagcttggtgaggtgaaggagtcggaaacctccaccccatccaagaagggctgggaggcgggcagcagcctctggggaggggaggtaccaggccagaggcagcttccagcctgggggctggtgaccacagcaccccccagggcagtcctgtttcttgcttcctgcctctgacttttaaaggtgggtagccctgggctcctctcaggtctggacatcatcatcctagctagaggcatggagcccccaatcacaggggaagagacagtggtataacaggctccttatgccaggtgcagtggctcatgcctataatcccagcactttgggaggctgaggcaggagaatcacttgaggtcgggagtttgagatcagcctggccaatgtggtaaaacctcatctctactaaaattacaaaaaaaaaaaaaaaaaaaaattagcaggacattgtggcacatgactgtaattccacctactcgggaggctgaggcacgagaattgcttcaacccaggaggtggaggttgcagtgagctgagattgcaccactgcactccagcctgggccacagagtgacactcttgtctgaaaacaaaacaaaaagactccttagattaaaactggattccagcctcggttccactggtcaccattcaagtactttgcatctctaagtctctgtttctttaacttcaaagggaagttagcattttccttacagaggtgctgaggattaaatgagaagagggtatgagatttgaggctggggaaggaggcatggggttctaggaaagggaggcagtcacttaggcctggagtaaggggacaggggcctgggcagctgacagagccccacagtgccctcgctaccctattaatgggcccagaatctggaaaccagccaccacgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtgactgcagcagacccagctaatgaaccagctgcagcagcaggaagcttggggcaaagcagtggctgacatggcctgccaaaagttgcaggagacccaggggagggagctgcggaggatggggccgtgagggggacgacctggcaaactccatcccttctcactctttcctggccccttaggagcacctggaagctgccagccagcagaaccagcagctaacagcccagctgagcctcatggctctccctggggaaggtacgggagaccgctcagaggaagaggagagagccccaggaggaaggggggactgctagcagcataggattgaggagttggaagagacctttagaacagctggtcattatgccgaccgggtgcctgcactaagttgggcatcagtgtggtgacctcctgtgagcggggggtcaccaagttgcctaaggatggctgaactggccaaggtcagaaagggagcaggtcagaactcccacatcgaccagtagtgggaatgtgcctgggcggaatagcaagatcttgattcttaaaagtaaaaataaagaacaacagctcattcctctctggggaggggctggctcaggattacacagtgagggtggaggtagaggtgggcccacagtacctcccttgttgggttgtctgaagacccctctggccaccccccacaggacacggaggagaacatctggacagtgagggggaggaggcacctcagcccatgccgagtgtcccagaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtggccaacaggtgcactctctgaggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtatgctgccagcgcctggctcacccggtggcctcggcccagaaggagccagaggcagccagaggccctggagccccagggcctgggggcgagtctgtgagtggggagacccactgggccctgcaggaagtcacggagaagctggcccatggcaggactcacctccaccttctccatgacttgaaaatgccacctgagggcaggtcgctgccgagatgtgactgcaatattttggctccagagcagctttatggaccacctggaggagaaggcagacctgagtgagctggtgaagaaaaaagaactctgcttcatccaccactggcgagagagatgccatcagtgagtgggaggccagggcacggcagggggagctacagggccgttggaggggccccagcgtatgagccctgtcctcccgcaggaaaacccatcaccttttatcagaaccagggggccgtgccaaagatgcagcactgggaggaggacaccatcaggctggagctcagggaggagatgaaggtagggtgtgcaacatctctgtgggggtgggggtgggggtgggtgtgagggtgggcgcaggcagcggcatggcagctgagcacccctccctccaggtgaagctgctggagctgcagcagatggtattgcggcttacagcaactacaacaatgggcacagaaaattcctggccgctgcccacaaccctgctgatgagcccggtccaggagccccagccccccaggagcttggggctgcagacaagcatggtggtgagtagagccctcaggtggggtgggcaggcaggaagagggggctcccactgtgctcagatccctgcctccctctctccaaagatctttgtgaggtgagcctcacctcctctgcccaaggagaggccagggaggatcctctccttgacaagcctactgcacagccgatcgtgcaggaccaccaggagcacccaggcttgggcagcaactgctgtgtgccattcttttgctgggcttggctgccaagaagaaggagataaacatcaccatcatcaaacagctgctcaagaaatttttaaataagaaaccaagttatggggttaatctcctacacaattcatttacttcctttgaatgttagagtcactcatgattatttgtgtttctaatttatagtttaagtttatttataaaaagttaaaagagagtgggtgtctgtggctctcactgatgttcactctggcatccttttagcatttttcttttttaatttcataattgtaggtcattagcatgcatatcgagtttgcccttacgtggtgggagttcaaacacacaaagacccactctttgcccaaaactgttctcgctggtttggaataggctgccatgcttttttaatgttattgcagcatgtatattcactacagaattcagacaaaatttgcctatgttctgctgttgtttgatctaatcttaatcacagtgagctcttcgttagctcaatatgtagtttgcccccaagtgtgcactgtttattactttgtaatatgccactatgagtactgacatttagagttgtttaaaggccaagaactggaaacagcctttcctccattttctgtgtattggtgatgggagtgataaccttttgggggagctttttaaatctcacagaagaggaaagtggcctcctctggcaggtatgtgcaggatagagtgtgtttcatctgttccggtgccaggaattagcagtgtattatgatggttcccttaggatttctatgtgctctgggctcatgaagatattgcatcatgagctgcagcagttgcactctttttggatgacctaaaaagggcttatttctgaggaatgaaaggttcccatcgttgactgtggatgtggaaaacctttcctagcttagagcatttgtatctacaatacattttaaagtcagagttcatgttacctgttttaatcacatgactacatgtcccagtacacaaaagggcactggttggcattcttcttaatgtatttagtgaagatcataacaaatcctttatgagttcaaacgtccctggaacaggcatacaggctctagtcaagaatgaattagagtgaaggaaagctgtgtgacacctggaattcctctctgttcacggatattctttgaggcttgaagattgattttaccatctagacctctttggctaatacctattcttcaaccaccttggttactctgacataggaatttacttccttttccttgaatggaaaacactttaaaaaataatagaaacattattataaactaatatatgtgagatacttagttgaaacaaaaaggagttttagtagacggtattatactatctttgaaaatcaaggagaagtttatgaaacttaaaatgtgtacaaactgcagtgcaatctactgttcgtgaatgtcaatgtattatcaggaaacgtgtctatacaatcacagagttatattttctcacagacttctttacaaagtgaaatatgtttttgtacctctgggtttctgttcgggacatattttgtgcaatatttatgtgattgtgcctatgcatgatgaatgaatgcatttcagttatatattgcctaaatcgtaacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttcaactgactcttccaaattttatgaatgtatcaatgtattagataaacccagtttcagaatgataaagaaaaaatgttagaccaaataatgcggctaattaacagtggtacgatttgtagcccgtgggtttaaaatgcacttaaagtcctgttctcgccttttattttctgaacttgccgcttttgcattctttgagttcagtttaaagacggttactttaagagcattttaaaccctcgggctagaaatcggaccactgttaatcagccacattatttggtctaacgttttttcttttatcattctgaaactgggtttatctaatacattgataaattatttcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtcatatatttaagaaaaagctaaaaagaatggaaattgtatgacaataacttaagtctttctccaaagtgcatgcagtcttttgcgatacctcattcagccgagtatttgtgctcttcctcattcggtataaggcagctttcagtttgcttagaaggcaacattggaatgttagagttcatcagaaacacagaattttaaactgtgagttccactgaatacattttaatttctgtaggaagaatcaaaatacctatttaaagatggcaatatataataatcattttaaaagtatttgattaaacctgataattttccagaaatgaaaaaaaaaatcagctctaaaaccaaagctgattttagaaaatttgaaaatgtaaatcagccctatccataatatagtttctctaaaacttaattttaaagagtcgttttaaaataatataactattaaaatatgtaactgctatcttaatgttctgaaataatttaaaacattttaaaatatgaatactgtagtataaaagaaagaaacagtgggaacgaaaagcagagaaagaaatgccaattccagtccaaagttttatttgccaagttttcttagaatgaattttaccagtttatgaattattgtaaacagaatgtgtaatggaaatactgaaagatttttccctagagtggccttattgactgctggtgtgatgccactgtaatgtaataaattattaagttgtttgaatgtgttgtttttgccttaaaattttattttgcgtttcttgaaaactatagtattaaaggtattgatactgtgcaaatgctgggcatgcttggcatgagataatgtgtttcatttttacaaagttgtaatataactatgcaagtgtttattaaaaaccaaaataaaaaagttatgggtttattaaaaaacttttattaaagttttataaaaagttattttattaaataactttatttaaaaaagttatggggtgaaaaagttatgggataaaaatgtaaaaaagttgtggcaaaaaaacttctgggaaaaaagtagaaaaaagttttatgaaaagttacaaaaaaagttatgaaaaataagttatgggatttttttaaaaagtcatggaataaaaataaaaattaaaagcaggcccctgtcagcaaagcctggagaagtggggctggagtctccaccgccaccatgtccctaccacctcttcccaggcacccctttacaattagggtagcagcacaagacctctgtctaatggggaaagacaaacagaccatttgccaccttgagcagggctgagtccctaaatttctggatgatgatgatgattgttatttaagagccagaggctggtggagttggtttgtttggaggaggcctgatggtccccttactctcaccatggcaacgtttccctcaggggggctcccatcttcttattcagagaggtagctgaggccggaaagcggggctaactgtggaccagcgagggcatgggctgctggggtggcccaccttccccggtgtacatactgtgtctgtgtaacattttgtatattccagagggtagggctgcccctgtatcatacctagcagaggttggagctggcacatggggaggaggttctaataattatttgtggctgggaaacttatttattgctagcgtaggacagaggaaggaggcggggatggggtcgtggctctctggtggtatgatcacagcttactgcaacctccaactcttaggctcaagtgatcctcccacctcagcctcccaggtagctgggagtataagcatgcactactatgcctggctaatttttaaatttttttgtagagaaaaggtcttactatgttgccaatgctagtcttgaactcctggcctcaagcaattctcccatcttggcctcccaaagcactgggattacaggcacgagacattgctcctgtccattaggttttctctttattactgttttgttgttgtggttgttgttttgttttgttttgttttgttttttgacagagtcttggtctgttgcccaggctggagtgccgtggtgtgatctcggctcacggcaacctctgcctcctggttcaagcaattctcatgcctcagtctctcgagtgtctggggttacaggcatgagccactgcgcccctggctaatttttgaatttttagttgagacagagttttgccgtgttggccagattggtcttgaactcctgcctcaaacaatccgccctcctcagcctcccaaagtgctgggattacaggggtgagccactgctcctggctaagatcccatctctatttaaataaaaaaagaaaattcagagcatgtggaatacagaacaccaaagtccaaagttatttacctctctgaggtaatctgtgtaaacaatttgaaatatatcttttcaagttcatgcttgctatgcatatacatacatatacacacatacgttgacatagtcccccttccctgctgtcatgctattagagtcttcttttttttgtagaaattggaccaactctatgttctttgctggcccatatttctcctattcagtgatgtgttacaaatgtgtgtttaagtcaatgtatgcaactcttcaatatcattttaaaaggttaaatatacgatcatatgaaggcattagaatttattccaacagttccattttgcacatttaataatttccattggtttgccagggagaacattctcatgccatggctaaatccttttgtacggccatccttaactattccctgaagataaacttttaaataaagttgctagatgagtctcatttcttaaaaagttcttttttggtagtttatatgtaacactgtagttttatatgtacttgcaaatagctatagtgccagtaaaaaatgtgataaaattaaactcacgtatgccaaatatattttgatttagtgcttcattaagtgcatgattacagtctctatatcttttgatttacctttctacctttacaattttcagcccagatacttagaggtcacatagtaaattaaggttttctttttataataatctccatctttctaaatttggtgcgtcacagtaagttatttttcggttgttgaaagctgtggctctgttctaaatttgagcccagaaatcatgccacttacaaaatatgctttgtcttccaacatcagagtgtctggtagaaggtgactgttcttggaattttaaaaatctaaacaggacaagacaagaatatggaaaatatttctgtttctgataatatggctgagtaggtactctgcaaagcctctgtcataaaatagacattctggatagtccttgcaaagacatatttgatcttgccaaacaaaaaaaaaatatccagaatctctaagaatgaagatgaagtgaaaatcagaagggctactacgagaataatggggaagcagccccagttatcaagggatgtttgcatgtgttcaataaaaagtttcaaacctaaaaaaagttaagaaaaataatataactgccctacatacatacatcatcaacaatttttcattcatggcatggccagtttttgttttgtatttttttttaaaggtgggcttttgctgtggttgcccaggctggagtgcagtggcatgatcttgacttactgaaacttctgcctcccaggttcaagcaattctcctgcctcagcctcctgagtagctgggattacaggcacccgtcacaacatccggctaatttttgtatttttagtagagatagggtttca[142 bp omitted]atacattccttcttcctctgaattattttgaagtaaaacctatatatcatatcatttttaaaattaccttatatgtatctgtagaagacaaggaatttttaaaaatatactcataacgccattaaatatcaaaaaattaatactttctgaaaatagccacaaatccagagttcacattttcttgactttctcataagtgattttttctaggttatctatttcaatcagatacctgtttgctcatatttacattcctaactgaacaatgtcggaagaggtacttaaacctgacataaaacacaaatgagcttatgaccaaatgcttagtgcaagaaaaaacttcacactgtaagatgagtccctccaaatacagaaaggaccagtattttaagaggtatgttaactaaaatgttgcagtgtatggagcagagcaggaagaacctttaagtctgaaaagtacaagtaaatttcatagtttccctggtccttccacaacaacctctggcatctgttttttctacaatggaggtaacagtagctctttcagagcaggaaaaggcttacagcagtgctagaagagggtggtggctatatacagtgtagctatttgtatattgtaacaaaccaacttttttttttttttttttttttttttttttttagtcaatagtagatttcttttggaaaaatagcagcctcctgtctggggacacctgcagttccactaagtgaacattggtgtctgctcacctttgcctctatttctctcaatatactgtcaagctgttccctgatttagcaattttatatactttctttttctttatttttttttcctttcccttttcctgagacacagtcccgctctgtcgcccagtctggactgcagcagcgccaacatggctcactgccaccttcaccccctggctgaagcaatcctcctacatcagccttcagagtagctgggactacccgccgggcccaccaggccaggctaatctttatggtttttgttttgtttttccattaagagacctggtgtcgggtcaggcgcagtgactcatgcctgcaatcccagcaccccagaaggcggagtccggcagatcacctgaggtgaggagcaggagaccagcccgagtaacatggagaaacccagtctctaccaaaaaaataaaaaaataaaaaactaacttggcatggtggctcacgcctgcaatcccagccactcaggaggctaaggcaggaggaccacccaaacccgggagatggaggccgcagggagccgagaccgtgccactgcactccagcctgggcaacaagagtgaaactctgcctcaaaaaaaaaaaaaaaaaaaagagaccggtttcaccacgttgcccaggccggtctggaactcctaggctcaagtgatcctcagtgctcggccgtccaaagtcccagctgggatcacaagcgtgagccaccaggccaggccaatctattcctttctgattaataaattgggccggtcacggtggctcacgcctggaatcgcaccaccccgggaggccgaggcgggtggataacctgaggtcgggagtttgagaccagcctgaccaatgtggagaatactcgtctatactaaaaaaaaaaaataaaaaaatacaaagttagcaggtatggtggttcacacctgcaatcccagccactcgggaggctgaggcaggagaaccacccaaacccaggaggcagaggcccagtgagctgagtccacgccactgcactccagcctgggcaacaagagcgaaactctacctcaaaaaaaaaaaaaaaaaaaaaaaaaaacaaaacccaaagcgaccgggtttcaccgtgttgcccaggctggtctggaactcctaggctcaagcgatccgccgctctcggccgtccaaattcctgggatcacaagcatgagccaccactccaggccaatctattcctttctaattaataaattgggccaggaacggtgactcaagcctgcaatcccagcacccagggaggccgaggcgggcggatcacctgaggtcgggagtctgagatcagcctgacaaacatgaagaaaccccgtctctaccaaaaaaaaaaaaaaaaaaaaaaaaaaaaaaaagccgggcataggggctcacacctgcaatcccagccacttgggaagctgaggcaggaaaaccaaccaaacctggaggcggaggccaca[131 bp omitted]aagtgatcccccacgctcagccatacaaagtcctgggatcaatcgtgagccaccacgccaggccgatcagttgctttatgattaataaattgggacttgcgcagtggctcacgcctgaaatcccagcacccctagaggccgaggcgggcagataacctgaggtcgggagtttgagaccagcctgaccaacatggagaaaccccatctccaccaaaaaaataaaaaaagagccgagcatgatggctcacgcctgcaatcccagccactagggaggctgtggcaggagaaccacccaaaccggggaggcagaggcccggcgaggtgagtccacaccactgcactccagcctgggcaacaagagcggaactccgcctcaaaaaaaaacaaaaacaaaaaacaaacaaaaaaagtgacccggtttcaccatgttgcccaggctggtctggaactcctaggctcaagggatccaacacgctcggctgtccaaattcttgggatcacaagcgtgagccaccacaccaggccgatctattcttttctgattaataaattgggctgggtgcggtggctcacacctgcaatcccagcaccccggtggctcatgcttacaatcctgtagcaggatttttaaggaattagagagactgatggggtttaggaggttattaattaattatttacgtgcattggcccagtcggattaacatttaaagcactgagttctgaacaagacttaccttttaagcattttatggggtgggggtagatctgtgcagggtgaagcatatgatagaagtgagaaacaaagataattgttcaattgaatcatgcattatattattttttccttttttaggaaaaatatgttttgtaacttgagtttgtttagtgaccttgcagttgtacagttagggaattagggtttttataatgcccgggaagggaggagagataaggctcactgccatagaaaagcaggaggtagtagttttttttgaaggactctagctcttctctttctcagggggaattgggtttttttacatacaactgagtttttgtttacacatttttaaatttcttttaattcctgttcccatcccagcaccctgagaggacgaggcaggcagataacctgaggtcgggagtttgagaccagccccacgaacatgaagccccatctccaccaaaaaaaataaataaataaattagccgggcatggtggctcagcctgcagtcccagccactcgggaggctgaggcaggaatattttctccctcccttagataaaagatagcatataccattgtgcactttgttttttgacctggggtggggtctcactctgtcactgaggctggagtacagtggtgtgatcttggctcaatgaaacctctgcctcctagactcaagctgtcttcccaccccagcctccagggtagctggaaccacaggtgtgtgccaccacacccggctattttttttgtatttttggtagtgactgggttttgccatgctgcccaggctgatatcgggctcaggcgatccacctgcctcagcctcccagagtgttttcaaagtgctgggaattacaggtgtgagccactgcatccggcccattttgcacctttttaaacttctcttagagatcacttcatatctgtttatagaaatgttcttcatcttttttaaaattagtactttgtagtgtggatgtaccacttttttattcagttaggttttttttgacatttgagtgttaggtctttttttctgacattacaagactaaaatatgaaaagaaaaactagaaaaaatttcaaagaaaatttacctgtctttgtgatcttgttgtagggaaactttttgtaatggttagtatccaggatatgaaaaatagcctaataatgaaaagaaaaacttaagacaaaatgggcataggatgtgaagagttactttatagaggaagaaactggaatggtcagtaaacatgggaaaagatacttgaactagaaactcatggataaattgaaagttaaaatgactattctgtcatcttcagattggcgaaaatgtaagtctgacagaattgctggcagagatatgggccagtggaaactcagctaggtaaagtggagcgcaattttataatctctaatgaagttgaagatgcacatacctgagcaaaaaaacacatgtgtacaaagaaatttggaaaacctgtttatcacagtagtatttgcagtaacataagatgatgcagaatgtaagttaaccaacaagagattggataaactcatatccatgtggtggaatattatacagcaattaaacatgaacatactagattgaaaagaattaacatgggtaaatctcatgaagaaaactttgggtgaaaaaggcaagctgcagaaggatatgggcaatataataacatatgtgagtagttcatttccatatttatgttgtttcaaaggagttatcggccaggcacgaaggctcacacctgtaatcctggcactttgggaggctgaggtgtatcgggcaaaattcacccccgatatttcacatagtttcttttctattttccctaagtgttggccggtctgagaaataaaggaacagagtacaaaagagaaattttaaagctgggtgtctcggggagacgtcacatgttggcaggttccgtgatgccccctgagccgtaaaaccagcaagtttttattagcaattttcaaaaggggagggagtgtacgaatagggtgtgggtcacagagatcacatgcttcacaaggtagtaagatatcacaaggcaaatggaggcagggcgagatcacaggaccacaggaccggggcgaaattaaaattgctaatcaagtttcagacacgcattgtcattgataacatcttatcgggaaacagggtttgagagcagacaactggtctgaccaaaatttattaggcaggaatttcctcgtcctaataagactgggagcgctatgggagaccggggcttatttcatccctctgctgtgactgtaaaagacagtcgtccccaaagcagccatttcagaggcctcccctcagggatacattctctttctcagggatgttccttgctgagaaaaagaactcaacgatatgtctcccatttgcttttcaaagaagagaaatatggctctgttccgcccggctcaccgacagtcagagtttaagattatctctcttgttccctgaacattgctgttatcctgttgttttttcaaggtgcccagatttcatattgttcaaacacacatgttctacaaacaatttgtgcagttaacgcaatcatcacagagtcctgaggtgacatacatcctcctcagcttatgaagatgacgggattaagagattaaagacaggcataggaaatcacaagggtattgattggggaagtgataagtgtccatgaaatcttcacaatttatgttcagagactgcagtaaagacaggcgtaagaaattataaaagtattaatttggggaactaataaatctccatgaaatcttcacaatttatgttcttctgccatggcttcagctggtccctccgtttggggtccctgacttcctgcaacagaggtgggtggatcacctgaggtcaggagtttgagaccagcctggccaacatggtgaaacctcattttggggtgtggtggtgcatgcctgtaatcccagctactcggtaggctgaggcaggataatcactcgaaccggggaggcggaggttgcagtgagcccagattgcaacactatactccagcctgggtgacagagcaagactccatcaccaaaaaaaaaaaaaaaaaaaaaaaaaaaaaaaaaatctcttagtttctgatggttttcctgaccatatatgtgatgccgaagttgcttttttgttgtcacatctattggcatcaagtgctgaacttttcatggagtggcaattttttggtaataaagcaactttcaaaatgagtctaagtttatctctggaaaagtttgaaagaatcagtgaaggttcttttagacagtacccatgttctacagatcagccattctctgtctctcaaattttcagtaaacctttccacataggatgtcagcacgattttaatacgttaaatatatgtaaaataaggcaaattaagacacaactccatcaactctcatctgctctgggcttatttctcttcatagtacataacaccatctacgtcatatacttattgtctgtttctattagagcagggtatttttgttagtgctgttagtgtgctcagcatatacagcaacacttggcagacagtaggtgctgaatgaaagaatgaagaagaacagaactcattttactaaagacattttgatatcacttttgggataggatactatacattaaagatgatacactgtttattccagaatggtcttagctacagtgttcacagcacagtatttgtagacttaatgctgttatccattctaccttcctttgaggttggcatgagagttgcccgtcagcgtatgtgtgctcttagaaatcagggacaatactatcattttaagcttcttggcagtgacgtgtacttaactagatggtgaactcataggtggatggggagtatctaatgcttttgtattctgcttttcagcaaataaatattaccgtactgtgtgtgtaacatgagctatgtaagtgtgtgatgattaaattagaagatagggttctctgcaatccagttttccaagataaatttttgccttgtttttgttaggtaataaaggtaccatattgactgttgatatatgcctacttagtcatgcttctcttgcagtaatcttatcaaattaccagctttttacttttttagagagacagtcctagaattgagaatcctcctttgcctacattcaaaatgagactatattatgtgggtaggaaatttctggtgacctacttttaatttttaaatttaaaaaaatattagcatagttttatatttagaaaacagttgcaaaggtggtatagagagtttctgtgtaccacacaggcacccagtttcccttgttgctaacatcttacatgattatggtatatttgtcacaactaacaaatcagtattgatatattataactaaactgcatacttttaggggtagtgacccagttttaaagcttatttcccacaatttgttaaaaatgacaatcagtattgagtgcccatgggtggtggcttcctgattcttcaaagaaactgagtaattttgtaaccattgggacttatcaggaaataaggaactcataataatgtgcgcttaaatttccagtggaggaattgtacagcttaacatacggttttgtaagttgggtattaatacataaagaggctgggtggggtttgatcactattaaaactgatttgttttgttccctggaaaatatgttactaccacatggtctacccttcatagataatcgaacctaagatcactgggcagaaaagggttgccctgtagtaggaaatgtgtcctcctgggactgagttgagatttagtttagcacacagaataagtagccaatggctgctatgagtctgacttctataattcaaattggtataaattaaatctaattcttttccccaggactgcccaatttaagattaagttttatactggcgcttattagagatatggccattttgccatttcagtggaaccttttaatcagctttaatgctgtcttaggtaaagtaaaaacttaatctaagggcttttctagtttgccatcctcaaagcagaaaaagcagcaatgaagcagcactgcctcatatagactctgcttttattaaatttgcttcaataatcctcttccagtcatcttttgtgctgcatatttgaaccataaaataagcaaaaactgtacccaaatgaaaatttcaagttattttaatgaagctctggaaacatcccagagctcagaagatgttttttcctagtttattttttaaattctggaaagtaggtcagtagacataccctgctttaattggtttaattagaagtgaaaaattataggactaactcaatttgaagtatagatttcaataagaagaattatactgggatgaatattatttaaggttttgaatttaagatgcatttaatcaatgcttataatttcctcttgaaaagatttatattgcaaaaaagaagactaagtgttggaatatgtcaatatatagggaaaaactttgccatgaaatataatatttgataaaatcattttagaattgtatctctaaatggtatgcctaagaatattgttctataggaccttaatagatatgcctcgggggaaaaaagtattgtgtgctcaagtgagtttgagatatactgcattaaatataagaagttgcctgcaggacttctcagagtctttaacactttctgaatttctgagacaagatatatagagggtacagtactttgcaaacctatttatccctataccacctagtaacatttttcaggaaaatgttttgagaacacgaatttgacctgttttaggaatttatacctttgacaatgttgaggaccttgttttttcctattataatgatgatgtgatattcacatatattactttttcccaattctttaagatatttttccaatgtattatattcaaccctctgctcagtgccttccttctgctaactaaagtgatggtttccgtctgttgctacacatcagacatacttggccctgaccctggagattctgtatgaacagaaatgccagaatacctgctcaggattctgtatttattacaaacacccaggtgattctgatgcagccaacactggtcctccaactgatgctttggaattgttgaactaaaagcatgcctttttttctagatggatgagtagattggggcatagtttgtggtcctagaacacatgggttaaccatccctcctagtgagaatgatagcacaggcctctgatgaccccacgaggtgctgtgctggctataacctaacatgaaacgatcattattccttaagaaaagcagaatatgtctaaatgggcttttagccaccttcctaataatgaagtaccatatatatgactacc[342 bp omitted]cccggcctattctttaaaaagaatattagattatattttctaaatgtgccaagtatctaagaatatattctttcacctcctgctgataagagttatacatttaaccttaagcaaatctgccaagattctatgtcatttatgctttgatttatgtgagtattaatgtagtttctgtgactattatatggttatatataccctccacctagtaaaacagttccatattcctggaaatggtcttttacatcctacaagtgtagctggaaaggaataatataaatactaatggtttgagagacaactagtcttgacatgtcttggttgaatagtgttctataagcaacaatatatgaaatactagacatacccattaaaagcagaaaatacccactactgttttaaaattattctgcaagatctcatcaatgcaatgagacataaaacagaaataatgggtgtaattattgaaaattggagataaaatttttattacttgtaaacaaaattctgtcaaaaacctgacaaattaaacaatacaattaatatgtttaatagaactaattacatatgagaggcatccaaaatccattttttctatacaaacatggtttgatatacagtcattttatctgtgtattaattggtttatgaaataacaaatagaaaaatcaagtatgcattatcaagttaaagaagcaggagagatggagctataaaaacaaagagagaagaatgttgtaaggagggcttaacaaccaggataaatgttgtagaaagatcaattaaagtgatggcctagagatcacgggcttcctttggcagagccatgttggtgaagtgaaggaagtggaagccagaccacaatggttgaagaatgaatgtaatgtaagagccaagacatttatttgagtctgatagtaatgaaaaaggacaagaattttcttcttgctgttgtttttgtcatttcatgttcaaaaccctttatctcccatgtggtactgaaaactccaagatgggatctctgtttctgtgaggcctgtagtgcttagtacatccttgaatgtgtgaggctctcattggtataagtttaattcctgactgtggatgaaagctttaaaactttgcgggcaaaatacagaatgaatttcagtgagttcccatgtattaaacaaggtggcgctggctggagacatgctgtccctgtgcccacaggagtagcagtgctgtgctcatcttcctgacccgctcttcacagtcttcaccgcctttcttcaggagtctcccctttggcttttccacagctatgaaacccacgtagtcggacaccctaatgcttctcctgtagggtgtgtgatgaggaggtgagcttggctttggagtgctgggaacctgaggaattgccaaggacccagagcccagccctgaccacccagagagcccaaaacacaatgaacaaattgaatttccacaacaacagagtcatgcaagaccgccgcagcgtgtgccttttccttcccaatgagaatctctgaacatcatcataaatgtgagtagatctcaatataattctgatagctggaggatagtgtattttcaggtttgctggagggaaaaaactggactttaaataattaagacaaaatgattgtattaattgacttctattcttaatcactaatttcattttttatatttcccttgacttttgggggagaaatagtctttgtctcaaaagtgggcttcagtgacctatgggtttgataaagcaaccagagataatgagacaagaatatttaatggcaacatgccagcaattattattagttaattgaaagcgtttatgattttggcctggggccaatgctttccccctctgctggactaacatgtgggtaaaggagaggaaaagctttgtttcactttttaaataaaagtattacgtaactttgaaatttgtataaaattaaaagatagtaaaaacaactattctaacagaattcaaaacctgttatgcttcagtggagagattattcaagataagtccgtgggaaattgggagtacatttctactggcaaagttagtgataactatgcacttctgacaaaatgtgaaatggggggtatgggcgtgtcatatcatcatggtgcagatacgtggatgtgtgcttccaaacaatggcaacctaactgactgctggaaccatacaaaatacctgaaactactcagaaagaaggtgaaaattgcatgcaaaaattatttgaaaaatattgagctaacacaacatgaatttggaattataagtgaggtattgtaactcacctacagatgtgttttttgtaatcaatattcatggactcagactacacagtaaaagcttacatagaaatcattctatctaaactttctggatacgaaagtaacctagtatgcgttttgctactatatctttatatgaatttaaatcacatttccaagtggcttacagtaatcaaggttgtcacaaggaagatgcaaattaaaaccacattgcaatatcactgcacacccactagtacggtttaaaagaaaaaaaaaacagaaaatatcaagtattggtgacaatgtggagcaaacagaactctttttcaataatggcaggtatgtaaagtggcacaaacactttggaaacctgtttggcattatactgtactaaacctgaacacacgcattgtttatgacccaggaatgcccctcctgggaaccaacaacaacgcatatatgtgttgcatatgttcaccaaaagacatttacaagaatgttcatagcagcactatttgaaatcacccccaagtagaaaatgcacaaatatttaacagtagttggataaagtgtggtacgtttatgcaatataataccatatagaaatgagagtgagggatctgcaaactaatatgcaactgtacaaatgaatcccacaaatataatgttgggtggcagaagccagatgcaaatgaatacatgctgtagatttcattcttttacattaaaaaagctagtcacacaaagttatgctgttagaagagagtgatttggtcgggcgcaggggtagttacaggaagggagtacacggagatttctggttgttagttatgttcagtgtcaatctatgtgctaaacaggtacaataaagattttagaattcatcaatttgcacacttatgatagatgcactttcctgtatgtatatttcaataaaatcttttaaaaagtaaaatgacaaaaagacactattaacaaaaatgacatattatattaactgttatactaaggaaaatataaaaatgagttctataacaggggctctgcaggtcatgtggtcatgccaaggaccatatgtgctcaagattctcatgacattttggaaggaggttgggctttctttatctttcctttcttctctcccttcccttcccttcccttcccttccctatttttaaacctaggtttggtattttcctggggtgatggtgactttggaaaattgggccggggcggaagtgaaggctgcaacattccccagaacattgagagactaaatggacagggggtgtgccagattgagtgtggagctcagttcctactggcgctcaccaagtctggagtggtgtggacatggtacgtaaacgtcctccccgtcacagtgtgcgtgcttgtgccgacgcgtgcagggaacttgggcctcgccccaggaccaccccggcgtgattgtgacctgtcatatttttacttatgcatgcatctttgtcctttaaaggatattgagtcgggattagtgacaatagtacaagaagaaatttcctattgtaactgggtcattttgaaaatactagaaaaattttaggccacttacctttcctgtttgggcgagatttataggaagtgtttcttctgctgaagcctaaggataaaatgagagcaaaatagccttctgaatcctttgatcctgagaaagttaacatgtatttcttgtaaaagcttattatattaatgtgcaaatgagcaggtgcccagactggccttggatgctgtgtcaggccttgctgcctctggtcataacattggcactatttatttatttatttatttatttatttgagatggagtctcgctctgtcgcccaggctggaatgcagtggcacaatctcagctcactgcaagctccgtctcccgggttcacgccattctcctgcctcagcctcccgagtagctgggactacaggcgtctgccaccatgcccggctaatttttttgtgtttttagta[148 bp omitted]aggactttggataggtgtttgcagtaatgtgtcttattttcagtctatatgaaaacctacaacagtaacttaaatattgtagaacatgtattaaggtattaaggtttttcccagctgacttaataagttaatttgaattaatggtgtatgattttgaatacaagttcgaagaccttgggtgctgtgtgtgatgtcattgagctggctgtgaaagatgtgagacaatgagtgtcttcttgtatagcattgtcagaccacaactatattgtaacactccaccacgggcctccttctcaggggaaagggggattacttcaggttgcgccagggctctgacgtgcacgtgtggaaactgtaggtggtggaagggctgagagggaagaagatcgtgcatgtggctgtcggggccctgcactgcctggcggtcacggactcggggcaggtaaggctgcaggtggcctgggggtggcgtgccatcctgacttgggggacgtgggggtcacgacatggccctcgtcctgttgaaatcacagctgttgatgaactcagccgagtcttactgcttgaagaaccatgaggccgggacccatccgttttgcccgctggtgtatctgcctactcagcagcaggggttgggggcggggtcctcagaaaagagg[385 bp omitted]aagactttgctttaggaaattgctaactggtgaggaggcacccatgcctcattttagagacagagctagtgcctgacaagtgttacactctcttctgcttggagaagcatatgctatgaccggcttgtagatattcaatttaaaattttatttatgaaaacaaaattaccattactgttttttagtcaaaatgaattatactttataattctataaggccaaggagctacttacttgaaaaatgagcatattgtttttggtcatttttctttgcaaagtaaaagggaaaaaattattgcacttagttgaagagaggaccttctgtgtgacttgcaacaaagcagaattaatttgattaatattaagaaaatactccttttatggttattggcattttcatggttagattttcttcagaattatagtacaccgatgccattttgtaagattgtgaaatggtttgcttttacttttaagaactcaattctttcaaataccatggcatacacgttaagcattttgaagtaaaaattacattaaagaaaatgtcctgaaatgttgaaaaattataagcttttttctcctcgtaaacaggtgtatgcttggggtgacaacgaccacggccagcagggcaatggcacgaccacggttaacaggaagcccacactcgtgcaaggcttagaaggccagaagatcatgtgtgtggcttgcgggtcatcccacagtgtggcgtggacaactgtggatgtggccatgccctctgtccacgagcccgtcctcttccagactgcaagagaccctttaggtgcttcctatttaggtaacacagatttgtatcctgagatttttctgtaggttacagcaactttacatttatttaattgtgccaacacattagaggttgtagtgctgcgttaactacattatgaatctaaagacacagaagaattatggtgtgcgctcatgtgatttatacatgctggaatgaaagttttagaagaaagtatgttgctgattcttgtgtttatgatcaggtaaattcacagcgctgtacttgtgtgtaaacaggactcctaataactgcctgagagatacaggcactgtactgggctcttttgtattttttaacagctttattcagttataattgacatataataaactgcacctatttaaagtatgcattttgatcgactttggaatatgtatgatccatgaaagcatcagcacaatcaaagataatgaactcatacactaccccagcgtttctctctggccctctgtacccctcccttttgcttttaactccctccttcctgccgtatgcaccaatttaatttctgtcactagagatcagtttgcatgtctgctttttgttgttgttgttttgtgggtgttttatttgtttgttttcttttttttgtagacagggtctcactctgttgcccaggctggagtgcagtggcacgatcttggctcactgcagcttccacctcctgggctcaagtgatcctcccacctcagcctcccaaagtgctgggattatgggcaggagccactgtggcaggccagtttgcatgttttacagcttactataagtagaatcatacagcatatactctttttaaaaatcttactttttccactcagcataataattttgagattcacttacgttgcatgtatcaatagtttattcttttaaattgttgaatagtatcttaagataaacaaatgcaatttgttcatccatttttctgttgatgaatgtttgggctgtttccagtttttgactatgcaagtgaaattgctaatggacatttccatacaagtttgtgtatggacatccacttgaaattctcttgggtaaacttctaagagaggagtggttggatcatatggtacgtgtatgtctagcttcttaagatcgctacatactgttttgcaaagtggatgttccagaggtccacatcctccacatttttgtcaacccttgatacattcagtctttaattttagttatactgacagatgtatagtggtatctcgttgtggttttaatctgcatttccctaataactaatgatctcaagcatcttgcttatttacaaatcacataccttttttggtgaatgtctgttcaagtcttttcccatatttaaataggttgttttcttactggtttgagagttccttatatattctgagttacaagtcctttgcctaatatagaatttgctagtattttctgtcagtgtggcttgtcattttattctcttcacaggtgaatcttaaagattagaagtttttaattttgatgaagcctagtttattcattttattcttttgtagagtgtacttttgatgttgtgactacaaaacctttgcctcaagattatgaagtttgtctttctatgttctgttatagaagttttatagttttagacaggtatatctatgaccagttgattaaattttatatatagtgggaggttcagattgaaaggcttttttgggcatgattgtccagttgtttcagttgtatttgttgaaaaactacgcttttcctactgaattgccttttgcctttgtcagaaatcagttgtctatggatgtatggatctatttctggactcccagtactgtttcattgatttatttgtgtattttggtggcaatgccacattgtcttgattactacagctttataaaaggcctgaactcaggttgcaacagttttttagctttgttctttttcaaatatattttggctgttgcaggccctttacatttccatatgacttaaaatgagcttgtcagtttttataaaaccgcttgcttgggattttgatgtggattgcattaattctgtaagtcaatgtgcaaggatggattcacagtattcagtcttctaacccatgaacatagtgtttctctttatttgttaggtgtccagtacataatgacacatgaagaggcaaaaaaagcgactaaaaatgaccagaaatgataggagagaaacagacccacaagggctccatatattggagttagaagacacagactttagtataataaatatgcttactgtgttcaaaaagataatatttcagcagagaaccaaaaactactgaaaataaaatagaaagactagaactgataaatccaatatttaaaattaagaacttaatgagtaagtttagaacacactgaactcagctgaagagaaagtaaaaatatctggaatgaagaactgaggagcaaaagtttagaaaacataacaagaaggtaaaagatctgcaggacagaggttaggcctaacacaagtgaaagaagagtccccccaaaaagatagaaaagagaatagagcagaggcaaaatgtgaagaaatactgaaagacagaattttccaaaacagacaacagatatcatgccccagaagccctaccaaccccaagaaagataaacatctccatgcacatgtaaaacctgtgccagatgaaaacaaaaagactctctgaaaagcagacgaaggaaaaataaaatgaaccacaattagacttccatccaacttcaggagaaataatataaaccaaattgcaatggaatactatttttaaagtgctgaaagaaaacacctagcaaaaagacttttcaaaaataaaggagaaataaagacattttcagacatacaaaaatagataatttgtaaccaacaaagacacatttttaaaaatattaaggggattttcaggcaggagaaaaacagtatagatggaaaattaaagaagaagaaaaaagtggagagaaattacaaagtatgcagaaaaatctaaatcaatattgactacataaaatcgtcatatgccctgcatgtattgtttgatcctttgacttgtttttttgctttttttgttttttgagacgtagtcttgttctgtcgcccaggctggagtgcagtggcacgatctcggctcactgcaagctccgcctcctgggttcacgccattctcccgcctcagcctcccaagtagttgggactacaggtgcccgccaacacaccggctaattttttgtacttttagtagagaca[138 bp omitted]ccccatctctattaaaaatacgaaaaattagcttggcatggtggcatgcgtctgtagtcccagctactcgggaggctgaggcgggaggaatggcgagaacccaggaggcggagcttgcagtgagctgagatcacgcgccactgcactccagcctgggtgacagagcgagactctgtctcaaaaaacaaaaacaaaaacaaaaacaaaaacaggcatgagtcactgcgcctggctgatcctttgactttttttgaaattttgtttgagcatatgacccacttagcatatgactggattttatgaacattttctatgtgcataaaagaatgtcttcgatagttctgttagatatatatttgtataaaatgtataaaattttggctggacgtggtggctcatgcacataaccccagcactttgggagactgaggtgggtggatcgcctgaggtcaggagttcaagagcagcctggccagcatggtgaaatctcacctccactaaaaatacaaaaattagccaggcgtggtggcaggagcctataatcccagctactcaggaggctgatgcaggagaatcgcttgagcccgggaggtgtcagttgcagtgagccaggatcgcgccactgcactccagccagggcgacagagtgagactccgtctcaaaaaaaaaaaaaattaaaaattaaaatatgttaagaacatataaatcagaatgaagataaatgatgttaaagagaactaaggtctttgcattgtttaggaggagactttactaaataataatagatttaaatcagtcaaaaatagatgttataattaatatcttcagtaactactaaaactaaaaatgtatataacacatacactccttatagacagagtgagactctgtctcaaaaaaataataattaaaaaaaaaaagtagaaaagttagctgagcatggtggcaccggcctgtaatcccagctgctcagcaggctgagacaggagaactgcttgaacccaggaggtggaggttgcagtgagccaagattgtgccactgcactccagcctgggcaacagagtgagactctatctcacaaagaagaaaagtgatatatgcatacagtggaatattattcagccattaaaaaggatgacgttctgacacatgctacaatacggatgaagcttgaagacattatgctaaacacaaaaggataaatcttacatggttccatctagatgagatgtctggagtggtcatattcgtagagaccaaagttagattcaaggttaccagggttggggtaaggggaagtagggcagttaaattgcttaatgggtacagagtttctgatcggagtggtgaaaagttttggtaagagaaagttgtgatggttgtgcaacactgtacttaaggtacttaataccctgaattataaacttagaaaatgactaagtggctaattttaagttaaatatattttgccacaatgaaaaatataataaaaggtatacaaattaaaacactcactctccatctaaccaattccacatgccacgcaactaaacacttactagtttcttgagattcttttaatgtttctttatggaaaaacaagcaaacaagcctagttattctaattcttccccgataccccatcctgatttttttaaaaagccagccagtcatcagcgggtaggaccgtcacttccgtctcactgtactcactctacagaattaccatatgcaaaggaaccttaaaataacaaattccagtacactgtggtccacaataagtatttcattaatatttggtggaagagagaatataaacattctgccatacctggttcatttattctgccaaatgtatgcctggtattgtgttttttggtcttgaaacacgtttcacaaaaatcaaagtcatcacagtttctgcatttgaatctggatccattgataggaaacatctgacatccatcacacctatttgtaaaatagcaactgagttaagaaaggtcatttattaaacttaattcaacagaaaaccattcgtcccaaagcaaatctagcaatcataaaaataactcacgtaaccccaggatgaatactgggcaccaactccatttctgatagcaacccagtccagtgagactgctggggaaagtcaacaatgatatcttttccattggcactgaaagccaggacacaacagaaatcacctgatccatcttcctcttcaccaataaaaacctgaacttaaaactgcacctagccatgtcatactacattgtagttatttgttttttacaaagagtctatcttttagagataggtactaaaatgcttatggatgaactaatatatgatgtcagcgcctggtttcaaaataatcacaagaagggagcatgaataattttggccatgaggcgacaatcgttaaagccaggtaatgagcacatggaggttcattgtaaactacattccttacttttgcattaggtttaaaataggacattttggtttctaattacaccaagtcaacaattccatacaatacctttggtatctcagggaataaaaaccacattaataacatgaagacttctttcatcctttgataagagcaacgtgtcactcaaaacaaagaaaccaaattcttatttttaaaatttgtcttgttttgatttgcaaatattttaacaatctcttaagcaaagaaaaatgtttaaagtaaaatattaaataatccacttgttcttatgtaacatgagaagctctaggaacctctcaccactggggaaccaccaactgtggccattttctaagcgatctgatgaaaagagaggcttccacaaggttcaaacgaacaaacaaataatctctttatgcatcaagagtttataaaactatacacatacttatttctcatgcaactgttaaaacggacatagtgtgcctttcaaagtgtgccacggatttgatttggaatctcaacagtatcatattaaatataatctgagaattgtttccagttcctaatttccatcattagcacatttccatttcttaaattcagtcctaaatttttatacagcatgaaaaagagccaggcatggtggctcatgcctgtaatcccaacactttgggaggccgaggtgggcggatcaataggtaaggagttcgagaccagcctggccaacatggggaaacgccatctctatgaaaaatacaaaaattagccaggcacggtggtgggcacctgtaatcccagctactctggaggctgagactggagaactgcttaaacccgggggcggaggttgcagtgagccaagatggcgccactgcactccagcctggtcaggggaggagaaagaaaaagcagtcctgacagtcaggagctggcctgttaatgtcaatgttaggccatttcacagaacaaatgacaggacaagtttacagaacacgaacatcagataaggccactctgtgactgatgaatcaaggcacaaccaaaacccctccttaaccatgtgtgattaaagttgagtctaatccaaaccacaaacaaccacacagtcccctatcctggtgatatgaatgactgcttccttaccaatcatgacgttagcatggctccattctttctgcctgctaggtaaatttattaagacatcctgttttaggattacccctgctttctcgacccctcccccaaatacccaacataaacttcattagtcctcgctcactccctctgatggagacacccattccccaaggtgtgtgttctcctgtaccgcaatgagttaatattaataaatctgattgtttcactgtaggtgagttcctttgtggcctttggcagaaggcactgacaagcaaaggaacactctatctctttcttcacacttgttttctgttttgtgtgcttgaacaaaaagaaatactaagtacatatgcattaatgaaaagttaacatcaggaatttaattacccagatgatattacctttcacaacccccacactctgatgagtcacagatccccatttgtattttggtgtggtgacagaggctttgacccgcactttatcaccaatcttgatgtgagaagaacttcttggtggaggatagcctacagatttcaataacaaatcattataatcagtattcatttatgggaattctgtctctaagaaaaagtaaaagcactaaacaaagaatgtgctcacctataagttccacatgaatgtacctaaaccagtagatgccccctttctgctgccagtcacactgcacattgagatcatgcaatccatctctgtccagcttgatgactttgccaacatcacatcaccttcgcacacttcttcgtatgttcggcagcatctaaccatcattcccacctagaattaaaatgaaattggagatccagtccatcatgtacacaggtgaaatgagccatgataagtagtattactctactcttaataaagaatttcaactgggcacggtggctcacatctgtaatcctagcactttgggaggctgaggtgggaggatcacttgagctcaggtgtttgagacaaacctgggcaacatggcgaaacccacctctaccaaaaatacaaaaattagccagatgtgatggcacatgcctgtggtcccagctacttgggagacttgagttgagaggattgcttgagcctggaaggtggaggttacaatgagccaagatcatactactgcactccagcctgagtgacaaagtgagaccctatctcaaaaaaaaaaaaaaaaaaaaaagaatttcatctagcacccagagtgcattctaagtattatttaatgataaagggaagagaaactctttagaacactgtctggctttgtgtctcaggcaggaaatatacaggaagaggctggatcaacttgtatcataaaggaagggagttttcaaagattactcaaaaggattccctgatcatcaaaaatataacagtggagacatcacaccctaaaagccaatggattggtcatcatgacaataaggaaaacgaagcttcctggtcatctttatacatatcagaacaccaatgcatcattgtgaaaactgatgaagtctccctgtattatcaagagcaaccaagattaataacaaagctttttttcacagaagagaattccagctaatgaactcagagaagatgaagttagaaaatcactatggtgcagcccctaatgataggtctaggtgatgacactaatgcctgctggagctatgagatggacaattaatacagaatgtcatcaaggaaggagcaggctgacaagacctaacccacccaaacctgcttgcctgttgagatggggccggagggagtacatgcctatgaagcttcctgcctgagattcagcctggtccaatcaccctccaaccctaactcctactgcattggagaaacagggagagaggaagatgttagccacaaggaagccacctccaaatgcagactgtaagacatttggaggacatggtttcagccacaaataaatagcatgaaaggagaggaagggagaaggagggttactatgaaatgaatgtttgtatcccccccgcaaaattcatgaagtcccgactcctaatgtggcagtattaggagatggggcctctaaggaagtcattaaggtaaaatcaggtcataagagtggggctctgacacaacaggattagggtctttataagaagagactccaggatgggcatggtggctcacgcctataatcccagcactttgggaggccaaggcaggtggatcacctgaggtcaagagttcgagaccagcctgaccaacatgaataaaccctgtctctactaaaaatataaaattaaccaggcatgtggtgcatgtctgtaatcccagatacttgggaggctgagacaggagaatcgcttgaacccgggaggcagaggttgtggtgagccaagatcgtgccactgcgttccagcctaggcaacaagagtgaaacaccgtctcaaaaaaaaaaaaaaaaaaaaaaagacaccagtgctcccctgctagctccagctccccccatccccagccccacgtccacaggaggacacagcaagaaggcagccacctggccgggcacggtggctcatgcctataattccaacactttgggaggc[136 bp omitted]gaggcaggagaatggcaggaacccgggaggcggagcttgtagtgagctgagatcacgccactgcactccagcctgggtgacagagcgagactctgtttcaaaaaaaaaaaaaaaaaaaaaaaaggtagccacctacaagccaggaagagggccatcaccagaatccagccaagctggtaccttgatcttggatttccagcctccagaaccatgagaaataaatgtctgttgttgaagctgccagtctatggtactgtgttatagccaactgagctaagacaagggggaaccactctagcttggaatagacttcaaagatccatcaaccaaatgcagataaggcatacaatcttggtttatccaagttcaaaaactaaccattaaagccatttctgagaaaactggaaaactacaagcaagcgttagatatgagatgatattaaggaattattatttattttgttaggtaatgctggtaaacagaaatgtcattatgttaagattctttattagtgatactcactgacatatatacaggtgaaatgagatgatttgggggattttctctaaaatatactaaaacaagagaattaggacaagaaatgatttaaagtagataaaggactatataaaacataattagatttttaaagtttgatggcaatgagaattacataagaaaaacaaggaaaggtatgtaggaagtgtcacaagtggggctagtagaaaacagccatccctgcgccatgtccaccgtggacaggccacttgtgctctccggctgcccctgagcccatctgcccctctgtcctctggctacaccggggcagccacagcagcctctgtctgggtgcccatcctgctcagccacccttcacaccctgtaggctttgcacccatctcaccttctcattgcagatcccgatccctggactgtgccctcactcccacccctttactgtagtctgctctctctcattccagggtacacagcaccttctagcgtaccatgagctcactggtcaggtatgtcttccagcaccagaaggcaggctccctgagggcaggggcctctgtccactgatgtttggcatataggacatacccaaatatttgctgagtgaaaaacggatcgaggctccagcttaagacaattactcacctgaatattctctctcacatatacagcataatcatcattacccaagaaaccagctcggtttttgtacgtctggctctccgtcacaacagcaccagtagactacaagaaataaatacattcaaagaaaaaaaaaaaggagaactcaataaatctactcaaaaagaaatgtctgtgaaatctataatattaaaaagtaaaggatgaaatcctttattttctctataaaaatcttcatttaaaaaagactaatagcagtagcatagtaggcagaaatgaatctcaaaagctacaagtatacaaaatttccaaggcacttccaaattaatcctatgaacaatttactcaggtcagaaactgatgtgtcaaaacatggtattttaataaaatatcctctaatggctaccgaagatcatgagatgtttgaacaagggtctgttctgaagctaaaagtaattatgatatagaaacccaatcatcccttcagtagtgaaacacagctttgttctgtgcccggcaacaccataggttggttttatgaaacagtccacagtagatatagttaattctttcaagggacagagaaagccaaggtgtaagactgttagagcgctagacggacagcggcccaggtgcgggcggtcacatgggaggcactgaccatggagtaggcggcatcatccatgtcctccaccacctcctcgtcagaatactcgtcggacaccgtgtctgcatctgagagctccgtgacctgtatgtcggagtggtccagcagccacccgaccaaggcttccacacctaagagaggcacacacagcacaccagccactgtgagtcaacagccctgaagcgggaacccacacacgtacaagcagaggccaggaaaacgaagtaccaggcaagccggacgcattcccggaagcaccagtgagagacttcagggcaaactcgatgttccttctgggaaatcccatctccatgagctgcaccacgatcggcagagcgggaacgggtgactgcttgcgcctcttcactctggcagggcggatgtgctgcacgttgacaggcgtggtggcctcactggagctgcagtcttcaaatcctgggctcgaagggtgagtggactccacaacggccagtgcagcagtctgggcagacaagagggtcctgggaggtttgggaagtgccctcggctagcttacacagtctaggaacatggggcatcatgcaagtctagaaagcccacattcacatgtgcgtttttcaatgagttcctaaaacatgttagaaaatgacaaagccaagtttcgcagtttaatgcagagaaaatacttggtggtaaaataacttgcctgtttcagcagacagagagcctactaaattagccaagtatcaatgtccattaaggaaaacttcattacagccctaagcgagcagtcacaggggcttgagggagcagggagaaaggcatttcccctgccttaaccaggcactgtggtggcggccacaggcacctgtgttttagacaggccagaaatgacacaggactctcatgtaccattaaaacaaccctcaactattcaagggttaaataaccacagtgaggttaaacaaggtattaaaaagtaagagaaataaaagagtattagttgggaaacacactgcaatgaatcagtgaacatctaaactgccagtctctacagctgggaactccccacctacagcacaaatagcacttccctgatctgtctgcaactccctggtcctcctccccagctgctctcatagcactgacttgctattttgttaaacggagcatgtgaggaaggaatcaggaagaaaccgaggacactgtggagccccccggtgctcaggaagtatcaaagcctagggttttgcagcgaagtctgggtaacttggaagtgacaggtttcatcctaaaagtttaaaattcagagccagattgagccaagagttctggttctgataatggggagttagggtgcattggactaacccttggctgataataatcatgaactctggataaaatattttttaaaactgcttgagggcactggagaacagctgacgcaatcagcaataaaacaagcacaacccctgaccccgagaagcctgcaggtaagacgcgcatttaaccacagacggcgcaccttcctgcactgcaggggctggggtcccggcctgccagagcaaccagaatgtgagggaaagcccgcctgagaaagaaaccacagagggaaaaccacgaaatatgcggacggactacccgcaaatctacagctgaatctaaactgaagcaccactgaagagcctgcgctcggcacaaagggaccgctggaaggctgcaggggctccccagctgcccagggccaggacagcatctgaggctcaagctcaaccaactagaggtggggaggagaatgtcaaggcttccagtgacgcccagaagagattctaaatccttgagaattaaggatccacaaccagggctaagggcaaataaaaaatcattagaaagcctggcaccaagccacctcaggatcaaggaggactgccaggtactgaactgcctgtgagaagaaaactccccattctccagaggaggcagaacccagagccaatacaatgtaacgtccaaagaatccagaatgaaataaaaattctcatatgtgaaggacaacaaccaataactgactataatcaagggaaaaaaactgcaaagagcagcagaccaacaggtgggcagatgttagaattagcaaacaagaaattcaacataactatcagaaatatgttttaaaatgtacagcaaaagatagatttggccaggcacggtggctcacacctgtaatcccagcactttgggaggctgaggcgggcagatcatgaggtcaggagttcgagaccagcctggccaacatggtaaaaccccatctctactaaatatacaaaaattagccaggcatggtggcaggcacctgtagtcctagctactcgggaggctgaggcaggagaatcacctgaacccaggagtcagaggttgcagtgagctgagatcacgccactgcactccagcctggtgacagagcaagactccatcaaaaaaaaaaaaaaaaaaaaaaaagatagacttaaaggatgaagaaaggaactgtcagaagagatataaaactattaaatgagagccaaatggaaataagagatgtgagaaatataaaataaagtatgtcttggatggatataacaacagattaggcccaacaaagcaaagcatcttgacctttcaaacagatcaagacaaactaaccaagctactaacaaggagaagaaagactttctattaaagtcataaaaggaaactcactaaccgtgtaacagatgtataatagtatttccagaaaagaacaaaaagagcaagacggggaaaaaaacagcagtcaaaagtttccaaatttggtaggggaacaaaaatcaagccaaagatgcaagcagcttaaataaatttcaaggaggatggtggggtgggcggggtgggccaccattgcatacatgagcccagcttagggaaactgcagaaaaccaaagataacacaaaatacgaaaagcaaccagagaaaacagacatttcatacaaaagaagagatgagaacaacgactctccatcggaatccatggagacaaaacagcggaaggtctttttttgtacaacagtccttctcagttcctgaagaacaactctacacggccttctaggtgttcacactcggcatctcccagcatgactgcagggagcacgtgcaccgccccacgtgctctcaagttgctcagcgtcttttgatctctgccagggagactggaaacacaaccaggccctttaaaatgaaccttcaccttggaggttcccagacctgagaagaagctggagttcagaagagctcatggccaacctcctcccttcctgcccacacccgtttcttgctttctccctttgcacccccaccatctttccagctcgttctaggattgggggaggcctcccacctgtccaaggcagtggctgcctcatctggacccttgctcccagaagggccctgctatctgagggtttctgttagggtaatttctgattgccaaactgagtactgatagttttatttttgtctctgatattttgtccagatttttaatgtattacacagcaagaaagattttggaatgaacatctctaatcctctatgttgccagccatgaaagctcccatccctcttacactcaatcacgtcgcctcctctatgcgaacgtcccgtagccctgaccctgtgcctcgctgctgccctcacctgctccacagcatggagagagcggagaggctggcggcaccagagcacccccaagaggctcctgagtgaatgaaacaaacggctgccagagtcctgacgagcctctttgaataattctacttcctggaaaaagatcccttcatgaagatgtgagcgtttaacccatgctgcatctagttaatattttttcacaatttacacaaacccaaaataaggttaaacttcaaccctctcagtctttagtattataatgttctgcagactatgcacaaacatggttaaaccccaatgaatcattagaattatttgcgtactatcatttaacattcagaatagatccttaagaaaatatacacctagaaaaaaagtgttcacaatttagtgctgtggattaaaaactgtcaaggctgcatggctgtacctcaagttcctgtttatcaaatatggccttcacaggagacggctgggtggccgaggccagcagctgctgcaagaggatcatggggggctgcggcccttcaggagacatgtccccaaggtcaggtgataccactgctccatcatctgaatttaaaaacaaaatatgtgtaagattctattttcaactgcgaacaccactttactattaaagaaaatgcattaagcatgttaaatcaggtatgacttctgcctcattatgtgatagaaaaccaaaatcttcaaggttcagacatcgaacaaaaactagactct[146 bp omitted]ggtggtgggcacctgtagtcccagctacttgggaggctgacacagaagaatggcatgaacctgggaggcgtagcttgcagtgagccgagatcacgccactgcactccagcctgggcgacagaccaagattcggtctcaaaaaaaaaaaaaaaaaaaaaaattagctgggcatggtggtgcgtgcctgtaatcccagctactcgcaaggctaaggcaggagaattgcttgaaccagggagttggaggttgcagtgagccaagatcacgccactgcactccagcctggcaacagagcgagactccatctcaaaaaaaaaaaaaaaaaaaggaactagactctaaaccactttcactgcctgcttttggtctctgtccttcattagtgcatctgtctcttagagccagcaaatgctccttcccagatttctgcacttggtctgattctttctctttttcttgagatggagtctcactctgttgcccaggctggagtgcagtggcacaatcttggcaaactgcaacctctgcctcctggctcaagtgattctcctgcatcagccttccctgtagctgggactacaggcacatgctaccacgcctagctaatttttgtatttttagtatagatggggccaggctgttgattagatttcaccatgttggccaggctggtctccaactcctgatccacccgcctcggcatcccaaagtgttgggattacaggcgtaagccaccatgcctgacctacacactctctttcatgttcactcacggcttcagtaacccctgacacagacacatcccacgtgcatatttctagctgtagcttttccagctaagccttgttgagatcattaagtgaccccaagtccaaatgtgacatgtgctcagggtgatggctttttgtctgttatgagtagctttaggtgcagcctttaggactctgtttgacacagccccagggagatccactgcgctcaagcccacttcacacatctaggtactcatccaggtactcacagcatttgcatgtgctggttttcttcagtgacaatttcaactaactagaccaggagctggaaatctttctcttaaagggccagagagtaaatagtttaggctgatgggctgtacagtctctgtcccaactactcagctctgccattgcagagcaaaagcatccagagacgatgtgtaaacaagtggtgtgcctgtgttcccataaaaatttacaaaaacaggtgcatggcagttttgtcaatctagctctgttcggagtccctgctcggcccaaagcacagacttgatcatcctgattcaggtctgctgtaattgctcatcgggctgagtgcagaacagaacagccaatccaattcccaggctccaatctcccaatctctacaactgggaaatcttcatgttccctacgacctctactattaattgattctatactttcaattgatttctttcatcctcagcaggtttaaaattaatttcatagcatcctctcctcttaagaagcaaacgcacacactccacattctactggacttgcttatttgtttcaaacacactactcaatattcctccctcaactcaagcttgaaacagcagtcaccttccactttttgctggttccccataaagttatcatctacaagactacaccatcacagtggatggcaccttccttccaccagaaccttctttcccttttcatgccttccccctcatcacctgacgcaggagcaattctccatctctgtcatctcctgtttcagatactcctataccttcctagcaggtgtatcacccgaaggtcaatgcttaccatgtggcccctaccacagctttccaagtgggcctcaagtttcaccctggtctcccaggtactctgtaacaggatgtcagctgcccatctagcttcagccccaccactcatcgaaaaaccctgagctccaagaagaggagagctgctcaacgtgcttccaaagactcaccacgttcactcctctcctcctgcctccaccaccagcagagtgcttgtctgctggcatctgtctgccacagccttcaaaggctgcccgtccagtgctcagctgccactggctccagacgcctgtggaaccactcacatgcctcaccgccccctggccccagagaacaaagagagccatctgcattcacttcctctcctcatccaaaccctagagagcaatgatcatagaaaaggacttctccgcaaaagacttagcataatgtctttcaatagttggagatcaaaaaatgtttttttctattaaaagtaacacaagctcattctagaaaactaaatatagagaaatataaagaaaataaagacagccaaaattccaccaaagattactgggtcactgttttgctaaacagataactatggcatatctataaacggatatacatagcagtgtgcttttctgttcacttactgttttcatgtttccacagcaataaacatatacagctagccctccgtatccatgggttctgcatccaaagattcaacaaaccacacatcaaaaatattcagaataaaacaattttttaaaatataattttaaaaagaatagcaataacaactatttacatatcatttattttattttatttttatttatttatttatttttttgagacagagtctcgctctgtcacccaggctggagtgcagtggcacgatctcggctcactgcaagctccgcctcctgggttcatgccattctcctgcctcagcctcccaagtagctgggactactggcacccgtcaccacgcccagctaattttttgtatttttagtagagatggagtttcaccg[142 bp omitted]gttatatgcaaatactacaccattttatagaagggccttaagcattagtgaattctggtataactgggggtcttggaactcatccccatggatattgagggaagactatacatgtaccatcattttgaatggcaccatgatatcacactgtacggatacacaacataagaatgggtattttggtgtctacagtttttcaatacaaaaacaataccaaaaaggaggccataacgacactgttgaatacattatttttatttattattttttttgagacgaagtctcactctgtcacccaggctggagtgcagtggcacaatctgcaccctgcaatccgcacacacggcaacctccgcaccccccggttcaagtgattctcctgcctcagcctcccaagtagctggcattacatgcagccaccactatgccccgccaattttttttttttttttttgagacagagtcttgctctgttgcccaggctggagtgcagtggcgccatctcagctcactgcaagctccgcctcacagattcatgccattctcctgcctcaccctcccgagtagctagaactgcaggcgtctgccaccttgcccagctaatgttttgtatttttagcagagatggg[136 bp omitted]gtgtgataaagtcccacagaatgacttgctgggccaaagtatataaatacatacatacatctatgcatttcaaagtccaactcatttcctcagacgcccattagatggctacaccaactgaaattcccagcagcagcctgttcatggagtgcggctttacgcgcatttgaagaaccagcttaggttcatcttgttacaatacaggctctatttctttggtctggggtgcagcctgggagtctgcatttctaacacatacctgcgtgccaccaatcttgctgacccatgcagcacactttaaatgggaaggcatgaaaatacctttttccctccccacccaccagatgccctcagtcttgtcttataagatgacgatgacaattttattcacagttggtggttgctgggcaggccacgtgtctgttttgtacatttataagccacctatgtccatttttatgaactgattattcacttcctttgtctactttctactgcccttcttataaagatttaagaactttttaaaaagacacctgtgtgaacagttccagtctcctgaacagctggctgagacaggatctgccgcagtttatcctggtgggagaacagcgcccgacctgctttcaggatgtatagcttcaactgctggcgccgcagcaggtccaggtccacttgtcctgcggaaggaaagactcagtgagaagggcgtgccctgctcagactccctcctcgccagcagcaagcctccgccacatggcgacgagtaacgctctgcccttcaggaatctgccgaccgcacacactgtccgtgacgaagggcttgcctttcccagagttacactcggtgcttctgggtaagcatcttctgcctcctgggtcttccttccctgctctccaggcacctaacttgataggacgcaggattcaatgggtttaacacggttagaaccatgttagctactattaatatgatcaaatgttccccaagttgctgaagtttcagccgcttccactcttcttctaagactcctctgagagaatctgtcagccccactagctctttaactgatgaagatcgcagcaatgcccaaggcttatctgatagcagaggccgcagaagcagcacagagagcatggggtgggaaggaaggagggccgcaggtgccgctcggacactggctcaactaactggcagacagttttattcaccacgatgggaaacggcagctactagagaatgccagccagctgaatttcggacatgtggtgatttgcatgcactgcacctccaaccagagatgtgaatgggagatccagagttgaaagtgcttacatcataaatgctgaagcagcaatcgtaggtctgtgggagcaagaggggagaaaactcaagaagactgggcagaatacgccatagttatgggtgaagccacacagacttccaggacataaagaatgagcagagagaagagctccctagaaacatggaaacaaactcaggagaaccgccttctagacccgaaggaaggcaaagccaagccaggctacagtcacagtcttagccatcctgaatgtcacaggcaagccaggcgcttccgggacagaggcccctggatccggcagagaacaggctgtgagccatggtccaacagggtgacggggccacagggccctgggatggaggggaggagggaagaggtgaacagacttctcttccgggataaagggtgacacggagaagagggtgtgagccatggggttcttcaagtgtggctccgaacatggcgacaaaggctgactcgaaaatactcattaccacgaacacagggttacattcccaaccgcaactcaacaaatggtgagcccacgtgaaccccaggactttagtacgtccgtgaattcactcataaaagaacactgtacaaaccacacgagtttaagacggcagctatttcatcaagaagcgccatgtactgacctgcaaaggcctgtttagtcgatttctttattttgtgcttttctaacttgcttccagcgaggttcaccaactgagcccagacagacagcatgggctctgtgaagggcaggttgttcacattaaaggccacggcagggagctggagaggacacagaagctgtcagagtgtggccaatatgactaacaaatgaaacgttctgaaagtcatcaaaaccatgggcttaatcctgaaatgccacacatacccgtaagcctttttatagctgagaataatcattttttaaaatgacattaaaggcaggatagagatttacacatataataagtataatctatattaatttttctttacaaacctgtcaacaataattacatcagtgtggtggttactatcttctcagatattttctatatacttcaagttttctacaacatgtatatattc[147 bp omitted]accccatctctactaaaaatacaaaattagccaggcgtggtggcacacaccgtaatcccagacactcaggaggctgaggcaggagaatcgcttgaacccgggaggcaaaggttgcagagggccgacaacattgtgccattgcactccagcctgggtgacaagagcaagactccatctcaaaataaaaaagaaaaagaatatatagtaagattgcacttgggctacatcaaaataatgtaaatggctccttctccctgtgcatccttgattcacagattaagatgacagtagctgctacattaagtcacgtcactcaaaactactaagcattttctacatgaagaaaggctgtttttttaaaggtgtttaaacatgtttgtttttttaaaacttgagttgttgaataaaaagtaaacttcataaattcacattttaaaataattagaactacctcatagatgcacggtaccttctaggttgctaaagccctcttcgtgtctctgaggctgaaatacacacgaaccactgctttaagtgccctgtgagacaggccctgcttaccacagaagcacaagctcgcacagcttcctggaaggcaaacttcaagtaccagaatcaagttctttcaagtgctgatgttggtgctcggttctagtgtaaagtcaatttcccttatcatgcagtaactaagcacaagttcacctactggtttcagctgattcaatgggcaaacgcgacacgtccgcatgtcagagaactgcacggtgattttgcccttcagggtgatgcgagtcatggtgacttctccaaagtcatcgtgcacaacttggccgcccaggcacaggcgaccatcgatgcctccaaccacagccaggaccgccatgaggccccccacttcagggttctcggaatcagggaagtagtcatctaactgggcctagtgcagaccaaacagcgagctcgaccggggacactcacggagctgcccaatccctacaggtttactgttcaactaaattaattctgagaacacaaacccacccctttggaaggccttcccgcaaagctgtgggtgatggagcggagctgggagttgatgtacttgttgatgagcccattccaccgagtcagggagtgcagcgtgtgcagcagtgccaccacctcctccgccagtgtgctgctgtgggtggcagtcagcgaggcctgcgggcacaccctgcgccgcctcagcgtggactctgaggaggaaaccaggggagaagctgctgcaccactcttcaccagggcacagggaagggagacggccactcacctctgagtgacggcactacacggctcttcaccaggacacagggaagggagacggccacccacctctgagtgacggcactgcaccgctcttcaccagggtacagggaagggagacggccacccacctctgagtgacggcactgcaccgctcttcaccaggacacagggaagggagacggccacccacctctgagtgacggcactgcaccgctcttcaccagggtacagggaagggagacggccacccacctctgagtaacggcacgtcagaggagcacatagtgagcaagctccccaagaagtcaaacagcttctccatgaggcatttcatgtccctcaccctttcggtcttgtcccatgacggaaggactgcttgcaacaaatgcacagctaagatctgataaaagaaaatttaaaa[132 bp omitted]accacctcccaggttcaagcgattctccttgcttcagcttcctgagtagctgggattataggcactcaccaccaagcccggctcattttttttggattttcagtagagacaggatttcactatgttggccaggctggtctcaaactcctgacctcatgatacacctgcctctgcctcccaaagtgctgggattacaggcatgagccactgcgcccagcctctctttattttctgttctcataatgcaagtaatcatgtgaaaattttgagattcattattttacagccaggtaattacactcaagttgattagtgattaggattgtcagggactttagaaaaaagcaacattacagatgcatgtgtttaattaaaaaagaattatttttagtttaattcttaagacaattacactacaaattctgtgaagcagatgagtaagtagttgcaggatttaccacttaagagaaaagcaggtaaactgaaggttagcaacttaccaattatcaaggacctctgccccttgcctccagaaaatctaccctgtcacttctagaccctttctgcactcgttacggaataaaggcccctgactctgagggcagggaacttcagtacatggaggcctctctcagggaactggttttgcctggcagcacattacctgcctctgcagcgaggtggcagtgaagggtgcgtgcccttccacaaccttcatgagcagcgtgatccactgcggggagctgagggcgccgcacacctgcagcgtgagagcgatgctctgcacaaaccccagcgtgcaccagctccggtgttgctccctgtacaccagcctgtttggagaagctgcgggagggaaaatagacatgcttggtaacaagtccctaaagacaaatccctaaagatatatatatccttatttttttatcaacttattttctacaataagctcctttaaaatatattgcagtttgtaaattaattcaaactaattcaaagtgagaagtggaaggcggcttttaagttagttcaagaaacatttccgaagttttcttttttttttgttttttttagagaagggccctcactgtgttgcccaggctggtctaaaactcctgggctcaagtgattctcctgccttgccctgccgaatagctgggactacaggcatttttaaaaccttctaagtatgtgtcgtaaaagtagttagggaattttagctatgcattgtttctaggcaataggaaaatgatctataattcaaatagtaatttgcaacagtgcatctattatatttttaatttcgtgttttaaatatctccacaatcttggttatatttaatctgcaccacttaaatactctttttgtaattttagtagagacagtttccaatccaagtttaatgcatctgcattaacaaaatgagtttttcactaggtttacaccactggattctggcaccagtgggcccacctctgctccgcctggctccaggactccactactccctcaatggaagctgaggcttggaggctgggccccctgagggaccccgcccacagccccacaggacctgctctccctcccacctcccccaccctgccctcagctatccaagcttatgaggacacctgccttccttcagcacactcacatgcgctcacacacacacacacactcactctcacaccctcatatgcatcctcacactcacactgatactaagttattcagacacactcatgggcactcatacacccaccctcacactttcaggtgcactcacaccactgtcgcaatcactaacacacacacaatcccagtcacacgtatgcacaaacagatgcaagctgacacacactcccatgcactctcacatacacttacccctcccaatgcatacaaaaactcacatatgcactcacactcctcaacactagtaatgaccgattactcacccactcacacctttacccacacactttctcactttacactcacacctatactgttataacctcccattcactgacacaagcaaaatgctcacattcactcacacgcattcacaataacatcactcgtgctcacactgacacaaggcactcatacacatttacacaaatgctcacactcaatcgcacacttacacttgtgcctgccacccactcatacttcctcacactcaccaaccctcactgacttacacttacactgggtgtctcattcgcacacccagtaatcccctcacactcacactcatgcctccctcgtgctcaccctcacacacacacattggctcaatgcaccgacgctttcactcccacttcacctgaatgtagtcacctgcccactcacatgctctcatggacatacacacacccacacaaccacatgctacaaacacaccatcacacttgcaacacaaacgctcagccacttgcccatcgaccgctaacacactcactctcatcaatatgtgcggacgctccagcacaccactaatacacgcatgctctcacacacactggaggacgcccacatacccacccacactcacacgtgctcactctcagtcacatgcacactcaccccactccctcagctcacatttctcatacttactctccacacacacaaacactttatggattaaactgtgcctgtcctccaacttcacatacattcggaacctcagaatatgatcttatttaatgaggtctctgtagacgtcattaaggtaagaatttaggtgacatcatgttggattagagtcaaagaaactcaatgaaagagtcctttcagagacagaaaaggacatgcagaacacaggggcaggggccatgtgaagacgcaggcagagactggcacaatgcgtcccaacaccaaggaagcctggagctcccagaagctggacaaagtaaggaaggaccttcccctagagcctgtggaagaagcatggccctgcccgcacctggatttgggacttctggtctccagaactctgagagaacaaatttgttgtttgaagccagtgttacgggttgaattcagaattgcaaaattcgtatgttgaagccctaacccctaccgtacctcggcaggtgaccttgtttggaaatagggtcgctgcggatgtaatcagtttgatgaggttgaatgatgtcctcatgaaaaggggagatttggaggcgactcacacacagggagaatgccatgtgaagatgacggcagagataggggtgacacctctacaagccgaggaacgctaaagagaccagtaaactccagaagctggggcagagccctgaagcagcttctccctcacagccccagaaggaactacccttgatctcagccttccagccaccagaaccgtgagaatttctactgtgtaagtccccaagtttgtatactttgttacagcagccacaggaaaggaatccacacacatccacacccacccacatgcacacccagacacgacaagcgtgcggcccccagcgctgactccctgggccctcgatctctcattccatacatgtcttgtccgtcgttccgctttccactaacattcgcagcagtccgcataaagtcttggtggcttcactctgcatgatctcagcatgaactccagcagacagacaaagagtctgcagtaagttaatagtgctggtaaacatcattgcagtggggtgaatgttcctttcagtttgttcggcttctaaaaaaaataatcaaaattacaaattatattggcagccccagcctcttggatggtcttaccaagcccaaccatgtgaagcttcacgtgttttaggaacagctaagaaatgtcacgaaacctcctcccacaacctggatctccacagataggatctagctttcttggtccacccctaaattctcacctctgcttccctagaagcgataaagtgctgactaactccacattacatgaagagttcagagtcagggaccacagaggaaaggtaaaggcaggtggcaggtggggtgtgcttgggcaggggctctcactggaggaggacgcgatggaccgagaccgcagggcaattccaccaggcctcggctcactcgctcagatgcaggctcagcaccaaccacatgagactcactggtgatgcagctgcccccacctggccaccacattctcaaagaggggcgggtgcacacatgagaggaaaatgcagaaagtcagttccagccagatcgccggatcccacagtcactccacacacctgcatcggaggtgcctgggagcttatttaaattacaggttccgaggacagagcgccagctgcaggtgtgtcctgacatcccattctaaggcccagatggcagtggcagcacccagcaactggacagtttgtaggctgccttggactaaacaccttcctgagtcacccaccagagtcgtcctctgtgtccgaatcctctgctgagggctgtgcaggggctggcagctctgccagcttgaggtcgtattttccttctttccccatcctgtaggagttggtgctgcctgtgtcccactggactcttatccacccgtcctctcccagctcaccaatcactcggcctaggcctggaggaggcccatcctgagaaagccaaagtagagatcagttaggagggtgcgtaacctgccctggtccttccatggctcccagcagacctcagttaggagggtgtgtgccctgccctggtccttccatggctcccagcagacctcagttaggagggtgcatgccctgccctggtccttccatggctcccagcagacctcagttaggagggtgcgtgccctgccctggtccttccatagctcccaccagacctcagttaggagggtgcgtgccctgccctggtccttccatggctcccagcagacctcagttaggagggtgcctgccctgccctggtccttccatggctcccaccagacctcagttaggagggtgcgtgccctgccctggtccttccatggctcccaccagacctcagttaggagggtgcgtgccctgccctggtccttccatggctcccaccagacctgccacacagatgtcgccatatgccaccctgtctgtcaggggctgtccccagacacagatttcacctctcctacaaaatgtgtgcttgcatcattttaaattaaatggcataaaataacgtgctcatgctgctttaccaaggaagtcggggaaatctcatctcaatgaggatcctctgagtcaatgcagagacagggctttgcagcaagtcctgtccccacaatccctcacgggccttgcaagagcggaaacctgaaacaagcaccagcacctccacattccctttgcttcagtttcccctgggccccagggggaagctctgtctctcacttctgcaggagaaagctgtttctaggatggatgctgtctccagacactgctatttctaagatgactgtgacaaagccagggcttaccagcgtggctgagaaaagccagacagaccatgggaaggtgaacactgccctaacttagctagggctgtggtaagtgacttccacctgggggcacctggcagagatttagaagagacctgcgatgagggaagatggaaacgtggccacaggcccatgaagtagatccctaactactggcttcagggcacttcgcagcacatggccatcagcccacaggggcagcatctgggcttcctgcctcagagccttcactacaccaactttcagaatgagatttactctcttgctcactctcacactcttgttccagtgacccatcaaactgagcctcatgccagtgagtttcctgaaaagagctgcctctctttccagacttgattctgctcagatgccctacttatgattccctgtttgtgttcactcccttcagctgctcgggaaccaacacctgtgtcatcgatcaactgacacatcctggattattccaatttccacccaccaatatcgtacagaactatgcagaagataactaatgtgtggctaatgtgttcacatcaaatctctgagtacctgatcgccccatttccagtccacacctctcatgacccttgttccaatcttcatcatggcagccagttctggccctgaaacagggagctgcacaggagccgtttccttccttgtttcttccaaaactgtggcagaagcaccttgggcagaagcattcatatcttcctcaacgctgtcacaactggggcctgacggagcgtcaaaaacaatagctgagccaacaagtagctacagtgtccccttaatacacacaaaacattcacaaagtactaatgaagatcgtaattttgaacaatccatactatatgttttatcaatataatattatgaatattttactgatataggataaaaagaagataaacggaaggatgaaatacataaatatcctaggaagatataaaagatattaaaatgctcagtaaagctactttctctacttctaggaattactcccctgaaaaaagcaaaataactgagttagaaagatcctcatcacattttttattaatagaaaaacaaagataactacctaaatatctaacagtgggaaactaacaaactttaatcatggttctgtgcagaagacagctaacagctggcccgagatacaacctcagacagggttgctgcaggctggccctcagctggagtctggatctcaggagggctcccccattccctaggtggtaggtgtggttccctgtgcctgaactgtctgtacaaacaatgtggtctgtgctgaaacctgctttccttagtctggaacttggtacacgccaggcagggggtgcccgtgtgatcagtcctgatggaaaccgtgggcctggagtctctacccagcttcccggcagacagcacttgacacggctcggtgccagggcagttaagctcgtcctgtgtggatcctgtggaagcttgtacctgctttcctctggactttacccatgtcctttttcatgattttgctctgtgtcccttcactgtaataaactatagccctgagtacaactacatgctgagtcttgtgagtcctcctggccaaccatcaaacctgggggtggtcttggagacccctgacaattggtgccctgggtggctacagagtcatccgtagcacaaaacagaagccgagctgctgtcacctgagagaagtaaaacttcccaatggatctgaaaataggagcgctaaccctaggagagtaggctagatttttaaccccccttttcccacttgctaaactgagagggggtaggagtgtggttctggtaactcccttgattttagttttctcctccaggtgggagggaaaaagatccaaacagtcccaaaggtgggctggggtggaccaaaaaatgtaaaaagtttgtgtttctctctcttccaagagaacaaaaaaggatattcaattcccagggctggagcaaaactttagataaactagcaggagaaacagcctttcctttagcctagccgctactttagggcccccaggaaggggccccaaggaagggacaggagttgcattccaggtggatctcccaggagcccctgggcagctatactgttaactctgtaaagactgaatgtattgctaagggcttgaataaatttgcaaccaaaaccggggggaatttttttattttacatagctttatgttttgtggctgttacatgtggatgtatacattaagctggtataaaatattatatgtttataatttcttaaatgataagaaggataccctgatcagggcaggctgcaaatatagacggatattcatgagacacaacttccttgctttttgcagccagtgggccagatgaaatttaaacacatgaatattatcaacagaacaagtccccatacttaatgatttgtgctgtgatttttacttattggaacctctgggggaaaagtagacaacataaaaaggccatttctcgatggagatatgcttttgtaatttttaaatgcaacttttggttgctaatgaggcctcaggaaatcagatataacccttactagatgattcttttcagctgtaatatacatattaaaatatatatttaacataatacaacatataaacataatatataaattaaaaaataattatatatatatatatagagagagagagagagacagacagacagacagatagaaagattccacccacccccaagacaggatttcactctgtcacccaggctggagcccaggctggagtgcagtggcttgatctccgctcactgcaacctctgcatccctggctcaagcaatcctcccacctcagcctcccaggtagctgggaccacaggcacacaccactatgcccagctaattttcgtattttttgtagagagagggtttcgctatgttgcccaagttggtctcaaactcctgagctcaagcaatccacccgcctgagcctcccaaagtgctacgattacagcctggcctgatacatatttttgaatggattaatgtgaactctaaaactgatgtgattataagagcttgggaaaaccttgctttttcactgtgactttgacaactggccctgcagcatctcagttttagccaaagaacaccaccataaaccaatcagatctaatagacatatacagaacatttcaccaaaaagagcagaatacacgttcttctcaagtataccacaggacactctcttagactgaccagaccatatgttaggccacaaagtctcaaatttaaacagacgaaaatcatacaagttaccttctccaaccaaaaggaaatgatgagaaattaataacaaaaggaaaagtggaaaattcacaagtatatgaaaattaaacaacacatggtaaacaatcagtgggtcaaagaagaaatcacaagggaaattagaaaatactatgagatgaatgaaaacacaacacaccaaaacttctgtgctgggccaaaagcagggctaaaaggggcaattatactataaaagtctgcatttacaaaagatgatctcaaatcaataactctacatctggaagaactaaaaaaataagaacacaataaaaaccaaagttaggccaggtgtcgtgcctcacacctgtaatcccagcactttgggaggctgaggcaggtagataacttgagcccaggaggttgaggctgcagtgagccatgagtgcgccactgtacttgggcctgagggacaaagtaagaccctgtctcaaaacaaagacaaaaacaaaaacaaaaaaatacaaagcagaaagaaggaaacgatagagattagagcagccataaattaaatagagaatagaaaaataatctacaaaaccaaaagttcggtttctggcaagaacaaaaaatctgacaaacttttggtaaattaagaaaaaaagaggccagtcaaggtggctcacgcctctaatcccagcactttgggaagctgaggtgggcggatcacaaggtcaagagatttaggtcatcctggtcaacatggtgaaaccccatctccactaaaaatacaaaaaaaattagccaggcctggcggcaggcgcctgtagtcccagcttacttgggaggctgaggcaggagaatcacttgaatccaggaggcggaggttgcagtgagccaagactgtgtcactgcactctggcctggcaacagagtgagactccatctcaaaaaaaaaaaaaaaaaaaaagaaaaaaaaagagaaaagatgcaaataactaacatcagaaatgtaagtggagacagtactaccaacataaaaataaaaaagattataaaagaacactgtgaacaactgtatgccaacaaataaaatagcctagataaaatggacacattcctagaaacataaattacccaaactgactcaagaagaaatagaaaatctgaatagagccata[221 bp omitted]aaggaaggagaatggcgtgaacccgggaggcggagcttgcagtgggccgagatcatgccactgcagtccagcccgggcaacagtgtgagactccgtctcaaagaaaaaaaaaaaaaaatctttcaacaaagaaaagcttaggtggtcaactctaccaaacatttaaagctgaactgacaccaatcctcaaactcttctaaaaacagaatatatgggaacactacctagttcattctatgaggccattattaccctgataactgtaaaacaataaaatattgctgaaagaaattaaagaggacagaaataaatggaaagacattccacattcagagaatggatgttaacattgttaaaatggcactatttcccaaaacaatctacagattcaatccctagcaaaaatcccaatggtctttttttgcagatatggaaaagccagccttgaagttcatgtgaaaatgcaagggacccaaagtagccaaaatcatcttgagaaagaaaacacacttctcaattttaaaacagtacaaaactacaatgttcaaaacagggcggtacctgcacaattatcaacatatagaatgtgataatgtaattgagagtccagaaataaacctaaatatccacagccaactgatttttgccaagggtacccagaacttcagggaaagaacagtcctcaacaagtggtattgaaacaatcagatcaacaaaagaaaaaggctggactcttacctcacactgtgtaaaagaaattacctaaaaatggaccaaagatctaaatataagagctgaaactataaaacttacagaagaaaacatgaggataatcttcatcaaccttgtgtttggaaatggctttttggatatgatatcaaaagcatagacgacaaaagagaaacagataaattgaacttcatcaaaataaaaaacttctctatctaagggaatacaatccagagaacaggagaaaataccctcaaatgatatacctgataaaggtctacagatctgtgaaggtctagtatacacgaactttttaaagagtctgaggactggtgttaattcttctttaaaggtttgatacacttatatagtgcatttattggtacaacaagatgacgacaaataaccctatttaaaaaggagaaaggggctgggcgcagtggctcacgcctgttatcccagcactctgggaggccagggcaggcagatcacctgaggtcaggagttccagaccagcctggccaacatggcgaaatcccatctctactaaaaatacaaaagttagccaggtgtggtggtgtgtgactgtaatcccagctacttgggaggctgaggcacaagaagtgcttgaacccgggaggcggaggttgcagtgagccgagatcgtgccactgcgctccagcttgggcgacagagtgagactccgtctcaaaaaaataaaataaaaaataaagagaaagggacttgaatagacacttctccaaagaagatatacaaatggccaacaagcacaaacatgtaaagaagctcaatgtcattcatcattagtgaaatgcaaaccaaaatcacaatgagataccacttcacacccgctaggatggccttaatccaaaaaaaaaaagaaaaccacaaaaaatagtgttggcagggaagcagagaaactggaaccctggaatcctgcccactggtgatgggaatgtaaaaatgatatggcactgtggaaaactttggtagtttctcagtaagttacacatagttgtaccatatgaccctgtaattccagtcctaggtgtataatcaaaagaactagaaacaagtgttcaaacaagtacttgtatataaatgttcctagcagcactattcacaaaagtcaaaaggcaaaaccaacccaaatgtccatcaacagataaatgagtaaacaaaatgttatatattcatacaatgaaatctttttcagccataaaaataaagtactgatatataccaaatgaaataacccagacacaaaggccacaaatggtatgattccatttatatgaaatatccgggatatgcaaatccatagacagagaaagcagatttgtgactaccaggggctggagagcaggggagtcaggactgatggctaaatggggtgcatttatagtgatgaaaaagttctacaactagacagtggtgatgactctagaaaattgtgaatgtatttaataccgctgaattgcgacgttaaaatgctacactttctgctatttgtgtcttaccataatttacaaaaagctttttttaaaaaaaagaaagaaaataaatcaaagcaaaatcttgacgttttcccaaaggctctcaagccagtgcagacctaccaatcaggcgcagtgccgtctgagcgagggccagcgtgccggaattgagcaggaggtcaaggttgtttgcgctgtgctgcagggtgagcatgctgagcatcaccaggaggaagtgggcttgcgggatggtccccaggctcggtcccgatgggttctcattggtgatggtttgcaggggaaccggctggatacctaatgagcattggcacccactgacatttcttgtaatggatacaagaataaatgtaatgcagaaagcacgggcaattactctaaacatctgactaataagcactgacacccactgacatttcttgtgcgtggatacaagaataaacgtaacgcagaaagcatgggcaattactctaatcatctgactattttgacacccactgacatttctctcgcatggatacaagcataaacgtaatgcagaaggcacgggcgattactctaaacatctgactatttttcagtggtttccacagagtgggcagctctgtcatgctgcacgatgggcctaccccctgcattctatgcacaggtcgttccatctgtctacaggacttagtatgctgctctctgaatacaccggtgccctattccattccttccatttcaaatataaaagttatgtctcacttttcctccacaaaaccaatccaatcaactctctgtagatgctcaaactatccaggaaataaatatcaatataggacacagacactttaggatatgtggtgatacacataaaaatgtcaaaatgtaaaaatgttatactagagtacttcaacattgtgtctcctgctaaattttaaagttttgtttaaaatctgagaaagctgacagcagcatagattatacaagtacaaagtacaaacttattaaagtcttctcaaaagcaaaaattggcatttgcaagtttccacaacatataattaaaggcaaactataaaataacattgatacaattattgactcaccaagctctttaaatttggcactggcatccaccaaaacatttcgaatgttctgaacagcccaagcgtacagcttgccaaaggtgacttccagcagcatccgattaaaaggcgggatcaaatcaacatcctttaaacaatcagtaagaggttccctttcaaataaagataaagaatttgactcgggacactgccagacttctaactgttacagaaaaacattctgttgccacagcttccttaattaagaaaaaaatatgctaacgttttaccctatatcgattccctcaggaataagtctttgccatccacaaaacatcgcatacggcacagatggaagtaagaaattcttgctcaccagatacaattttaaaattgtatctatcccttccaggcgaacctctgctctctccaactgcaaaatatcaatgcatacagttaagtgttatgtatattacccaatgcagagaagcatttctcatcaaatgttacctgttttagtaggcactttctcttttccacatccactggctcttctttaagggcaaattcagcaattgtactgaggagtggagactgcggataaagaccctgcacattctgcttcaaccacttgtatttgtgaacatctgtaacagtactcaacagcggctgccatttgtcctaacaaaggaaaacaattttcatcattagtctaccctatttaataataaactgtgctctaaaagttattcaagtaaaatataaataatgcttatgggtttaaattggttaaaatacgttaaatttagtaatacatgtttttaaaactatgctataaatataagtgaatttataatctctatactatatgttggaacaggctagcttggcatactaagttaagttatggttcatattaacagccacagggcccagcactgtttctggaacaaagaatatatttaaggaatgaatggtgaataattaatgatacaatctaataccaaaaataaaaggaaacccttctccagctacagctctgaccaggacatcataagtcaagttcatgaagcatcactggggccgtatttctaacaaccgcccgtccctccctccagatgctcaggtacagaggtacaagactgtggattcctgtgctacatgctacgattctattcagccaacctcagaatcacagaaaataccgcaccttgggtgatttaattgcaatgggtctcttgtccacatttattggactatgaggcaaaatgcaagcttcttctaaatcactctcttcgtttccaattttttcttcatcatccgtagattctggcttcttaggaactgtgttttaaaacatcattcactataaaaatcatacacttaaatattaattttaaattaagacatatttagatttacatgaaggacaaatatttcattcaaataaacatctgaacaacattataaattgcaatgctcaacaacaagagtgaaatgatcaccctggcagaacaaaaagacaaagtgagagtgcgacgaggggagaagccccgaagcaggggaagcccggcagccagcaagctcttcctcaagtgccagagagtgaacatttgagtctttcaggccatgctgtctgtcgcaaatactcaactctgctgctgtagcacaaaaagtaaccacagataaagcaacaggtgtggctgtgctcctgtaaaactttatttatggtgctacaattttagcttcatgtaattttcatgtgccaaaataatatacttcttttaatttttaaataacaatttcaaactggaaaaaaaaaaaaaggtcttagtccatgggcaacccaaagccagcaagaggtagaatttggcccatagttcctggcttgtccaccctggtccagttcagtggttctgttactgtgtaactgaatcaactgaattcactgtgatatgtggaatttcctccctatactttatctcttttaaaatttttggtctaaatctcctcagcatataatataaaaaataagcaacatgataatacatctgggcagtaaagagctaacatagcaggccggggttgctcaaaccctgcaaattcccaaggaaggtctgtcccttcaggattggtccttcttctaggagctgagctctgagcccttggaacatcctgcctgagaagttttttggtatacctgacacccaggaccttgtggcagtggtctggccaggtagtttatgctaatgatgggacttgcgagggaccacttgtttttgcactggggcactggagcctgagtgaggtcagtcacaggggcactgcctgcgtatgtgactggcccccaacaaaatctctagactcgaggctcaggtgcgctggcctggttaacaattcttcacacatgatgtgacactgttgctgggagagctaagcacatccacgtgacgccactggggagagacaccaaagcgtgtgcctagtttcctctggacttccctccatgcacccttccctctgctaattttaatctgtatcctttttgcagtaaaaacacagctgtgactataacagctcttctgagtccttttagtgaatcaagcctgagagaaggctcggggatccctgacacagcaacaggaatattaatcacttaatcttttcaagttacttactttccaaaaaaaaaagaaaaccagcttgaaacaccacacgataaatctataaacccacaagaaactctaaaagtgacagtgtgggctcagaacccacggatatgagatggcaaatgtggagtctctctccctcattccgaggcagcctgtctcctgggcccaggctgagttcctgcatgcctgggttaaaggaatcgcagcagtgtgactgctgtgacttcctgatccagagcacccctcgcattcagacaggctgttatggtgtagggtttgttcaggaacaatcaaattaggatggcttctaacacactttagtctttcataagcttattgttcaaaatgcccatcagaaagtcagtaatcaatactgttcaataagcaggtttgtgagtaaatcagtataagtcataatatgatcagaggccaggcgcggtggctcacgcccgtaatcccagcactttgggaggccgaggcaggcagatcacgaggtcaggagatcaagaccatcttggccaacatggtgaaactccgtctctactaaaatataaaaattagccaggagtggtggcgcgtgcctgtaatcccagctacttggaaggctgaggcaggggaatcgtttgaacctgggaggcggaggttgcagtgagctgagatcgcaccactgcactccagcctggcaacagaccaagactccatctcaaagaaaaaaaaaaaaggatataatcagaaatttctgtagtttatttataatcacaagtgactaaattctaaactattttataatttctaagcatttttattcaaatttggatttaatgcaaaaagacttttctgtacccttacacagctacttccaggaaaatgtcagtaactcttttagcttccctttatagttcttcatgtatcagaatactcaatatttccaaacaaaaaacatttctttagaagaatggcaataagtttaaatgttcccattatatctcattaccaggataactaataaaagtacttccttgttcccatcaatttagcaaagattatttacgttttcaacatcaatttactagtaatcaaatcataccacactcaattcctaaactgcctcattgtctgatcatttggaaaaataagcgagatgtctgtatttaatcctaactataataaaaatgatggcagcaggtagaaatgttacatggaatcaacagtagagaaacttcactctgaaatcacagatccaacgtggcagggtgaagcacaagctttaatagtatcttctgtccttttacattcttacctctctttttccttggttctcgaattatcttctgagctatcctcctccaatggggcaaagaacttaacaatttaaacttagacattatagagaggtcattacaaacagcaggtctcaattcattaaagaggaatctcaaacgtttgatgacaggagcgcagacctccttgtaagaacggccctgttcttgatgagtctgcaaagttaaccaggaaaagacaactttaacaacaaatatttcagcaactgtctgcaaagcacagaataaaaagaattaaaatctatcaccttaatgagcgaacattttgcttggtagacaactctacaaacatccaccactgacttaggcaacgttctgtgctttacttgctcaatatcaagtgcacctgcatgaactaaagataatgccacatgacctgtaaaaagacatttaaaagaagggcagtgaaggaatgaatacgtaccacaggttagtcgaggaatctgcagtgtagctaaagtacaaagatattgagctccttacctaaatcttcatgttttaagaggcaacataacagcaagcgaccgacctcttccacgggatgctcggggggaaacatgatcggtgtggtcaaatggcactgcctacagtacctttctatttgacacaaaaagtcctgcaacaggaacagctggaagtaacttcagggaaacccagtgagtcttcacaaatcttaaacatgccacagcttctgacgcacttgcaatcactaatgcttctgaagcctcgctagcatgttaacacaatcaggttctcacctcaaaaccctccaaataatacatgaaacaaagtctgtgctgtgttaaccaaagagcacataagtattcctatgtcaaagtcctcagataaacagagcactgaggtggcagtgggggcaggcctagctcaccttcacgttgtgatcctgaatgttgttgtctgcaatggcttgcagaaatgcctgggaatggtcccccagggcccgtctgtgggagcagagtcgagatttgctggcaggtgtgccccctggggagctgcagtggtcctcgtctttctcctcgttgtagctgtagtggatctggctggtctgcaggcctccagagaagatggatgactgaagccattctagaaaatgcacacacaaacatgaaagagaaactcaagtgcacaactcaaaataaatactaaaaaaaaaaaaagatgctcaactgaacactcaatttagaaggtgaaattcagcatcattcatatgaaagagctccacctaacatgtttacacaggttgacttataattcctctatctacgtgaacacactttctggtgattccacacgcctcaggcatggcatcagaactcaggatcgtagttccagtccaacattctctggatacctgtgctctgcctgcagctgcctggttccacaggtaccgtgtgaagactgaggtgcacattctaacagggaaggcagcaaagggcaccgctgacacaattaatcacaggatttcaagtccgaaactgtgcaacagatgactatgggggtaccagggagactggaagacagaccaccgctattctgagggtcagtgagggacttgtggaagcaacaactgagctaagatgaggaataagacccagacgctgagtatccaggcagggaatagcacatctgaagggtttctacaaagaattacatcctcagggtaggctatgtattcctagagcacttataaaggaatgaaaaggagaaaatatttaagaaacacacaatctgtaatgaaggatagatccttggagatgggagggccgatggactggaaaggagacctgtgcgtggtgcaaggcatgggatcaaccagtgcgaatgttaattacaactgcttatggcaacttgagggagtgcaccactacagatctctattaacgatctgtgttatcaaatactgctccaaatccaagcaatcaaagcgggatgcacttagtgttcttttactggacatttagattttagagcactcaggagcattccccaacacaccacattcgttcttctgaaacactaatccaatgccgactctctctggccccctctctttaagcacaggacagcccctccttactgctccaagataagcctctgatcctcctgtggatcggacccacctgccagggcccatggcaccctctgccctggagctcgccagccctgccctccttgccaatttaaacaaagcccatcttctggcaagcaatgagccttgaggaggagggaaggaagcagacacctcagagggcaccacaggcagcccagcacctagcactgcacaaaggtccgcccaacggggggctgtatggacaccaagatcctccttccctgcaagcctctgccacacccactcctgcaagcagcaggaaagccctgctcctctcagcagtgcccttgacactcctgtgttttctgcccagaatgctctctcacgcaatttcaggactgctgccaatgtgaagcctttcttctcccagaaccatgtatgaacatctccatttcaccattcaccaccttgtaatgtgacctgcttagaatggtggctcatcaacaagcagcagctgaaagcagaggcgtgtcctacccatcactgcatcctgaacacctcgcatggtaacggcaccagaaagcagaggtgtgtcctatctatcactgtatcctgaacacctcgtatggtaacggcaccaggcaaatgctcaacagaagctgctcacatggatggacagacagacagatgggaaatgcacaactacatgaaggaaaatggaaacacatcttaggagacagaaagaagcttattattttaggtggttacaaaggctgccatcctgaaatataactgacttgagcctggtctggtaaaaacgcagtgctcaaatagtatgctcttccctgagaggacagctgatccacattctgtgcaatttctgggcatgcagggagacaaaagccatgctgggcccatcaggcagaggctgcaatacgtgagaccaccaagggcagacgggtagacattcctgcacactttttagcttcctctgcagcaacagaccatgagggcaaatgacaaccactcacagctgtttctacctgattgagtctcactatccttattatttttttttttgtcatcatcaactgtgttgaatcctcctctccttttttttttttgagaccgagtctcgctcttgtcacccaggctggagtgcagtggcgtgatctcagctcactgcaacctccgtctcctgggttcaagcaattctcctacctcagcctcccgagtacctaggattacaggcacccgtcaccacacccagctaatttttgcatttttagtagacatggggtttcaccacattggccaggctggtcttgaactcctgacctcaggtgatccacccgcctcagcctcccaaagtgctgggattacaggcatgagccactgcctggccatctcctgcttttttaaagagagagtcttgctctgtcacccaggctggagtgcagtggtatgatcatgactcactgcagcctcaacctcccaggctcaagcaatcctcctacctcagcctcctgagtatctgggactacaaatacgtgccaacatgcctggctaatttttgtgttttttgtagagatggggttttgccatgttgcccaggctggtctcaaaatcttgatctcaagcaatccacgtgccacaacctcccaaagtgctgggattacaggcatgaaccactgtgcctggccctctcccactcttaatggcacttacagttcaaaaaaaaaaaaatctgctgattagcaaaaagtaaagattttcttactggcacattcaatctcgacaggagacagcggtgtgctcattgctaaataggaagcgtgtaatccgagaagcaggcccagattcctctctgtgtctatcagaggtgaggagagactccccagatctggtatggtgacgccttcttggtcaggctggaaaaataaatttaatcatcaatctgaggaaacagaattaattaaaaacataaaaccaaaaggacagctctctcctgcagctgtaccgcacgtgagcccaggggtgctctgggcgttctgcccctccatcctgtaatgagttggtgctgctgtgcccaagtaacagcagataccatataaacccacatgccctataaagcaggcagcaaccgcacagccctactgtagaaaaactaaaccacagatacatgatttggctagaatattccttaggaatcagtttccaaagtgactgtacaccatgcttcagaaagtataatgaattgttacatgcataaagaacccactgggcaacaaaactatgacaagtattcgatgacaagtattagtggactgtgaccacacatgtagaggaaatgaaatttattctaacaaaaatcaaactctgaaaaaagcaagagttcaactttttcagtcacagaagatatttacagcaaagttaattctccccttcataaactgttttaagccctgccctaatggcatttaatacatcttattacttgtcgatacctagtaagctaatcccaatatataaattctatgtgttcgtgaatacataggaaggacatatttctattgtaaagaattacacttctacatagttcttcccaaaaaatacatacctcaagattataagccattccaaatttctacataagaccaaagtttaacctcttttcttgtggaacactgcctatatttctcacaaattgatcatttaaaaaacaatctttcaagaccagtacatcacagatcttaacatgaataaatgtaaattcatttatgacaaaacttctaaaggatctttatatttatccctaatgccccgcaaaagacccagatatcagtacttctagatccaaatattcctatcacaaacacacagagggtatcccctgccatcctctgcatcactcaaggcatacagcctcacctccaaatactggccaacacaaaatgcgtgcatggattcccgggtgtcttcaaactgcaaagcagcttccaaagctaccactgggtcttcccctgcaaactgagctgaaacaaaaagggaaaaagcaacatgagttcaattcagcttgcctgaagagctacaggagaaatagtgagtaggaaataagttaggctcttaactcaaaagtgagggttaccagaatataatgacctcccactgtctcccagggttgcctgggccaactcggaacttgaaatgagttccaagtattaaaacaaaagatacataatgaaaggaaattcttcgaatgtgctgaatttgttgataagacagacaccaaagccacagatacattaaaatatgcgggggctggcacaaaactaaaggaatcatttataagccaaatactctgcttaaaatgatacaggctgtaacttttaaccaggaaataacaagtgtaatcttaccaagaatactattttctgttaacgactgtgtctggaagtcctttatatcatacactttcccgtcaatcacagtccagaagcctccatcgttattatggttctccaaatcagctatgcgtacaaatgtcactttctcattatttctacagttctgacctgtaaaaaatgactctgtatatacagaaaccagaatcagtccattgatcaatcaacaggtaaaatgaaaagaacaaactgtgtgaaagaactacaagcagaaataaacaaatccacaatcacaatgggagaaatacatacctagctctgaaactaataccacacatacaaattctgttaaatatagaatgctttaaaaaaaagtctaggcagcatgaataccaaatcgggccatgccaggccatagagtaaatctcaacagatttcaaagaaataaacttacagagcatgtgtgctgactacaatgcagttaaattacaaataggttttcaaaaattcattcaaaataaaataaaaatgactctgtatacacagaaaataaaaatattcatccacatatttgaaaattacaagatacacttataagtaacccaaaattctaagaaaaaatgactatgaaaattagaaaatgtgttcagttaataatcaaaatactgcagatcgaaattggtgacatacaactaaatgcatgcttgagggcatttatgcctttaaatgtatatatttacacattaaagggggaaaaagctaaaaaagaaaagaaacaccaaatcaataaaagtctgttagttcataaaaatactcaaaaaaaagaaaacctgagtggtggtcacctatgcaagtgctaggataccaactcaatattatgaaaaatagttaaagggaggtggcagttcaagaagtcaagcttagattatgtccttgctgtacaaattgtacctcctgctaaccagacagcagagggcaaggttggtaggggattttatagaggatacgcaacacatgaattccctggtctagcttcacagaactaaagcggggagccaccgagcattacaggcctcctgagccaacagaaagcatgcagcatgaccccagacataacaccgccccaacgagactgaattcaaatccaaccaaacctctagatctaaccagcagattaatgtaactaacagaagaacatgttggtctagaataagagaatgcaatcaaccaagttcagaaaatgtgaagttctccaaaataaccaacctgcttctttgaaaaagaaaacggtatgatcagagacagggagaagagggcctggagccatgttgtttggggaaagagactagaagcatatgtcaagcaatgccaatacgcagaacatgctcaggtcttaattcaaaattaccacctaaaaaaggcatttttgagatagtccaggaaaatgtaacatggactgcatgttagattaaggaatcactgttaatcttatagacaggataatgatattgtagggtttttttaaaatccttatcattaagaggtaaaataccttaaaatgttttaaagacag[131 bp omitted]cccatctcgtaccatgccatattactgcatttaacaggtatgatgaagcaactgaacaggctatttttccatttccattgcatttcaacagagcccattaaaaagtagtataaatggcccttaaatactaatatattttaaaatgctcaaactatatcggggtcaccactttgtgctttagcaggcaaaatcccaaaagcccacacacaaggctgggagaccagcatccctattggtggtgagagaaatcaagatgtacaggagcaatctggtgacaaccagcccacacgaggtccatccccacctgtgcatgtgcacaggcacacacgcgtgcacacatggaggacacgtgttccaggccaggccttgcagtactatttgtgttttctgttgttgttgtttgagatggagtttcactcttgttgcccagcctggagtgcagtggcgcgatctcggctcactgcaacctctgcctcccaggttcaagcgattctcctgcctcagcctcccaagtagctgggattacaggcacccgtcaccacgccccgctaatttttgtattttttagtagagacggggtttctccaagt[135 bp omitted]caagtgtccaccaataagagactcactaaagaaagatagataaaagacacatccacacactgaagactaagctgatttataaaaacaaagagggacactctgataaggtactccagtatatatggttagttaaaaaaaaaaacaaaaaacaagcaacacaagtaatgaagcatgctaccacgaacgtactcatgccagagaacaaggaggttacagaggagactggaaagtcagagggagcaggtgggaaaatgggtggaaggggtgggcaggggaagcgacagtgtgtctctgcctaggtttgatttttgaaccatgtgactgtattttttttttttaatgactgtaaaacaaaataaatactctttatactagaaataaaatgttagaaaaatctggattcaaaactaggattactgttctgcactggcaaagttcactaccattcccaaaggcagttttctcattgacataatgagatacaacagcgtgcatgaggtcctcagcgggcctgcaccctacaggtgctccacacatgcaaatcactaccattactattacataagagatataatacataattatactgtcactactataaccagcatgacatactaagacagcctgcgttcagagtatgaagaaggctgtggaaccccctgcagaaggtgggagggcctggggctgtggataaaggggagctctctggggctgtgccacctgaacctggaacccgggcccccaggttgggtcgccaggcctgtgcgcctcagcttgctcatcactcactctcaacacggataacaccttcaactgcaaacacgtttaaaaaccacaggccagctccccctaccaataccagaaaaaacaagtctccacacgggcccaggatgagaacctacaagtggtactagctacaaaacacatggagaacacggttcttgcacacaccttatgagacgtcggagagctacacagaggaggcatctacagggtgtagccagacggtctaaatgggccatgacaacaaccgccgtttgttgcagatcaatggcaagcctgttgtcttgtggaagggtgaggtacctcaggaaactctcactggggctcagaggaccagacaaaagctagaaaggaaaagtaaacaaaaattcagaaatggtgggaaaaactaaagtaacacagttttttacccaagctttatattttggtattgactcatttgacccatcaaatgacaatgttgatgatacagttatactatacgtctatatatttatgcagcatataaactgtataaatctctaaatctgctgtatacatgtacacaacattgactgtgcatgtatacatttatgataccataggtaagttgaatccacacagattactaacatgaccaaaccactctacaagcctaggacccctggagaaaggcagaaccacctctgtgggaacccagcacagcatctcaagctggccttgaaatctaaaaccaaaacctttattttaatctaaatgttgcccactctggagaacacctactttcatttgcaaattaaatcacagttctaattcttctaaaggcagaagacccctatt[132 bp omitted]aacctcatctctattaaaaatataaaactgagctgggcatggtggcgggtacctataatcccagctactcgagaggctcagacaggagaatcattcgaactagggaggcggcagttgcagtgagccgagaacgtgcactgcactccagcctgggaaacaggcagagactccgaagacgggaagggacgggatgggacgggataggacaggacgggatgggataggacaggacgggaagggagaaagaaagcaatgtacccgcaaaacaaacaaacaaacaaaaaaacagtctcggggacctatgggactataacaactccggtcactgaactcacgaagggacaggagaaagaaggtggggctgaaactgtactccatgaagtgatggcttacaagttcccaaatttggcaagagacataaatctacagatctaacgtaagcaaaccctaaacaggatgaacccaaagaaatccaaactaagacatataataatcaaactccaaaaaacaaaagacaaaacatttcaaaagccactaaacaaaaacagtgccttaactatcgtggattaacaagtcaaatgacagcgaatttctcatcagaaaccatggagcccagctgaaagtacaaaatatttttcaagcgatgaaaagaaccattaacccagaattcttatatccagcaaaaatgtccttcaggaatgaaaaggaaagcaaaacattctcagaggaagtgaaacagaatttgtcaccagaagacccacaccaaaagaaaggctaatggaagttctctaagcagaatggcaaccatcaaagaagaaaaccctggaacttctggaaggaggagatgacaagcacaccaacgcataaatacaatagacttttccctcacctcttgactttgctaaattacgtctgaaggttcaaccaaaaattataacattgtcatatgtggttatcaatgtaagtaaatgaaatatttaaggcaagtatattatgaacagaagaacataaaggaacatcaagggaggtagtttctatatccctgaagctggtaaatgacaacatcaggtaaaatctgataagtgttcatacatacacaggctgagtgtcccttataaaatgctcaggagcacaagtgttccaaatttcagatttttatcagatttaggaatatctgcatataaataatgagatattttggggataggacccaagtctaaatacattcatttatgttttatatataacttatacacagagcctgaaggtaattttatatagcatgcttagtaattttgtgcatgaaacaaagttcatgctaagtacttatgaatggaattttcaatttgggggcgtcatgctggagtgccataaagtttcgaattttggggcatttcagattttggattttgggtttacagatgctcaatctgtatgcaatatattacctagaaaagccactaaaaaagctatacaaaaagatacactctaaaacactacagatgaaatagaatgctaaaaatggtcaagtaaaccacagagagccaggaagaaccaaaccgaaaaaatgaaaaacagaagaaatagaaaatgcaaaacaaaatggcagtgttaagcctcaatttatcaatgacattaaattaaatgtaaacaatctaaatacatcaattaaaagacactaggagagtagactagagaacatgatccaactatatgttgtccataagaaagtgacttcaaacaggcaaactgaaaatagaagtatagaaaaaaaaagatcatgcaaacattactgaaaggacagcaggagttggctatatttataacaaataaagtaaacttcagaacaaagataattaccaggagggccgggcacagtggctcacgcctgtactcctagcactttgggaggccaaggtgggtggatctcaggagtttgagaccagcctggccaatatggcaaaaccccatctctactaaaaatacaaaaattagctgggtgtgatggcagaagcctataatcccagcttctcaggaggctgaggcaggagaatcacttgaacctggtagggtcggaagttgcagtgagctgagatcatgccacttcactcctgcctgggcaaaaggagcgaaactccgtctcaaaaaaaaaaaaaagataattaccaggaaccaacggcaacattacaaaatgagaacttggtcaatccaccattaagacacagcaattcgaaacgtgcagacaccaaacaaacaaaaaaacaatgaatagaaccgaaaggagaaaaagacatttatacttttatagttggagacctcaaaatctctctctacagctgataaaattaggagacagaaaagctgccaggatatagaacgcaacatcaccatccatcaactagagccaatcaaaatttatagaacactccagccaataataacagaatacataatcttttcaagtatccacaaaacaaatactaagttagaacatatcctgaggcataaaacaaacctaacaaattttttgaaattaaaatcacacagcatatgttccctcaaacaatgggaacaaatctgaagtcaacaagagaacaattacaggaaaattgcctaactctcagaaactaaacaataaacttctacataacccatggatcaaagagaaagtctcaagggaaattttaaaatatattgtgaactgagagaaaatgcaagtacaatacatcaaaatgtatgggaaagagctacagtgggtgacgagagacaaatttacagcactaaatgaatggtacattagaaacttggaaacaaatcaataatataagtgcccacgttgacaacctaaacgaaaattaaaaatagcaaaatcaacccaaaagtaagcagaaaggaagaaataattaaggtaagagtagaaacaaagtgaaaacagaaaaacaataaacagtaaagcaaaaagctggttctttgaaaagatcaataaaactgacacacctctctaagcaagactgacaaaaaaaaaaaaaagacataaattacccaacattagtgatgaaacaagctctaaagatatgaaaaaagataattaggaattactaggaacaactctacacacataactttgacaacttgggcaaaatagacttattcctcaaataatgcaaattaccacaactcaccaaatataaaatagatcatttgaatagctctaccactatcaagaaaactgaattcataattcaaagaatcccaaaaaaaaaaagaaattaccagatccaaatgaactcactggataattccatcaaacattaaaaaagaattaacacagactcaaaacaatctcttctggaaactagaaaaggaaaaacttcccaattcatattaagaagctaatattagagccaatattagcattttaagaagctaatattagagccaatattagcattttaagaagctaatattagagctaatattagcattttaagaagctaatattaggtaccgtaactaaagacagtacaaactacagaacaatataccttaatatatatatagacacaaaaatattcagtgaattattagcaagtagaagtaaacaatatataaaaagaattccacatcatcgccaagtagtttcattccaggaatgcaaagctggttcaacagtcaaatatcaatgtaacccaccctattaatagactaaagaacaaaaatcacataattacatatcaattgatttagaaaaagcaaatgacaaaattcaatactcgtgaatgataaaaattctcagaaaatagcaacaaatgggaacttcatcatcttgataaacagcatttacaacaccttaagctaaaacctatgccaacaagaatgtcagaaagggtcctcccagacctatttatacagcagagagaatcattaagaatgatttagatagttactaagagtttactctcctaagagattacaacacccaatggccagcaagcccttttcattagacaaaaagaaaagctgtgatctgtcaacactctcagaaggttcactgtgaaatgtgcacttctgaactcctgctgagggcctacacgctgcaatgttgagaagcaagtgtccagaggtctccttggaaacattgcaaaaaaaatgtgagggactgatggatgaatagaaggatgaaaaggtggagagaacggtgataaagcacgtgggatgatgccagcggcacaatcttaggtggtgaatatgtgggtgcgcgctgtaaaattctttcaacttttctgtatatatttttttcataataaaatgttggaaaaaataaacctgtgaaaaaggaagctttagtcaaacatatctaagcaaaagaaaaaacaaattctaaattcctatggctcaaattaacgtgtttttctttttaggctgagatggaagagtaaaaaaacagaaaaagaaatgaaaggaataggagctattctaacagctacaaattccacctgcagtttgattaaagatggcgtggctcaagaatatgctttgaatccaagccccttcaaggctgccaggtacagagtcggttctgcaaaagctctgtacctgtgaacaagcagagcttccaaataaaccgattaaagctgccctgagtcaataagccgggctttaatctgagcaagaaaggtacatttttagtctagttacccacccataactgtaggtactttgatacctaggtgaggggaaacatggagaaaggcaaaataacagatttttaaaatcacaacaaatctttatcaaacatttgtgccaggcactgacttaagagcttcaaatgcattatttcatgtcatttgcacagcaactctctgagtaagtactttcacttattttatatataattttaattatttacattatattatacttattccttttttttgtttgttttttttgttttgagatggagtctcaccctgtcacccaggctacagtggtggtgcaatcttggctcactgcaagctccgcctcctgggttcatgccattctcctgcctgagcttcccgagtagctgggactacaggtgcccaccacc[131 bp omitted]ctctgcacctggccacttattcctattttatacatgagaggcccaaggtgagacaaagtgatttgtgtagagtcagagataaagccaaaattgatacccagacagactgaaaaacttctctgtcagaaaatctagaaatggtaaagggagatcttcaaactgaaggaacatgataacacaaggtagctgggacagaaacaaaaccttaagggcccataatggtaaaatgaaagttaacataaaaaacttttttttggccagccatggtggctctttgggaggccgaggtgggtggatcacctgaggtcaggagttcgaaaccagcctgaccaacatgacgaaaccatgtctctactcaaaaatacaaaattagccaggtgtggtggcgtatgcctgtaatcccagctactcgggaggctgagccagaatcgtttgaacccaggaggcagaggctgcagtgagccaagatcatgccattgcactccatcctggcagcctgggcaacaagaccaaaactccgcctcaaaaaaaaaaaaaaaaagaggccaggtgtggtggctcacacctataatcctataatcccagcacttaagggtggctgaggcacgtggatcacctaaggtcaggagttcgaggcgagcctggcaaacatagtgaaaccctgtctctactaaaaatacaaaaacgttagccaggcacggtggtgtgtgtctgtaatcccagctactagggaggctgaggcaggagactcgcttgaacctgggtggcggaggttgcagtgagctgagattgtgccattacactccagtctgggcaacaacagcaaaactccgtctcaaaaaaaaaaagacttttttttctcttttcaaatttgaggggaaaaaatgtaattgcctatttaaagcaaaaacaaaaacatcatattgtggggtttataccatgtttcacttggacatgacacagcaacactaccaaccaagaacatgtgagaagcaggaagctacagtcagagcactgccccgcggctcaggcagtgtaataccatttgagagtgggcagtgacaagtgaaagatgtaactgaaaacgccagagatgatagatttaaacccaagtagtctaaagattccaaataaaaaacagaggttgtcagggtgaataaagaagcaagacctaattaaatgatacctgaaagaaatctactttacacatacacaaagtttgaaagtgaaaaaagctaaacctggcaaacacaccacgcaaacaccaaatcagaagaaaggagagtagtcagaccaaggtgacttcacaacaaagaatgtcaccggagattaagggggtcaaatttatgaatatggcgtaaaaatcctaaaagtgcatgcaccttataacattctcaaatacatgaagcaaaacctgcagagctgaaagaaaataatccataattagcatgagagatttcaattctcctcagaagaaagaggaactaagcagtgaaattgctcttcatgcctccccagcacaatggagatactcctgggaaataaagccagtcactggggctgatctcccagaacactgagactggcttctctgtaaataaatgactggtatttgctaggagaagtgtccttatctatgaaatgtttttagcaagatgtggttagtttaggattgtgtttggtaaacatacctaaaatccatggacttatgggacatggctccctggaaaaggttccctaaggtgtataaactatctgactacaaaacgggaacactgcacatccttaatgctccttgtgcagtgagatgacgacacacctcagtgagaggaccacacgcctcagtgagaggtctcatctcgcaggccgggctcaaagaggatggacctgcgggggttgcacagactctcccacatctctccccactttgcctgagcacacaagtgaggatattacttgtatctttaaagttactaagtaatcagctacgggtaacatctctgagattcatgtcaaactaatgtggtaagccaaccttgtgtgttagttcaactcctctcctaacagtgactagaacaagcaggcagaaaactatttcaagtcaaggatacctgaacactatcaacttgatctcactaagctttacagagcagcaaaatacactttttttttttttttgagatgtagtcttgctttgtcacccagactaaagtgcaggggtgcaatcgagattacaggcacccaccaccacacccagctaatttttgtatgtttcgtagagacagggtttcactatgttggccaggctggtctcgaactcctgacctcaagtaatccacccacctcagcctcccaaagtgttgagattacaggcaggagccactgcacccagccacattcttattacatgtgcatgaaacattccacagaatgcaccatattctggggcttcagacaagcctcagcattgaaatcacagaatatgttctctgactacaactaatttagaaattgttaacaggagatatttgaaaatccccaaatatttggaaatgaaataacacatttccaaataataagtgagtaaaagaagaaattaaaagggaaattagaaaatattttcaactgaatgaagatgaaaatgaataaacatttccaaatttgtgaaatgtggctaaacaatgcttagagggaaatttatattatagtcttgaacacttgttagaaaagacaaaaaatctgaagtcaatgatctaagcctttaccttaagaaactagaagagacagaagaacaaatggaacccaaagccagcagaaaaaaggaaataataaagagtaaagcagaaatcaatgaaaaagaaaacaaacaaaatcaataaaaccaacaactggttctttgaaaaaactcaaactgatgacttctaggaagactgatcaaaatcgaaagagagaaaatacaaggcacatttcagcaaatttctggataacaggtagtatatgctggtacttactacatgcaaaataatagcatacgcactttgtctggcctactgtactgatcccataataacctatgaggtaggtactactactaaccccaaatacgaatttttttttaagagacagggtctcaccctgtcacccaggctggagtgtagaggcacaatcatagatcactgcagcttcaaactgatggcctcaagcaattctctcacctcagcgtcccaaagtgctgggattacaggcgtgagctaccatgcatggtgtcactaattatttttatatatgtacatttacatatgtatgtccatgccaggaaagaaaagcctgaatatccactctgaagggataatagtggctaactcttagaggaaaactgaaattggggtgggcagccaggtgaaatttctgcttttataatcgatacatttttataagaaaacatttatttgatgtatatttttaattggaacgaaaatgcatcagacattttaaaaaattcaattacacacaaaaaagtaagcaaagaataaatatatgggttttactgggttggagaaagggaagagattatgaaagtccatccatgataaggaactcctataacccaaaacaaaaaactcaattaaaaaatggaattagctgggtgtggtggtgcccgcctgtagtcccagctactcgggaggctgaggcaggagaatggcgtgaacccggaaggtggaggttgcagtaagccaagatcatgccactgtactccagcctgggtgacagaacaagactctgtctccaaaaaaaaaaaaaaaaaaaagaaagggcaaaagggccaggaacagtggctcatacctgtaatacagcactttaggaggccaaggtgggtggatcacctgaagtcaggagttcaagaccagcctggctaacatagtgaaacttcgtctctactaaaaatacaaaaaattagccaggcacggtggcggacacctgtaatcccagctactcgggaggatgaggcaggagaatcacttgaacctgggaggtggaggttgcaatgagccaagattgcaccactgcactccagcgtgggcaacaagagccaaactccatctccccaaaaaaaaaaaaaaacaaaaaacgggcaaaggatttgaatagacatttctccagtgaatgtatacaaatggccaataagcatgtaaaaagatgctcagcatgactaatcaacagggaaatataaatcaaaacaatgagatgctgtacctactcacacaaattaggatggctatcatcagaaaacaaaaagtgttggtgagggtgtggagaaattggaaccttagtatactgctgcaagaatgtaaaacaatgtagccactgtggaaaacagtttactgcttcctcaaaaagttacacatagtgccaggtgcgatggctcacatctgaaatctcagcaactcaggagtctgaggcaggaagatcccgtgaagccaggagtataagaccggcctgggcaacacagtgagattctgtctctaattagtcaagcgtgatggctgggcaacaatgtcaatatatttaatgccaatgaactgtacacataaaactggttaaaacggtaagttacatggtatgtatattttaccacaatatttaaattttttaattagtttttaaaaaattgttaccaaaaaaatactaagaatccattcaagttatttagaaagggagtgtcagatcaacctttccaaagtgccaaaattcgcaagatcacctggttgcttgccccatacccagctgtccagaattgacttggccctatatataggtgcaggagtttcttcttcatcttttttctctttgtcattcagatctttctttgtcccacttggttcgacactatcatctgcagaattaaaaattttttaatctgtcaccgcttttcagaatgtcataccgttagcctctgcaaatgtccctccccgaaaagttacaacacacatgattaactgaatgcttgacaacttaaaaataaaatacatcaatcatacctgtaacagatccagtataattttcataaagaaaccaatatattggccgggcgtggtggctcatgcctgtaatcccagcactttgggaagccatggcgggtggatcaggaggtcaggatatcgacaccatcctggctaacacggtgaaacctcgtctctactaaaaatacaaaaaattagctgagcatgatggcaggcgcctgtattcccagctactcgggaggctgaggcaggagaatggtgtgaacctgggaggcagagcttgcagtgtgctgagatcatgccactgcactccagcctgggtgacagagcgagactccatctcaaaaaaaaaaaaaaaagaaaccaatacaacaaattatttaaaggatgtcttccaaaatgatattccatctacttcctagtacatttcttaactgagaaacttaagtctttcatatttacctacttcaatttcacaccaattgcttttatccagtgagtcccagtgcttgtgtatccatgggaaaagggagggtgtagaacaagagtatgattcaaaaatcttttaactctttacaaggccctactccactgccaactgggaagcactgctatgcaggggcactgtcactgctggcataattcaagagcactgggacacaaaggaaaagctgagaaaaatcactttaggccactgacaatgtcaagtttcagtcaaaaacaactgtcataaaactccttacacagtaagcgaagagaagagagaactaaccttaaccttgaagtgtaaacacattccatcacagaaggctgtgactaaatgtctaacaacataattagaaaaatgtatctcaatcggggaaagacatgatatcccatccagattacaaataatgactatctaaaaatctcgaaggaaacagttcctctgtttataacacttctgacaccaaatgtatggacttttgcaccaagcaattctccagttctctgcgacacccagctttgtgtcccacagtgcaattcaattctgaaactaactacctagaattagcacagaccccacaggttaataacaagagagaaaaggtgaatgctgaaaaaaatatccaaagaactaatggctgaaaacttcctaggttcagcaaatgacataaacccaggcagactgaagaatctgcacaaagcccacacaagataaatccaaaggaagccatgacgaggcacatcataatcaactgctaaacactaaggacaaaaccttttgaaaagtgccacggaaagtagatacagaagaatttctcgtgtggcctgaaattaagactaaatattacgtgctgccttgacattggtaaaatcaagaaggcctcaaatagcctaaccacaaggtctcccctgagctctgctctcacggataagatcccaaagccaaacaacctccttatcgcggaaacccgaccccagcctgctcatccctgccggcccagagttattcaaacaagccagtcacatcttcccatggaagcaaggtcatctcaccctcctgttactacaaaatgtgcctcccacagcccctcgtggttcgctctgttcccaagtgcagcccccgtgtggcatgcggtgtcccccaccccagggctgtgagcatgcgtgactaataaactgctatttcatctgtccagtgtcggtgtcctacgttcagccatcccatatccctagggcaggaatcttctagggttataaacagaactttaatcaacctctccttggttattttactggttccatgatacagctttttctgtgcaaaagatctgaacagaaactcacagaggatacaagagtggcaaaaaagaacatgatattcagcattgttagccattacagaattgcaaattaaaaccacaatgagatcccactagacttgttagaatggctcaactaaaaatcactgataacaccaagtgctaacaaagacacagagcaacagaaacgtgacagattgtcagcgggaatgcaaactaaaacagcctccagtttaccaaggtagacacctcgagtcacagaatacagagtagaacccagccaggaacacggctcaggtgagaacacaggtgctggctctgaatgccagactctgccgtgtgtgtgtgtgtgtgtgtgtgtgtgtgtgtggtcactaaccacagcccacaggacaaacccagcccacagcctttttgtgtatggtctgaacacagagaaagtattttagttttgttgttcttttgagatggagtcttggctcaccacaacctctgcctcccaggctcaagcgattctcccaggttcaagtgattctcatgcctcaacctccgaggagctgggattacaggggtgcatcaccatgcccggctaattttttgttttcagtagagatggggtttcaccatgttggccaggctggtctcgaactcctgacctcaggtgatccgcctgcctcagcctccaaaagtgctgggattacaggtgtgagccaccacgcccagccaccgtattttatagtttttaataattgaaaaataatcaaaagaaaaacagtattttgtgacttgcaaacattctgtggacttcatcttttcgtgtccataaataaagtttacagaatgaacgtccccagcccgctgacgtagtattgtctgtggctactctggcactacagctgcaaggtcccatggctatgacagagaccatagggtccattgagagcttaaaatatttactatctggccctttacagaaagtaggccacccctaccctacatctggctataaattttacaaatttgacaaattctgagaccctgtctcagaaaataaaataaaatattcatagtcttaataatggaaaacaaaaacatttactgaatgccaaaacatctccctaacaatcccaatcagttgggatctacataaagaacaattatgctctgctttccaaccatgatttttaaaagaacaaaagacaaaaaaattcatcaaatgtgggctgggcatggtggctcacacctgtaaacccagcactttgggaggccgaggtgggttatgaggtcaggagttcaagaccagcctgaccaagatggtgaaactccgtctttactaaaaattcaacaattagctgggcatggtggagggcgcctgtaatcctagctgagtactcaggaggctgaggcagagaactgcttgaacccgagaggaaggggttgcagtgagccaaaatcatgccgctgcaccccagcctgagcgacagaacaagactccctctcgagaggaaaaaacaaaaaaaattcatcaaatgtaatgaataaaacatatactttggattttgccatgtacttagcttttcttagagcaccttttagaactattgtttcacagaaaacactttgggaaacgttttaatttataaacaaatactggagggctaggaagaagaggttaaaactttttaaaatatacagaatgaattactgatacagaaaaacaaaaaaaggttgctgattcctgtcttggaagacactgtcatatggacactcttagcctcagcatccagaggtccagaaagggaaaatttcaagtcagagagaattctatatataccacttacttggaacattcagccctcaaaatcccaacatcatgacctcagtttcaacacaattgtccttagtccttatgtcactgcttttggtgctgcctgctgtcaaggcagtggaagccagtgatgcaactgctctctcgttaaaaggtgtggttctcagtattacaggtgtttgtacttgcttgcgggtatacgcacgaaagataaaaatgaacagatgtgactttgaagggcctaatgaatgaaacctcaccctgaaaacctttgtgctactgaaactaaatgtaagctttggtgtctgaaagtttccaagaattagtaagtaggagagttttactttctgagttgattccatgaaatgggaacaaattggtacataaatggattttgcccagaatcctaggaaatcgccactgttcagtcgtaatcactgcctcctaaatcactgagtctgttctctgtatttttattagacttttgtcatctcccaaattcagatatccaatagtcagccaaaaagggaaacttttatctctggaaagaaaaaaaatcatttagaaaaatgtattcagtgtatctaatactgaaatggagaaaagacttaatgttaaagaaaaaaaaaacactatagacattgacatggaaaagagatttaatgttaataaaaactttatattaactgagtaacacctcctgatgagaagtgctatattaaatataaacccattatgttgtttaaaaaaaaaaaacatgaaaatcaaaagcactaaacagagtgaaagaagccaagacacagaagaacccgactacatgattccatgtatggagttctagaacaggcgcaatttgtcaatgctggagaaacatcaggccagctattgcctctgggaagaaggggcaggacaccagagaactttctgagcaagagtcatgataaagatgtgggttacacgggttacatttgtcaaaacttgtgaaatggtaaactcaaaatagatacatttcattatatataaattttacctgaaagtcaaaaacaaagttgaactagaatcaattacatacatgagtgtctaaggagctaggtgagacaaacggtggatggacagacagcaggatgtggagccaaatacggtggcagaacatggaggtgggtctgcagccactcactgtacacgtctgtcagttattgtgtgtgtgtgtgtgtgtgtgtgtgtgtgtgtgtgtgaatattttcaaacaaatataaaaaataaattaaaataaaaacacaggtaactctgcttgacactgaaactgaagagggagactaatactttttcccatggtttgttttgtgttttttgtttttttttttttgagatggagtctcactctgtcacccaggctggagtgcagtagcacaatatctgctcactgcaacctccacctcccggctccaagcaattctcctgccgtgccctcccaagtagctgggattacaggcgcccgccactatgcctggctaatttttgtattttttagtagagacggggtttcaccatgttggccaggctggtctcaaactcccaacctcaaatgatctgcccgcctcagcctcccaaagtgctggaattacaggcacgatccaccgcgcccggtccccaagtattttcaagtggacaccatcccaattcattccacaaaagaagaataaatacttgccaggcacggtggctcacgcctataatcccagcactttgggaggctgaggcgggcggatcacgaggtcaggagattgagaccatcctggctaacacggtgaaaccctgtctctactaaaaaatacaaaaaattagccgggcgtggtggtggacacctgtagtcccagctacttgggaggctgaggcaggagaatggcatgaacccaggaggtggagcttgcagtgagctgagatcgcgccactgcactccagcctcagcgacagagcaagactccttcccaaaaaaaaaaaaaaagaagaagaaatactttcttcagactaatgctctcccaactgagctatttcaacttagaataaatactttctaaagtggtagctttatccacgttgatgactctcaagcagggggaccaacgaacttcaacagtggttctcaaccaaggatcttttcagattcaacaagtttagggtgtatacaagcatccatttttttaaacctcaatggggactctgaaacacagccactgttatgaacaacctaatgatagtcctattgagcatgcaaaactacaacgctaaataagattgttcaatggcatttccttgcaggccaaaggcttccaataagtgtttaatacacccccaaagaacaccacaaatgcagcaagacggttttgcaataaaaatgccttcaattcacgtaaaacaataaaatccgggcagcttgtattaactaccattttagacaacaatctccaaagtaaaaagcaaaacttcaaagagttaagctcaaagctcctgttcctatagcacattacaaaatttctataaaatgcattttataatggtctttaccaaataaaaaacactagttaaaggcccttaccttttccaggagggagctatccgttctgggttgattctgttccagtgtatacaatttctccatctttaaccatttcattccacagaccacagagcccatctcttgtgaatgcaagctggcaatgataaacgagataagctcacactcacactgcaatttttaaagaatgatatgggaaaaaatctcaatcccccttatgtattcgatcattcggtaataaaatcaatgatttactgaattagtgacttaatcattttacatttcatgaaagtcatccaagaaatataaatgaaaaggtgcataatagtataaatactattctacctcttatgtaacatacaagaaaaatgacacgtggtcaggcgaggtggctcatgcttgtcatcccagcactttgggaggccgagcggggcacatcacgggggatcaggaatttgagaccagcctggccaacacggtgaaacgccgtcccaactaaaaatacaaaaaattagccaggcgtggtggcgggcgcctataatcccagctactcacgaagccgaggcaagagaattgcttgaacccaggaggcagaggttgcagtgagccaagatcgcgccacagcactcagcctgagttgataagagcgagactcggtgttaaaaaaaaaaaaaaagaaaaaaaagacacacacacaaacacacacacgtgcatatgctctgaaaagataaaccgaaagcaagtaccaatgactacctacggggaaatggggaggggacatggacaaaggcagcaggaccagaaaaagcaacaacattgtgagtatactttagatgtctttacttctgaaacatacatgactttcatcctcaaaaattaaaattaaatcataaaaaagcaaaacctacaactggcaacaagcaaattaacccatgcatatacaaagaaaagtatgtcaagggacttttgaactacatatcattaatagaatatactataatgaaaaataaaatatttatcggtattgataacactctcacaattttagaactacttcatgttgcacaataaagcagtgtaaatacaataaaacatgtttatgataaagtattaaatgttctcagaaattaaggttttaggccggccatggtggctcacacccgtaatcccagcatttggcaggccaaggcaggtaaatcacttgagatcaggagttcatgaccagcctggccaacatggtgaaaccccatctctactaaaaatatgaaaaattagccgggtgtgctggtgcatgcctgtaatcccagtcactcgggaggctgaagcagaagactagcatgaacccaggaggcagaggtttcagtgagccgagattatgtcactgtgctccagcctgggtaaacagaacgagactccatctcaaaaaaaaaaaaaaaaaaaaaaaaaaaaaaaaaaattaaggttttcagtggaaaagaggaaaaaaaatcaaagaaattttgaaaaacaacttaaattggaaatctatgaactttatttttgaatatatttgcttactctgttttttaaaggactagaatcaaaggcaatctgacagcggcacccagattttggtctcttagaaccatttcccgataaaagacgctagggctcttgggaaaataagtagattcaagggccagggcagacaaagatgagcctgtttcctcaaagaaaaagctgtttcctcaaacatggccaggtgcggtggctcacgcctataatcctagcattttgggaggctgaggcgggcagatcacttgaggtcaggagttcgagaccagcctagccaacatgccgaaaccccatcttttttaaaaatacaaaaattagctgggcatggtggcaggcgcccataatcccagctacttgggaggctgaggcaggagaatagcctgaacccaggaggcggaggttacagtgggccaagactgtgccactgcactccagcctgggtgacagagcaagactttttctcaaaaaaaaaaaaaaaaaaaaaaaaaaaaagcagctgttcaaagatgatagggactcctggccaaatttataataattataataactgtgagcatcaaaatcaaaaacgcctttgcttgtcaacatttgtgagtcagaaaaggcttcccagaacaggaaaagggagcatttcagacactgggggaaggcatccattctgaaaactgcgtatgtgacagaagctcccttgtctggcaaaacaaaagccatttttaattaaaagagacagatgtttgcccatcttttttttttttttaacttctgtggatacacactagttgtatgtatatatatatgggttatatattctatctaactcttttttttttttggagacggatctcgttctggcactaagctggagtgcagttgtgcgatctcagctcactgcaacctttgccttctgggttcaagggtttctcctgcctcagcctcccaagtagctgggactacaggctcacaccaccacacccagctaatttttgtatttttggtagagatggggtttcaccgtgttggccaggatggtctgggtctcttgacctcatgatccacctgacttggcctcccaaagagctgggattacaggcgtaagccactgtgcccagccctatctaactccatttttatacccattaaccatccgcacttcacccccactttatccttcccagtctctgataaccatcattctactctatctccatgagttcaattactttcatttgcttagcacctacaaataagtgagaacatgcaaagttcgattttctgggtctggctcatgacattctgttcctgacttaacataacgacctccagttctatccatgttgttgcaaacggcagtatcccattctttttcatggttgaatagtactccgttgagtatatataccacattttcttcatccattcatctgctgggaacacttaggttgcttccaaatcttggctattgagaatagtgctgcaataaacatgagagtgtacatatttcttcaacatactgatattctttcctctgggtatatacctaccagtgggattgctgaatcatatgatagtcctatttttagttttttgaggaacctccaagctaatctccataatggctgtgctaatttacattcccaccaacagtgcacaagggttcccttttctctatattcttgccagcatttgttcttgtcttttggatataagccattttaattagggtgagataatatctcattatagttttgatttgcatgtctctgatgaccaaccatgttgagcacctgttcgtactgcctgtttgtcatttgtatatcttcttttgagaaatgtctattcaaatcttttgcccattcttattggattattagatttttttcctatagagttgcttaagctaattatatattctggttattaatcctttgtcagatgggtagtttgcaaatattttctcccattctgtgggttgtctcttcattttgttgattgtttcctttgctgtgcagctttttaactcaatgtgatcccacttgtccattttagctttggttgcctgtgtttacgaagtattactcaagaaatcactacccagtgcaatgtcctggagagtctccccaatgttttcttttagcactttcatagtctgaagtcttaggtttaagtctttactccattttgatgtgattttcgtatatggtgagagatagtggtctagtttcatttttctgcatatgggtgccccattttcccagcaccatttatcaatgaggctatcctttccctcatgtatcctccgggcacctctgtcaaaggtgagttcactgtagatgtatagatctgtttctgggttctctattctgttccattggtctaggtgtctgtttttataccagtaccatgctgttttggtatacctttctagtaaactttgcacttgatctaagccaaaaaagaccaggaagtgactgtagtataattttaagtcaggtaatgcaatttctccagttttgttttttgctcaggatggctttggctattctgtctcttgtgattccatacaaatttcaggatttttttttctatttctgtgaagaatgtcattggtattttgatagggattacattgaacctgtagattgctttgggtagtacagacattttaacaatattgattcttccaatccatgaacacagagtatcttttccttttctgtgtgtcttcttcaattttctgcatcaatgttttacagttttcgtggtagagatcttttcacttcttgggttaggtttattcctacgtattttactttatttgtagctattataaatggaattatttttcttgatttatttttcatattgttca[132 bp omitted]gaaaccctgtctctactaaaaatacaaaaattagccaggcctggtggcaggcgcctgtaatcccagctactcaggcggctaacacaggcggatcgcttgaacccaggaggcagaggttgcagtgagccgagattgcgccattgctttccagcctgggccacagagtgagactccatctcaaaaaaaaaaaaaaaaaaaaaaaagagagagagaaatgctactgatttttgtatgttaatttagtatcctgcaattttactgaatttatcagttctaatcattttttggtggagtttttaggtttttccaaatacaacaatcatctgcaaacaagagtaacttggcatcttcatttccaatttggatgccctttatttcttcttcttttttttttttttctgagatggagtcttgctccatagcccaggctggaatacagcggcacaatctcagctcactgcaatctccacctctggggttcaagtgatttccctgcctcagcctcccgagtagctgggacaacagacacccgccaccacgcctagctaatttttatatttttagtagagatagggtatcaccatgttggccaggcttcaaactcctgacctcaagtgatccactcacctcagcctcccaaagtgctgggattacaggtgtgagccactgcacccggcctttctctctcttatctgactcctctagcaagggcttccattattatattgaataacagtggtgacagtgggcatccgtgtcttgttccagatcttagaggaaaggctttcagtttttcacctttcagtatgatactagctgtgtgtcagttgtatatggcttttattgcgttgaggtgtgttccttctataaccagttttttggggtttttatcatgaaaggatgttgaattttatcaaatgccttttcagcatgaatttaaatgatcatatggttttttatccttcattctattgatatgatgtatcaaactgattgatttggatatggtgaaccatcctggcatccctgggataaaccccactttggtcatgatgaacgatgtttctaatgtgttgttgaattcggtttgctggtattttgttgggtatttctgcatcaatgttcatctgggatactggcctgttttgtttttttgattatgtctttgtctggttttggtatcagggtaatattggccttctacaataagtttggaagtattccctcctcctctatttttcagaatagtttcactaggattggtaatagttcttctttaaatgtttggtaaaattcagcagtgaagtcactgggtcctggggtttttctttgctggaagactttttattattacagtttcaatctcattacctgttattggtatgttcaggttctggatttcttcatggttcaaacttggaaggctgtatgtgcctgtgaaattatccatttctttttccttctttttttgaagacacagtctcactctttcacccagggtggagtgcagtaacatgatctcagcacactgcaacctccccctcccagggctcaagtgactctcgtgcctcagccttccaagtggctggaattacaggcacgcaaaaccacacctggttaatttttgtatttttagtagagatggagtttcaccatgttggccagactggtctcaaactcctgacctcaagcgatccacccgcctcagcctcccaaggtgctgggattacaggtatgagccaccacgcccagcctgcaaacttatctatttcttccacgtttcccaatttattgacatatagctgttcatagtctctaatgaccctttgaatttctgcaatatcagttgtaatgcctactttttcacctctgatttgggtcttctttttctcttagcctgcctgaaagcttgtcaatttatcttttagaaaaaccaacttttcatttcattgatcttttgtattattttcttcatttcaactccattttatttctgctctaatttttattatttctgtccttaaaattatgggtttggttagctccttcatttctagttctttaagatgtatcattaggttatttatttgaagtttttctacttttttgattttcctcttagtattgctttcactatatcccacaggtttcgtatgctgtgctgccattgccatttgcttcaagaaattgtttaatttcattcttaatttcttcactgacctgttggtcattcaggagcatattgtttaattcccatgtgttggtggagtttccaaaattcctcgttattgatttttagttatagtccattgtgatcagagaagatacttaacataatttttttaacttttatatggcaaaagaggaatctagcttcattcttctgcatatgaatatcaagttttcccaacaccatttattgaagagattgtcttttccccagtgtttgttcttggtacctttgtcgaaaatgagttcaccgtagatgtgcggatttgtttctggattctctattctgttctgttggtctgtgtctgttttatgctagtactatgctgttttggttactatagctctgtagtataatttgaagtcaggtaatctgattcctccagtttgtttctttttaattacgagagcttcggctattctgggtcttttgtggttcaacatgaattttaggattttttttttttctgtttctgtgaagaatgtcattggtattttgctagggattgcactcaatcggtagattgctttgggtagtatggacattttaacaatattgattcttccaatccatgaagatgaaatatttttccatcttttgtgtcctctttaatgtctttcatcagggttttagagttttcattacagagatctttgtaattatcttctttggttacttcccaggtacttaatttcatgtgtggctactataaatgggattagttttctaatttttttcatattgtttactgttggcacacagaaatgctactgatttttgtatgttgatttcgtatactgcaactgtactgaatttatcagctctaatcattttcttgtggagtctttaggtttttccacatataagatcatatcatctgcaaacaaggataatttgacttcttcctttccaatgtggaggccttttatttctttctcttgtctgattgctctagcaagaacttccagtactatgttgaataacggtggccacactgagcatccttgtcatgttccagatcttagaggaaagactttcagtttttcaccattcagtatgatactagctgtgggtctgtcatatacggcttttattatgttgaggtatgtttcttccataatcagttttaagagattttatcatgaaaggatgttgaattttatcaaatgccttttcagcatcgactgaaataatcacatggtttttatccttctgttgacatgatgtgtcacatcgattgatttgcatatgttgaaccatccttgtaccccagggataaaccccacttcatcacaatgaacgatctttctaacgtattgctgaatttggtttgctagtattttgttgaggatatttgcatcaatattcatcagagacattggcctgtagtattctttctttgacgtgtctttgtctgcttttagtatcaaggtttcaatttttaatgacttattttgtggcctaacatatggtctaaccttgaggacgatccatgtgctaaagagaacaatgtaaattctgcagccatcagatgaaatgttctagaaatatctattaaatccatttggtctacagtgcagattaagtttgatgtttcttcgttaattttgtctggatgatctgatctgtccaatgctgaagtggagtgttgaagcctccatctattaatgtattaacgcctctctctctctttagctgtaatatttgttttatgtatctgggtgctctagtgttgagtgcatatatacatatatttataatagttatagcctcttgctgaattggcccctttatcattacataatgacttttttggtctccttttatagttttggtcttgaaatttatttggtctgatataaccgctatgctcttttgtgatttccatttgcctctccctttttccatccctctgcactgtcctgaagagatggtctccaatctgaagaagcaagcagccaatgaactgcctgtggggaggggcagcctccaagagcccagggtttcagtcccacaaccacaatggattcaattctaccaatgaggacctgagctccagatgacagcgtgccctagccaacaccttgactacagcctgtgacacctgaagtagaggatagaactaagctatggccagactcctgacccacagaaactgtgagagtgtaaatgcttgttgttacaagctgccaaatttgtgtttggtaacttgttctgtagcgacagaaaccaagccagcatccttcagtttttgtagaaggaacagctttccctcagcactgttattttttctgttcacatcactaacaggataactgccataaacatacttggaaccaaaacatatgacttttggtaaaaatatcagctggtgggggagaggtaaactccttcctaaaaagtgagccctggccagatagagtgactcacatctctaatcccagcaccttggaagactgaggcaagagaatcacttgtgcccaggagttcaaaaccaatctaagcaacatagcaagaccctgtctctacaaaaaaattgtaaaattggccagaaagctgggcatggtggctcacacctgtaatcccagcacttgggaggccacggcgggtgaattgtttgagctcaggagtacaagaccagcctgaacaacatggcaaaaccgcatttctaccaaaaatacaaaaaattagccagaggtggtggcgcgcctgtactcccagctacttgggaggctgaggtgggagaactgcttgagaccaggaggtagaggctgcagtgagttgagatcactccactgtactccagcctgggcaatagagcaagaccctgtcaaaaaaaatttttaatttaaatttaaaaaattaaaataatataaaaaataaaattaaaaagtgagccaaaaacattcagggcccctgaagtttaacgagtgaatggaaagctttgactcttctagtcttcagtcagaggagagcagtgaatacgtgcactggggttcagtccaaaccctaccacaatgcacatgataagaggctaacagtggtcagaactcacagctccatgtgggccgtgctccaggagtttcagactatctttaggcactcaagggaatacgacatttgacccgtgtcttaaagtgtttcagaaaacag[132 bp omitted]cgaaaacccatctctactaaaaatacaaaaaattagccagatgtggtggcaacgcacctatagtcccagctactcgggaggctgaggcaagggaattgcttgaacctgggaggcggacgttgcagtgagtggagatcgcaccactgcactccagcctgggtgacagagtgggactgcatctcaaaaaaaaaaaaaaaaaaaaaaaggctattaccaagtgtccaaaaaagaaaggatgacagcagaagtcaacacagggaagtacagtctttaagattatttcaggcagggcacggtggctcacatttgtaatcccagcagtttgggaggccaaggtgggcagactgcttgagcccaggagttcgagaccagccagagcaacatggtgaaacccggtctctacaaaaaatacaaaaattaaccaggcgtggtggtacgcacctgtagtcccactactcagggggctgaagtgggaggatcacctgagcccggggaggttaaggctgcagtgagccgtgacggtgccactgcattccagcctgggcaacagagtgagaccctgacttaaaaaacaaaaaaagaaactatttcaaatcacgtaagttaaatcaaatgtgaaagggaaaataagggagggaacagaagaggaatgagaattagttccgttttaaccactaagatttgcactaactactgaacataaacatggagctcctccccactccaccaaccctcagtaaatatagatccagatcttagcagagtgttcagggctagagactcaaatctgggagtagtcaacaaatggactgtaggtgatgtcctggagaagatgccaacacccaagcagagaggggagacccctgcccagccctgaaagcactctaagatcgccccagactggctgggctccacacatcagtgttctgcggtacagcctagattgagaaacattagtgttacagaggtaccatttaaaaaaaaaaagccaaaagatggaacatttaaagactaagccaaagaggaagcccagtttacatggaaacaagaataattaccaccacctttcgattattacctgggtagcactgggaaggaagaggataggccagaccttgtccttctgagtaacaaggaattcttttttggaaggtagacactggactcctggaaggacatgcactgtggaagcctcctaggaactgatgacccaaataaatggtaagcaccattcaaaaaactatttgggcaccttaaaggtggaacattactaaggcaataaagcaagcctcactggaggaggtctccagagagttagactctgaacaagcaaaagtgaagcccagaagagctctccagatcacaaacagtacaggatcctgactgaggaagcagcagcctgggaacaactggaagacagccgtggcactgagaagaatggagactacaggcagggcgtggtggcccacgccgtaatcccagagctttgggaggccaagacagaagaactgcttgaggccaagatttcaagatcagcctgggcaacatggtaagaccgtgtctctacagaaatgtaaaaattacccaagtgcatggcacgtgcctgtaatcccagctactcaggaggctacagcaggacggtcacctgcacccaggagtttgaggttacagtaagctctgatcacaccacagcattccaacctgggtgacagagaccctattcatttaaaaaaaaaaaaagaaagaaaaagaaaaaaatgaatgggactttccatttgtaaagtgagagtatttatttctacaactgtctccaattagctttttattagtagctgacttacctaaacgtgcccagtagcttttcaacttttgacttttttggttcagatcccagaagcttctaattaggttatttgggctaagaactcttttccaatcttttccaatctcacattcctatcttacacctctgaaatgacatggcaagtaaaggcactttcatcgtcaaaagaccccagcaaaagaggcagtaacaggctcactttttgtaagttactaaactgaagctcagaaggccaatgacttgaccaaaggccacacaacactgaggctgtgagaggcgggatttgggaagaggcccaactccaaggcttattcgcttcccaccaacaccataacatgcacccacacctgcagcacggcagccagggcaagccttcacgctcccatacataggc[133 bp omitted]ttcatgccattctcctgcctcagcctcccgagtagctgggactacaggcgcacgccaccacgcccggctaattttttgtgtatttttagtagagacagggtttcaccgtgttagcctggatggtctcgatctcctgaccttgtgatccacccgcctcggcctgggattacaggcgggagccaccgcacccagcccgttaaggcatttattaaagtgacttcagaactatagagtcaggcaataaaatccaaaactgaataatataacaaatgaatatctgattaatgtataggttagaaaatgtttctttttcatgtccttacaatttgacagaaaagtaatcttcaaatatttgcagatgagtaaaggtatacggctttttttcttaaacctacagaaaaatactaaacacctactgaacgtaggacaacatatgaaaaaatgttaagaacaggttcctagaacaattagaaaggtcagacaggaacattaagtacgtcgatttgaagacatcctagaagcagcaagggagtgaggtcttcctaaagtctaagacccacgagaggaagaaagaggcccagagaacctaagcacgcagggatgagactgagaagcaaaacggagcttctgagagactcccagggccctcatacaggagaaagaggcctggcagatcccatgctctgagctggaacctcaaagggccacacaccagaaatacaggtgagttagaagtagaccagccttcacggaaaaccagcccagtttcgcattctctcaatttccaaagggactgcagtgacctgggattgcctagaacatcctctctggaggaagatattgttacctagagcctcgatttattgctacaatattgcatatacaatatctgaaagtcaagcaaatataataatgacaaagatacaagaccacatcattgaaaaatgaaaaaaaaatagaagtcattagaacagactgagtagatcctgaaaacagaaacataaagacttctgtcatgaaagaagagcctgaggaatgaactgaagtgttgacactctgctcagcagatgtcagctcggggcaatggggtgagggaagtgggaaagcgagacaaggagatcaatgaagtaacgatatgcagtatatgacttcacagtcagctaagtgtgattttagcctactctgcctatgtaggagccattcttatttcctttaatttcctaaaaaaagaaaaatatatattaaaaaagagtgattttatatttttcaatggttgcaacataatcaaaagaatcatatgtcagccaagcacggtggctcacacctgtcatctcagactttgggaggccaaggcaggcggatcacgaggtaaggagttcacgaccagcctggccaacatgatgaaaccccatctctactaaaaatacaaaaaaaaaaattagtgaggcatgatggtacacgcctgtaatcccagctactccagagtctgaggcagaacaattgcttaaacccaggaggtggaggttgcagtgagccaagatcgcgccactgcactccagcctgggcaacagagcaagactccctctcagaaaaaaaaaaaaaaaaaatcatatgtcaacaaatgaaaattatatgacattcaaattctggtatccacgaagttttcctggaatatagccatacacatgtttggcagcttctcgcaggacaatggccaaggtgagctgttctaaaagagcacgtacggcccacataaacatttactatctggtgctttacagaaaaaatgtgctgacccctatgttagtgccacctcttctcaatgagctgcaaatacaaccaactgttcagccagcacattcactaggcatatgtggcttttccagaaggtttgcaagaagaaactacaccataaaatagtccaaagaggaaagaaaaaagggaggaataaaaacactgagttccctcatctctccttgtaaagtggtgaacgttcataccacaaggaattcacacccacacacactcgccacaccttccaggctgtgtcactggctccttggtaggcagtcaggaagccatactccaactctcttgcgtgacatcacagcggagactggagccgaagggcggctcacaggcatgagtcagccaagagggacagagagaggcggctaaggaatctatggggtcggacaaggtttataaacacacttttaaaataactacctttaatagagtcaagcaattaaaagatcctattaacagccgggcacggttcatgcttgtaatcccagcactttgggaggccaaggcaggcggatcacgaggtcacgagttcaagaccagcctggccaatctggtgaaaccccatctctattaaaaatacaaaaattagccaggtgtggtggcaggcacctgcagtcccagctactcgggaggctgaggcaggagaatcacttgaacccaggagatggaggttgcagtgagccgagattgtgccactgcactacagcctgagcgacagagcgagactccttgtcaaaaaaaaaaaaaaaaaaaaaaagatcacattaacaatttcaacacagaagttgaaactagaaaaaagtacctaaagtggcagttaaagaaactgtcaaacatttcaaactaaacattttaaagggatgtgtttaatataattatacctcaataaagttgatatgtttaaaaaatggaaattctggaatagaaaaatataatagtaaaatttaaaactcaatggatttgattaaaaacagattgggaaggcctgtgcttcctccacctataaaggatgaattctgtagaaatcacttccttgctataatcaactagaaaaccagacagaatataccgaaaagctgttaccaaaaactggacaacagacagcccagagctgggatccctgagagaagggaaacactgcccagaagcagcttccaggctgcagcacaggaaaggggaacccaaatagagcccaaagaacttgctgagctcaggagacagatcagctatacgtaggccaaatgacaagaatacagcaagctccagagatgagtggaggggccccttgagtatctgtctgagtactactctgagcataggttaagaaaactatggaatactggggaaagcagcactagaaagtaataagcagcactgccatgatgcacagtctgggaaaagcctgtgtttccacaaacaaggaaagaaagatcttctcatacaccaagcatcaggtggagtcctgagaacagtattgccttcgttgtatggataaatgagcccaagagtaaagcctgtgtggatcagcctaacaaacctcagaatcaagctttgaaaagatcaaactgaccccatgtaacttacatgtatggcagaagaaaactaaggctctttaaaaaaataaaacaaaatcctgcacagaagataaaattaatgcctagcattcaatcaaaaattagcaggcatacaaccatgcccccataactagggcaatcaatcaatagaaatgacagaatcaatcaacagagatggatctagaagtgatcagagattacagaattcacagacaaggacattaaaagctctcttacagaaatgctccctatactaatagaaggaaagcatgaatgttataaggagtgaaacagaagatataaaaaggactcaaatggaatctctagaaatgaaaatacaaaatggatggatgagattaacagaactgcataacagttacaaccataatctacaatgtctaagcacatggctatgccatgctctctcccttaacactcatgcagtctaggtttaacaaataactgtttcatgcccatcatcagttgcaggttgatctacagtcatccagttgtctaaagatctttctccactccattcctaaggaagggctcatgagaacaatacttcctaagttacagctcactgagaagtttgtgtgtttttcatctgaaaagtcggttttgctggaacaaaaaatgctttactcacattttcttttcttgagtgccttaaacaggatactcaatttcttcttcataaagaattgtcatctgctgggctcagtggctcactgctgtaatcccaccactctgggaggccaaggcaggtggactgcctgagctcaggagttcaagaccagcctgggcaacatggtgaaaccccatctctactaaaaatataaaaaattatctgggtgtggtggtgcacacttgtaattccagccacttaggaggctgaggcacgagaatggcttgaacctgggaggtggagg[135 bp omitted]caagtattgctagtcttttccaagaaccaaagttaaaagttagttctttaaaacaccaggccaggcacagtggctcacatatctaatcacagcactttgggaggccaaggcaggaggatcacttgaatgcagaagttctagaccagcctggacaacaaagcaagaccctgcctctacaaaaaacttttttttttgctgcaaaatgctcttaattaacctgacaaaatgccacatacagggttactgcatcttttttatcatggaattttgaaaacaaaaattgttctcttgaggcagcagtatttggatattagaggtaaaaaccacccttagaatccagtcctaaaaacatcaatgaatattcctatatttacaaattcttctatttctacatgtcatctatcaacaggattatgaacctgaaagcctgagaatagaatttatcaagatactcatgtttgtactttttttatctactgcccttttttattttttttgagacagattctcactctctcaccaggctgtagtgcagtggcgcgatctcagctcactacaacctccgccacctgggttcaagcgattctcctgcctcagcctcctaagtagctgggactacaggcacgtgccaccacacccagctaatttttgtatttttagtagagatggggtttcaccatgttggccaggatgatctcgatctcctgacctcagcctcccaaactgttaggattacaggctaagccaccacacccggccatctactgatatttctaagcatgaagtgacattttttttttttgagaaggagtcttgctgtgttggccaggctggagtgcaatggcatgatctcggctcactgcaacctccaccttctgggttcaagcagttctcctgcctcaacctcccaagtagctgggattacaagcgcacaccaccacacctggctcatttgtatttttagtagagacagggtttcaccatgggggccaggttggttttgaactcctgacctcaagtgatccgccctcctcggcctcccaaagtgctgtgattacaggcgtgagccaccgcgcccagccgaagtgacaatatttatatacaataagtttaactgtaaaagcttacatttatgcgtggtcatttttaattgatgattagatgaagagacaaataaatggtcccagtttagctactgatatactcaacaaaccttgacggacctgagggcattatgctgagtaaagaaaatcatttccgaaggtcacatatcacttggtaatctcacagtaacaaaattatagagatggagaacagatcagtggttggcaggagttagagatggtggcagaagagaggcaggagagagatctttctggtgatgaaacagttctgcataggaaattgtagtagtagttatatttacagacacttgatagaatggcacagaactacgcacacacattgtaccaacttcaatttctgggtttttatactctattatggttacataaaatgtaaccactggggcagtatgcgcaaatatacaatgacctctctagtttctttacaacttcctgagagtctattattatttcaaaataaaaagtttttttaaaaattgcttcatgcatatctagtttcatgtgccacttaaaaaagaacccaaaaatagaaactgtaggaaattcatctgagtgcagcttatgcaagaaggggcaggataactccattctggacctatgctcaaagacatgcacctttaccttacaacaaaactggcgaacaggcatgtgttttaagaataaaaagcttttaaggtctcatatattggtttttatgattcctttgcttaactgactttttggtttgctaaaaaactaccaatcacatcagattagaagtactttcacggtaaaaataaaaagtgatgtgactgacacctcttacctctgtaatgtattactcttcacgagagcagtgaaggaaaacatggtg[156 bp omitted]tctactaaaagtacacaaaattagccaggcgtggtggtggacacccgtagtcccagctactcgggaggctgaggcaggagaatggcatgaacccaggaggcttgcagtgagccaagatggcaccactgcactccagcctgggagacagagtgagactccgtctcaaaaaaaaaaaaaaaaagtgttgaacaattaaactgtttatatgtaataaccagatatatatgcctggcataaaatgagccctgcattagaggttgctggatgtagggtcctaggcctgacgtatccaaataatgtctatgataaagaagtcaataagtgctctctataacacacaagcattataagttttcacactccaaaaactcttcctttctaaagttactaaaacttttaagggcatttcgaacaaaaacagctgtggaaaacagatcggttaaatcctatggctaagaaacatcttcctatcccatgtattattcattacccaggtgtcaattctgtttccaatacaaaagtctcaagcagtgaagcgcttcccactccagctgggagagccatcctcaacaagataagggtaaaacctgtgagcacaaggcttccatctgcaattcctgtctgcagggaagctccccaaagagggaaaccatgtcttattccttacggtaaaacaccaccattcattccttgtgtttaacaaccaatgctggtggaacataaaacaaaacttagcaatcacttttttcatgctacttagacctgtaacacatttttcctctggtgcacactatccaaaacctagtcgtttcccttactcctaggaggaatttagatgactttttttttttggccaggtgcagtggctcacgcctgtaatcccagcaatttgggaggccgaggcaggcagatcgctttgaggtcaggagaccagccaggccaacacagtgaaaccccatctctactaaaaatacaaaaattagtcgggcatgcatggtggcacacacttgtaatcccagctactcggaaggctgaggtgggagaatcacttgcattcgggaggcggaagttgcagtgagccaagattgcgccactgcacgccagcctgggcgacagagcaagactgcgtctcaaaaaaaagactttctaatcatattggaaatgtgtaacaaggaccaagtactgtgtattaaacttaataaatcaaaacaacaggccctctaagatataaatggtgcttcactgtatgtttatctgcccaacccatcataggaactcaattcagcattaaactggttttagatcaagacactagaactcatgtttagcagttattaaattacaattattaagaaaaaaacttcattacgtaaagtcctttactccaaaaagtttctcaaaatacataaacactaatataaaaacaactattaaaactttgcctgaatctcaggatttcagaaatatgaaagtactcatctctcacgtctcccatccacttaaaatgacaaaacagatcattatagctaaatcaaaggaaatgtttaaagagaaacaaacccaaagagtaactacaccaattcttgacccaattctctgtactctgtcttatgtaacattacactatgaataacaatcccatcatccacaacagctttttttttttttttgaaaaaaaagctctcattgtccaggctggagtgcaacggcacaatcttgacccactgcaacctccacctcccgggttcaagcgattctcctgcctc[133 bp omitted]ctataggccataattactgcaacttacttctccaattttcccctccacagttaactcaacagctcaaaaacgatcagtaacaaacaacagtcaccatgatatggttaggagtgtggcagatttcttaaccagtaataataaataggaaaaaaattttctctattaatagatctcaagtttcgtgcacttgcaagaaactaattaaaaggcagccgcgcacgatctacaaaaacagccataagactgttacattttaagttacaggaaataaacctgctcctctaattcagcaagatacaactgacttccccttacataccctaaaaaaaagccttacacgagaaatttaaacatggaagcagaaacacaccaagaaaaagacatgtcaaaccccacctgtatatctgttttcaaccatttggagtcgaggcgagcctgggcagccaaacacaaagattcagagggcatcttttctccagcttcctcccaggtctcaggcctgcaagtaaacacatacgctgaagacctaatgctttttaatagtttacaaagacactcccgaaaggttcaatgcagaaaagaaaaaagagagagagaacagaaaggggggagagaagagctggtggaggggagagaaggggagagagggaaagagggaagagatggagagagagggaggtggggaagggaaagcctgcttccaaggtaggcagggtgtgccgagtttctgcaccacgctgacgagaccttgagaatggacggtcacaggaagccaagttacaatgtcatccccctgccctcaaatccaagaagtacacacacataacagggagcccatcgttttaacgacaaatgacagcagcatgaatctgccgctttaccccacagcagggcgcgtgcgtgaaacaaattactcaaaaggatcgcctgcagaaaaacccacagccaccaccacttaagagatggagagaggcccgaggctgccccgcgggtggtccgcgcaggccccggtgcggccgccgcgcccacgcccgcctcccgggctcggccgcccgccagccccgcgcccgtaccgcccccgccaccggccgcccaggtgccccaggccaggacctgacgcgcagggcccggccgcctcgccccgccggcgcgcggacgcagcctcccaagagccgctggctcagccggcgcccgcgatcccggcgcctctcgcggcccgaggggcgggccgacgcgggactgccgccccccgcgtacggccaatcgcaacgaggctgctccgtgggcgcagccaatggggaagaggagcccttcgccgctcctcccgactctcccgcttccagcaatcccgcttatcttcctacttggagcgccgtggctgcggccaaggccaacagcgggcgccggaaggctggatttccgccgcacgcacgcgctcccgcactcccacgggagactgcttggcccggagcgctcttgatcacgccgcggcgggaggtggcgctcacactaactatagctatccagggcgcgggtcgagtggcgagaccagctcccctgggtatgagaacgcatctttgtgcggtcggctggctggggcctgaagagcttcctcctgtgtgttcaactgaacgcagcaaaagtcttgggcagattccatggagcagctgtggaagcactgtgcagggaatcgaagaaggaaacacctccagcgaccacaaaacaaaattgaagaactataaaacaatataggccgggcgtggtggctcacgtatgtaattttcagcgctttgggaggccgaagcgggaggatccctcgaagccaggagttggaggatcccatgttgccagactgggcaacatagcaagaccccatctctaaaaaataaaaataaaaaaatttaacaattagccaggtgtggtggcacacacctgtgatcccagctgctcgggaggctgagacaggagaatcgcctgagcctgggagatcaatgctacagtgagcttagatcgtgccactgcactccagcctgggcgacagagtgagatcctgcctctaagaaagaaaaataacggccgggcgtggtggctcaggcctgtaatcccagcactttgggaggccagagcaggtggatcatttgaggtcaggagttcaaaaccagcctggccaacatgatgagaccccttctctactgaaaatacaaagattagccaggtgtggtggcacgtgactgtaatcccagctactcgggaggccgaggcaggagaatcgcttgaacccgggaggcggaggttgcagtgagccgacattgcaccactgcactccagcctgggggacagaggctgcaccactgcagccttgacttaccgggttcaggtggttctccacctcagccttgccactagctgggactgcaggcacatggaaccacacctggctaatttttgtagtttttgtagacgggattttgccatgttgcccaggctggtctcgaactcctgggctcaagtgatccgcccgcctcagtctcccaaagtgctaggattacaggtgtgagtcactgcactcggctaatagtaatgaactttgaacagaaggaaagttgttattattttcttggttatgttctatctatattttctaatttttctaaacatgtaaagataaaattctaaaaactcagacctcagaacaaaaaaattagagtataaatatttattttagttaacttgtacaaatttggtttctggaaaaagaatggaatagattttctgagaaaaaaaatccaccactttggccgggcgcagtggtttacgcgtgtaatgcctgcactttgggaggctgaggcggtggatcacctgaggtgaggagttcaagaccagcctgaccgacatgaagaaacccctgtctctactaaaaatacaaaaattagtcaggcctggtggcacgcacctgtaatcccagctactcaggaggctgaggctggagaatcgcttgaacccaggaggcagaggttgcagtgagctgagatcgcaccatagcgctccagcctgggtgacaaaaggaaaactctgtctcaaaaagaaagaaagaaaagcagactggctgaaaggattgaagaacaaaatatgatccaccaatgtgctatctacaagataaacattttaaatacagaaacagattgaaagtaaagggatacaaagatacaattaaaatagtaaccaaaaaagagctgaaggggctgtactaatatcaaatgtaatacactttaaattaaagcagggctgggcatggtagctcaggcctgcaatcccagcactttgggaggtggaggcagagagacacgtgagcccagaagttcgagatcagcctgagcaacatggcataatcccatctctacaaaaaatacaaaaattaggcgggcatggtggtacccacctgtggtcccagctatttgggaggctgaggtgggaggatcatgtgagctggggaagttgaggccgcagtgagctaagatcgggcccctgcactccaccctgggcaacagagcgagaccctgtctgaaaataaaaaaaaataaaaaacggggttgagagacaaaaaaggacatccttttttttattattgtattttgaaatggagtttcgctcgttgcccaggctggagtgcaatcgtgtgatcttggctcactgcaacctccgcctcccgggttcaagtgattgtcgtgcctcaggctcccgagtagctggcattacatgtgcctgccatcacgcccagctaatttttgtattttgatacagacggggtttcaccatgttggccagggtggtctccaactactgacctcaggtgatccacctgccttggcctcccaaaatgctgggactacagacatgagccaccgcgccagccgaaaccttcattttaaaaaaggctgggtcaggcatcatgcctcatgcctgtaatcccagcactttgagagggcaacgcaggcggatcacctgacgtcaggagttcgagaccagactgaccaacatggtgaaaccccgtctctaccaaaaatataaaaattagccgggtgtggtggcacacacctgtaatcccagctactcaggaggctgaggcaggagaattgcttgaatctgggaggtggaggatgcagtgagccgagattgtgctaccacactgcagccagggtgacagagtgagacgccatctcaaaaaataaataaaggctgggtgccagatgtggtgcataggcctagtttgttgactcctgtacttaacatataaaactctaaagaacagtgggaaggagcttccctctagaggcacaggagcggccaagttggtccctgagcagtgactttataataacatgttacactgtgttttttgtttttgttttgttttttgtttgtttgagacggagtttcgctcttgttgcccaggctggagtacaatggcgtgatctcagctcaaaacaacctctacctcccagattcaagcgattctcctgcctcagcctccaaagtaggtgggatttcagtcatgcaacaccatgcccggctaattttgtacttttagtagggatggggt[146 bp omitted]ttgcccaggctggagtgcagtagcacgatcttggttcactgtaacttctgcctcccaggttcaagcgattctcctgcctcagcctcccaagtagctgggattacaggcatgcaccaccacatctgactaatttttgtatttttagtagagatggggtt[132 bp omitted]atatgtgttatatttcacaataaactaaatattaaaacaaagaataactgatagctatgcacaaaggtatttaaatttcaccctcacaaataattttttttttttgagacaggatctcactctgttacccaggctggagtgcagtggcaccaccttggttcactgcagacttgacctcccaggcccaagcgatccttctacctcagcctcctgagtagctgggactacaggcacactccaccacacccacctaatttttgtatttttggtaaagatggggtttcaccatgttggccaggctggtctcgaacttctgggatcaaggaatcctccaaccttggctttccaaagtgctggtattacaggcgtgagccactgtacccggccaagaatagtttcttctccttacctaggtagagacctctgcagaaatgctgggagatctttggagaggggagattttttaaataaaaaatttaatacttggaggggcgtggtggcttacccctgtaatcccagcactttgggaggccaaggcggacagatcaggaagtcaggagattgagaccaccctggctaacacggtgaaaccccatctctactaaaaaaaatacaaaaaattagctgggcatcgtggcgggcgcctgtagtcccagctactcgggaggctgagtcaggagactggcgtgaacctgggaggcggagcttgcagtgagccgacatcgggccactgcactccagcctgggcgacacagcaagacttcgtctcaaaaaaaaaaaaaaaaaattaatgctttgggatgccaaggcaggtggatcacgaggtcaggagttcaagaactgcctggccaagatggtgaaaccccgtaaaaatacaaaaatttgccgggcttggtggcaggtgcctgtaatcccagctattcaggaggctgaggcaggagaattgcttgaacctgggtggcagaggttgcagggagccaagatagcaccactgcactccagcctgggcaataagagtcagactctgtctaaaaaaaaaaaaaaaaaaactgatctagttcaaaacctcactttgaatccacccacattgctctaaaatactttcatctttcctgtggctaaaaccttaaagccttgccagtaactcccattgcacttaaggaaatccaatctcccttgttgtggcccctgaacaggctgctgctggcccaccacggtgcctctagtttgtgtaaaatgcatatgttaatttataatatatgaggcttttttagctctaaaaggctattattcactagttgctgtgtgaatcagtatttctgggtgcagttagaaattattagagttgatgcccaagactcatctccatcagcacgggggaggcatctgctcgttttatggtcagtgactctgggcctcctgctgggctaagtcctgaggtgggtctgactcaggtcagagctgtgcaccccggccctcctccccaacgtgcatgagtgctctttaggatggagctgaacactggcttctcaaaaccacttggccccatcacaggccctgagaactgattgggtcactctggtgggctccccagccctagccaagaagggtttctctagggagcctggccccccacttatgagacctggagccccaaagatcctgaccaggggcctgcctcctccagggaggggccactcgcccccaccaagctcccttcacagagacccatccaacagagctgaggaaaaccatgcctcataaatgaataaatacataaataaggatgccggggacctgtggattttgtaattcctgaaagaaggcagagtggctggctcacagcaagcgcagtaggagatactgctccccggccaggctgttctctgtctctttggagggagccctagggtacaagaaaagccagaggagaccagctggcccagaaggtgcctctccaccccttccccagagtttctgggaaacaaagcccacccgagggacacatgccttcttgggagttgtaccaggcctccttcctcatccggccatgcagtggttttcagtgcccgaaacagatgaataaaataggccctttactggatgttcttcaggaacatgcacacttctttggatcttaccatcgttttatctctatttaaagttaaatgctgtgttatacagagtattggtaaagatgtagagctacaagaactgtcaagctggcagtagcataaaattgtataagcacattggaaacctgtttggcagcttctactaaagctatatctatgcctacgttcagaaattccatcctaagcatgtacacaagagaaacgagtgcatatgtccacaaaaagacttatataagaatgttcactgccatttttattcataagagccccaaatgaaaacaacctaaatgtccatcaacaggagagtgaataaatggtgatacagtcacatcatggaatactacacagccaaaaaagaaaaatgaagtggtaggaacactcaacgacatgggtgaatagagggagccaggtatgagagacagtgcacagtaccagcccacctagatgaagcgcaggaaggcagaactgacgatgattgaagtcagaagagtagtttcctttgtgggaaagtgtaggtcaggaaggagccttctggggtactacaaatctgccgtattttggctgggtgcaacagctcacaccagcacttcgggaggcataggcgagagggtcacttgagcccaggagttagagaccagcttgggcaacacagcgagatcccatctctacaaaaaaattaaaaattagcgtggcatgctggtgtgcacctgtagtctcagctactcaggaggctgaggcaggaggattgcttgagcttaagagtttgaggttgcagtgagctcccaaagtgctgggattacaggtgtgagacactataccagcctgatttttaaatactgaccaagccttgtgttactgggataggcatcacttggccacgatttactactctctttctttctttttttttttttttttgagacagaatctcactctgtcacccaggctggagtgcattggtgcaatctcagctctctgcaacctctgcctcctgggttcaagcaattctcctgcctcagcttcctgagtagctgggattagaggtgtgcaccaccacacctggctaattttgtttgtttgttgtttgtttttagtagagatggggtttcaccatgttggccagcctggtctccaactcctgacctcaagtgatccaccctccttggcatcccaatattcctatgattacaggcgtgagccactgcgcccggccctattctgtttctatattgctaaatttgacttgctaacacgtttttgaggatttttctgttgatgctcatcagggatgttggtttgcagttttctttctttgtattacactatctcgtctggctttctgtcaggggaaagctgaccttatacaaagtattggcatgtgttccctccttttccattttctctaagggattgtgtagaattagtgttatttcttctttaaatgtttttgaatccatctgaacctggagatttctttctaaaagattttacgccgggcacggtggctcgtgcctataatcccagcacgttgggaggccgaggcaggtggatcacctgaggtcaggagtttgagaccagcctggctaacatggtgaaaccccgtttctactaaaaatacaaaaaattagtcgagcttggtggcgtgcgcctgtaatcccagctactcaggaggctaaggcaggagaatcacttgaacctgggaggcagagattgcagagagctgagattgcaccaatgcactccagcctgggtgacagagtgagactccggctcaaaaaaaaaaaaaaatttttacaaattcaatttatttaacagatacagaactattcaggtaacctgtttgtttctaggaggattttcctggtttgtggcactcggacattgctttatttcatctaagttgtctgatttttaagtgtcaagttttccttagtgttctcttgctaaccgtctgaagtctgtggggcctgcagtgatgtcccttcattcattcctgatactgataatttgtatcttttctgtttttttctttgtcagttttcctagagtttttcaattttgttgatcttttcaaagaatgatctttaagtttcattaatttttcccttctttttttgctttcaatctcattagtttctgcttttatcttggcatttgttcctttggcttgttttgcgttcactttgctctttttctggtttcttaaggtggaaacttggattgctgatttagacctatcttttttgtaatatataatgatttgatgctataaattttcctctaagcagtactttaattaaccccacaaattttggtgcattttcatttatgttcaaaatattttctaatttcttttgagaattgttctttgacccatggatgatgatgatgatgatgattattattattatttttcttcaatacggagtttcactgttgttgcccaggctggagtgcaatgacatgatctcggctcactgcaacctctgtctcctgggttcaagcgattctcctgcctcagcctcctgattagctgggactacgggcacccgccaccatgcccggctaattgttttgtatttacagtagagatggggtttctccatgttggccaggctgatcttcaactcctggcctcaggtgatccccccaacttggcctcccacagtgttgggattacacgcgtgagccagtgcgcccggcctgacccatggattattaagtatgttgttttattttgaagtgtttgcagattgttttgttaatgatttctagtttaataccattgtgattggagaacaaactgcatatgatttcatttcttttaaatttgttaagatttatgtgtcaggttatgttctcagtgaacattctgtatgtgcttaaaaagtatatgtatggtctgtatatgtatggtctgtatatacatatatgtatacatatatgtgtaaaaagtatatgtatggtctgtatgtgcttaaaaagtatatgtatggtccagcactttgggaggccgaggcaggcagatcacaaggtcaggagatcgagaccatcctggctaacagggtgaaactcagtctctactaaaaatacaaaaaaaattacccgggcatgatggcgggcgcctgtagtcccagctacttgggaggctgaggcaggagactggcttgagcctgggaagcagagcttgcagtgaactgagatcatgcgactgcactccagcctgggcgacagagctagactccatctcaaa[139 bp omitted]ggtgaaaccccatctctactaaaaataaaaattaaaaaaataataataattagccaggcgtggtggtgagcacctgtagtcccagctactcaggaggctgaggtaggagaatggcgtg[144 bp omitted]gtttattgaaggtgttctacagttctcctagatttttgccgattacttgttctctcactatgaaagatattgtgtgtgttatatgtgtctaacaattcattgtctagttagagttgctattataccacttcaagtggatggagagcctcactgccatccattaatgtgcattaatcattttgagagtgaaaagattttttaaaatgtttttacttttttaggtatggccaagtgagatggggctagtgaaatgggtgggagaattggaagctgatagtgtgtgagctagacacccatgaatgcttttccactgggcagttagagggatgataggtaataatataaggcagctccatcacacaagctggtgactcctgtgcgacagaccaagaactgcatttggagattcatttccgattgttgcgtttcctcttagagcattgcttggtcatcgtgttctgagtggtccattggcctccatgtcccttttggggtggatatttgctcagtgacttttgagcagctggatctcctgcttcggcaggtgagtgaggggatggatggctccacggactggcccccgccccaggagaaagagtgcgtggccgtggcaacgctgaatcttccccgacttcaggtattcgtgatttcccttcctcttgctccttttataagtgtcttagcgatttgtaagaaggtttatgtattttgaaggacataggttttagcctgctgggggaagtattttaaagtaagattgtaatgcactaataatggacgcaaggcttaaaaaacttgatctgtttattttatgtttgtcctggaagtcagcctcggcatgcaggaagagtgtatatggattgtgttatttttgctataatcattagtttgttggtattcttactgttttactgttgttgcgtgtggagaaatgactgggtgagatcacaggtgatggagagagacagcgctcagctgagagaccagtgctggcctgtctctcctctgtcctgtgaaaaccctgctccaggagggtccagtcttttggtttccctgggccacactggaagaagaattgtcttgggctacacataaaatacacttatgatagctgatgagcttaaaaaaagaatcccaaaaatatctcatgatgttttaagaaattttactttgggccacattcaaagctgccctgggccacatgctgccctcgggccgtgggttgaacaagcttgatctactcagtaagcttggctcccaaagcaataccttcctttcctcaccatgaaggctgtggttagggtcaaaataaaagctacaaaagccttcctccctagcaaaactaaagctgaagtgtttgatcatcatcttttgtctttgtaataaaaccctctaacttaatgacaagaaccacggttttctcgacatagtaatttttcccttttattacagtggtttcttgtaacaacccgtcatgtccctcttccagcccctcccctttttgccctgcttctagaatgtacagaactgagtgtagtgtttagttgcagtaatgaactgagcagaggtctggagcatgcttctcctctagtcctctgtagcactcatttatcaccatatctgtggcatcctggcgtttgcgtggttgcgccccaggtgtttgctgcccctcctggtttgcggtgatgtgtctgttctggtcagtgctgtggggcgtggccttgtgtatgtcttaggctgtcgaggtgtcccagcgtatggttttgcatttgcctctccagggtcctgagggttctgtaggtttcacagactccaggtgagtttcggtggtcatttcctgacctgtgatatctatacctagatgagtggtgtgcttttgatttcacttctactcacagggcaaggccgggtctctgatttctcatggggcctcttgctacccaaagcctgggacgggcagtgtgttgccccctggctgcggttggctggcaggcaggtgatcctgagtggctcccagccttctgcaggaagctcgagttcagtgggtccttgtgtgcattcccgtgtgggaggttgtgctgaagcctggcggcttggctctgctttcagagcccggaacctcttgactcctgctgtgtgtgcccacgtgaattttggttttgcacttgaggagtttccctgtgtactctcagctccacagtctaatttttagcagctcttttttttttttagacagggtgtcactttgtcacccaggctggaatgcagtggtacggtcttggcctgccaggttcaagtgattctcctgcctcagcctcccaagtagctgggactacaggtgtgtaccatcacacccggctgatttttttatagagatggggtttcatcatgttggccaggctgatcttgaactcctgatctcaagtgagctttcccgtcggcctcccaaagtgctgggattacaggcatgagccaccgcctatggcagcttttgtggttacattgtagccattatttctgtgtttggtgcagattgttggggcggggtggaggttgctgttgctagttgtttagctcttctgctcatcttgagcttttccatatatgtgttcatagtggggttaaaaaaaattcctctagaaaatacttcaactattgtgggtaagagtttttttagtccagtttttaaaaatacgtaaactgagaagttattttgtctatttagatgatacttcaaattgacttttattcagtgtttaataagactttgaaattcactcatttttaggggttctaagtgaaaattgtttttctcctttcagttgcatgctgccattagtcaccaggttgacctggaattccttggtttaggtctgggcagcgtcttcctgaacagcctgaagcagaaggtggtgaccctggcaagcagcgcagacgtgctgagcaccgtgcagtcggcctcccaggccatgctgcagagcggctggtccatgctgttgcccaccgctgagaagcaggcccgggcactctgctctcctgtcctgcggaggtgggctcggggaaggaacaggagagggcatgggtcagggtgctgggaggggatggcgtttcactcaaattggcacacactttctatttcagtttcaggcaatgaagtgagcataagtccaggtcatcgattggtgattgatcttctggtgggcagcttgatggctgatggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttatgtgctaattttaaaaattattgagatgatttgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcgcagcaatataactgtatagtatgcactctttcctgctttgccttggagaatgattttcagattcactcactgttgtgtgtattgcgacttcgtttttattattgggaagttttccattttataggtgtagtactgtttgttagttcattctcctattgaaggacatgtaattgtttttggtttttgttttcttttttttttttttttttttgagacagggtcttgctctgtcacccaggctgtatacagtgacctgatgttggctcactgcagccttgtactcctaggttcaaatgatcctcccacctcagcctcctgtgttgcagggaccacatacatgtcaccatgcccggctagttttttgatttttttgtagagacaaggtttcactgtgttgcaaggctggtcttcaactcctgggctccagtgatccccccaccttggcctcccaaagtgttgggattacaagcgtgagccaccgcgcccaggctttctggtttttggccgtgtagagctgccacaattgtgctgtgaacaagtactttagtgaacatatgttctccctttggataaacacttggagtggaatttgttaggtcctggggttagtgtgtgttcatagtttcccaaagtggctttgccatttgcatttgaaccaggacttttgtgtgtgagaattctagctccttcttgtccttacagagcagctggatgctgtgtgtgtggagccgatcacattgggttttgtgtgagccattagcagggttaaggattttagggacttcacagaaggaggctggagagcatcagcagaggcagcctagaccttggatctgtaaaaagaagacactgtttgaaactgcacagatgagttggggtttccaacagggcaggtgggggcctgtgggtggatgggtgtggcagccacagaggctgggatagcttggcactggggtcagggctcagccagcctgtgtgccttcacacctggtaatgagatcacttgtaaacaatttctgtttgtcaattacaggatacaaaaaaagaagcacggaaggaaaaagaaatttatgaacaggaagcaaatgcctcaacatttcatagaaggaggactccattggataaagaccttattaatacggggatctgtgagtcttctggcaaacagtgtttgcctctggttcagctcatacaacagcttcttaggtaaatcatattagctgtattgtattgtgttttatttatttacttttttgttttttgagacagagtttcgctcttgttgcccaggcccgagtgcagtggtgcgatcttgactcactgcaacctccgcctcccaggttcaagtaattcctctgcctcagcctctcgagcagctgggattacaggcatgcgccaccatgccccactaattttgtaattttattagagacagggtttcttcatgttggtcaggccggtcttgaactcccaacctcaggtggtccatccactttggcctatcaaaatgttgggattacaggcattagccaccacgcctggcctatttatttacttattaatggtgttttttttttttttttttttttgagatggagtcttgctctatcgtccaggctggagtgcagtgtcacgatcttggctcactgcaacccccgcctcctgggttcaagctattctcctgcctcagcctcccgagtagctgggactacaggcgtctgcaaccacacctggctgatttttgtatttttagtagagatggggttttaccatattggtcaggctggtctcaaattcctgacgtcaggtgacccacctgccttggcctctcaaaatgttgggattacaggtgttagccactgtgcctggcctgtattgtattttaataggtgattattggttttcatattaagatagtgaaatctagcgcaaggatctcaaaaatttgtttgatgattgaaggaatattctgaaaattacctagtatagatgttaggataaagagcagacccttttcaatataggtgagaggagaagttggagggtgtgatgatactcaaaagtttttcactgaagagaaattggggcgtgcagtaaacatgtaaaaagattcttactaataagcaggtggatgcaaatgaaaatcatcatggaaggttatttttaaaactgattgtatcattgcctcactttatatattacagagttatacatactactttgtaagataacttttcttttcaaaactgaagtcaatgtgatagaatggtgagcattattttggaaggccagactaggaggaggtgggaggaagaagtcagactcagcctgtgaacagacgctaaccttggcagaagccaaaacagtcagacagtgttgtgtaaaaatgatcattcaagaagagcgaaacagcaaggtgatttgtgaaagagatttattagaaaatgaaacacatttatacctctgttcaataaaaatctgcttttcgtcaactgatgctcctggtttttgtttctacacatagagaaagcagagccctggcagctggggtcaggcagccgagtacagaccagggagccctgggcagtggctgcagctctcagctggcctgttcatggggccatggtgggtctgtggcgtggggtgggcctgtggcgtggggtgggcctgcggcgtggggtgggcccgcggcatggggtgggcctgctgtccacagccagaaaaactaacttagtgcacacacagtgaaattttgaaacaggaagttttagagctagtttctgtcatagattttagtaaatgctactttgcaaaacctttttctgatgtttgttttgtttttctaatctgataatgcatatttcacacattctggtctttaacaaatggaaataaagagaactaaacaatatagtttgtgtcgatggaaagagcttgggatttgttctcagaaaatttcagttacaacagtttgttcatataggtggacttccaacacagtaactataggagtaagaataaaagctgtgtttactttcacagagttaattaagaatacatgagaaaatggatgttaaaaaccttgtaattaaaatgtacagttacatgcaaagttttaaagtgagcattttccagaggtgcttttctaagttcttgaatgcctctcccttttctgaagtggctgcttcgtggggctgttggtctttggcagggggtgagtgcagggttcctgttgtgggtcctttgttctcacgagggcagtgcccgttttccccgtctcctgcttgcccagactgttcccgtgcgcagagagactggcctgtttgacctgcagctgtgctgtttgagctgcagctgtgtagcctgcgctggcccatctggctacactcaacaccgtttgctgatcagcacttgaagtctgtccgtcatagctgagacactgaatattttatctgtttaatttttattcattaaaatgcaggtttgaaaatttgattctgttattagaaagcacttaagtatgtttagaatcacttggccttgggagtctactttgtcaactgtgtattttatgagtctaaatggagatcagatgttttcaatgcaaatttcacggtccaaattgaaatgtgttacatatgtaagctactcagatggtttttgaggacttaatatgaaataacctatgtaaaatatctcaataatttttcttagattgatttcatgttgaaatggtcatatttttgatctgttggaataactatgatacattattaaaattatttttattttttaagatggaatcttactctgttgaccagaccggagtgcagtggtgcaatcttggctcactgcaacctccgcctcttgtgttcaagtgattctcctgcctcagcctcctgagcagctgggactacaggactacagactcccgagcagctgggactaccaccacgcctggctgatttttgtatttttgtagagacagagtttcaccatgttggccaggctggtctcgaactcctgacctcaagtaatctgcccgctttggcttcccagagtgctgggattacaggcatgagccactgcaaccagccattattacaattaattttatgtgttgttgtttttcttgttggtgtgttttttttttttttttttacttttgttaatgtgactaagaacaattttttttccccacccggagatggatcctcactctgttgcctggactggagtgcagtagcacgatctcagctcactgcagcctctgcctcctgggttcaaatgattctcctgcctcaacctcctgagtggctgggactaacagaagcatgccaccatacctggctaatttttgtatttttagtagagatggggtttcaccatgttggccaggatggt[133 bp omitted]tggtgtcctgggcaggtggctctgtgctgtctacacaggttgtctcctgtgtcttcgtcttcgctgcgtgtgactttttggttcctgtggcacgtggggtcctgtatgggacattggttctacagcagatttatagtaaggatgtacctactaaaaaatacaaaataaaaagaatagacacaaacatagaaataagtatcacctcacaaaacttttggaaagtagaaaaagaaaaatgcattcgcagctttccagtagccgatatccaggctgtcttcataagcatggatcatgtttccctctcctgcatgggtagacactgttttctcaccttaagtgtttgtgagtgaaggattcttgatgtgttgacttggcagatgcagttgttgaacagtagtttatctaaagatcgtaagagacttttggagacatttcatgtccttttttcccttggaaaacgtgggttggagaaatcgctgcttgccaaaaataagccgtgaaacgtatttcagagtagatcgttatttacatgctggcgaggagccacagaataccatttacatttgaaaatagagtgctgcgaagtttttataagtagtgaatcccatcagaattacacattttgattatggctctaaattttatattaaataaactaaaaatttcattgtattgtattaccgtctcttgctccttcaggtgtagcatacatgttagattctagacctgtttcttgtgttacagtggtgttatccaggcagggtatcatgtagtgaaggtgatgtctagtggtggtggtgagcccagtgaaggcgcatccttgccgtgtgtgatgagggcctgtgggttgctatgggattccccaaccctggctcctctgtctcctgcttctgtccttactcacactgctggtagttttctggtgtgagccacgggggcaagtgggattgacaagcctgctgtcacattaggaacctgagttaaagtggagctgaaagcatgtcctcactcttgatgttgtgcagagagccacctgtgctcctggctcaacggggcgtgtgtggtgggtctggaaccaggccctggtttggctctcctcccctccatgttcccctgtcctgtctgatttgcttcacactgacataagagttactttccctcggcctcccaaagtgctggtattacaggcattagccaccgcgcccagctagcatcctttcaagtactggggtacacccaagctcccagcttctagctaggagtcattttgtccctctttatcccaaaggacttgccaccatctttggttcccaaagcccaggagggtccaggctcttcagcctccaaccactttgcatttcttgtctgcttttcgttcatggagataattaacttatttttcagcctgggcatgtcttttttatttactttattttttatttttattttttgagatggagtctcactctgtcgcccaggctggaatgcagtggcgggatctcatttcactgcagcctctgcctcccgggttcaagtgattctcctgcctcagcctcctgagtagctgggactacaggtgtgcaccactatgcccagctaatttttacatttttagtagagacagggtgtcgccatattggccaggctggtctcgaactcctggcttcaagtgatcctcctgcctcagcctcccagagtgctgggattacaggcacgaccaccgcacccagcctttatttactttgtatatctcatctattactgctgcagtttgcagaagagaggatgccctcaaacctaacttctccaaaccatcccaaatgggaagtctgctccacgtcaacagcattgttgcttttaaagactatacgtcaacatggcagattatagcaaaaggatgtcgagggagcaataggaaagcaagcctgagagtcctggagagaaggtggcagagctgccttttgaaggtggttccttcctcagaccctgcccttcctgccttgttcctccagttgccagatttgctgttggagctcctccacgggcgaagaggtgaggctggactgagagggagatggagaagctgccagagattcttttggatctagaattgagacagcagttccagccaggtccagaggtgggggctgtcacccagcccccaggggaatggtactgattgcagaatgtggcgagaactccctggctgggagagggaggtgcttgctcccttgaatcacctgagcccaggctggaaggcccaagggggaggacgaggccagctcactccagctccatcccctccctttaaccctaagctagttaaccctcccagactccagtcctttttcctaagtgccctccctgcaaagtctgcaccgagcagcgctccctcgcaccagctcaccctgcactgtcttgtctttcagcaaccccatgggtttgaacttgagacgattcatgttcctaaaagcctctttgggctgagggaaggcatgggtggctctgccagttttggagtgggggccgactcttctcagagccgctgcaagggccagggccaccctcccaggcgggtgtctccgggctgggcagcagctttgtaggcagcctgggtcatccccactggtctgggaagctgggggtgcaccggctcctgctcctgatagggccaaggcaccttccttacctaagagctgactttcttgaagagtgggcacagaggagccggcaacctgggctgtgtaggcacccaggagaaaatctgcagctcagtatcagaagtctccaccagcacggctgttgcagagatggggaaactgggctgagagggaagggggcttgcccaaatcaccagccctggaatgtttggagctttgggggtggatctcccaggaaacgtgtttttatggcaccaccgcctctggtcacccaccccgaggtgtggcgggcctggacagccagcttgactgagggccaggctggtgaagtcaaaactaccactcaggaagaagacctagcccttctccagacagagttcaaatgtgaggactgccttctttgggcctcaaattccccacgtgaattccaaggacccctctagctcctacactctgggccaaggtttcctctgagccgcagtcagcctagaggacctaggatacatcttccttggacagagacccaccataggggcagcaggaggtaggggtgggggtaggcaagattcctgtggggaggtggagctgtcatcagagatggtgtctgcaggcagtgggtgtatcgtggctctgctactacttgctgggtggccccatgacgtttctttccccactctgacctcagtttccctatctgttctgtggagataagatgcctgcctacatatttgtggactgggatgtgtgtgggccagttgcagtgtttcttggtgtggtcctggggcaggctgcaccaccccatagagatttctgggccccaccctaggctcacaggaccagaatctctgggaatgaagcctgggaatttgcatttccacaggcatctggctgattctgacatgactgaaaagcactaatagtatatagcaagttctttataaaaggtaaattcatagctgccttttactaaacataaatctcaccttcccttcctcagttaaggacacacaccgcagttgaaaatcactgtgcctttccagatgcagaatctgacctttccgataagattctgttaactgctgctttctgcagtttgtattccaaaacaaggggaatatgtttccattttttcaatacaaatgtttaagtcggatatgctttctcaaactggacacgcactcacacagcttagggtttcagctatggcttcctctcaaattattagcctctttctgccagggagcagtttttcccagacaagaccctggacagaggttggtggggccctcctcatcagaatcactagattatgactgacccctagaggtggcttttctgcttaagtgtcagcccatgggctgggttgtgacccccaaagctgcggcagaagcttccacccatcctgggccccccctgccatctatggggaaaggcctgtcccttgtcttctgggcccagccggcctcacaggcattcagcagattggaaagtcgaagcatgtgctgtgcttggctgggctctcctgcgcccctttttggggtgaggtggagtgcatccagcccccagcatccctgccgtttattcccacccctcatccccacccccatacacactcacaagtacaaacacaagcacagtcactggcacacaccactctggacagcaccatttccagcctcagcggggcagtttccttacagggaagttaatgaggcactaacgaaggctcaggggacagggggaacctctatcgagaagaggctcctagacctggttctgcctctgaattgctgggggtccttgagaaagttgctatccctctctggtctcagtttcctcaggtgagaaatggggggccggccaaatggtctaaggttctgggaacctctaaatcagagcccgtagctggtggtcaagatgagggagaggccctcagggtcagccgaatgcctgagaggccggacaggcccaaaggtgagcaacgtgagcacatcaggtgggctcagagctggcgcatgagccccacagcctgcagagcagccctgtactcgggagcccgctcgcaccaacccagtgggacttcagagatgtggggtccagcctttcctactattgctgggctgagggctgggagctgcagattctgaccccacagctgccttagacatgccagatggtctggggcaagacacacccctctctatgaaatgagcagccagtccaaataggtacgttagagaagggctgtgggatggacccagctgtagcctggggctacagactggcttccggggtactcaagcagctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggcggctgctccccacagccaggagtccggcccagcacccacctgagtccgcctcagtcctgctcaattgggttatccgtgctcttggccctctggtcccacccacagagggaggtctttggggcgaccaggtgagctggcccttgtgggaggatgtaactgactcctgagcctggcgagccaggcagcccctcgccaacgtccccacccctacctctccagcccccccgcattccctgatcctcccatccgctcccctgacccagcagttgcctctgctcactctcttttcctgctcccaggctcgcctggtcatgtgtccttcactctcctctgagtctccctctttccaagccgcctccactctacttgacacactctcccttaagacaccagagtacacaagcgcaagtctctgcacctcacctttactcccagacatgggagggagatgacatgaagacccaaacgccacttagcaggagatctggggtatgcagaggggcagaacggaggctgtggaagctccaggggctccctgcaggaggccacatgtaagctggctattgaatgtggctctgagctgagacctctccttgaagctccagaccaggagccagctgctagctggacccctccatttggtgcctcagagaaactttgcactctctaggtctaactttgaacccagaaaattcccccatgtcggccctgtctcttcatagggaaagcaccacctcagacccagttctgcaccaaacccacatttgagtcacgaggctcctgccctgcactgtgagcactctggataagccagtgctgagggggaaagagctctgaatgccaagccaaaacatgagcttcaactccacctccagctctgagagctgtgggtagggaagggccctcgtccagtttgctgtagaaagatcagtctgccactgtatggcacatggatggcaggggcagagtgcaggtggagagaacagaaggtgggcagggcgggggaggcagggacatggctgtagccgtggagatgggaggacagacaggacttggtggccacttgggtgaaccaagggaggagtcaggaagagacacccagttttgtatcagatgtgtagagcgtgggatgctgttcattgacggagggaggaggaggaggaagaggtatggcatggggaggaggtagctgagctctgtcgtgaatgtcatttgaagtccccagggaaagccaggccggccagcaccttcactgcttcagccagctctcagggtgtctgtgctccctggccctctcagctcctgcttcatagctgtcatctgcagtgggagacagctgcacaagggcccagcatgtctgtgtgtttacccaggggactgccgcatggcccatgccgagcagaaactgatggacgaccttctgaacaaaacctgttacaacaacctgatccgcccagccaccagctcctcacagctcatctccatccagacggcgctctccctggcccagtgcatcagcgtggtaggtgcagagggtacctgtggctcaggctcaggtgaagaggcagctcatgcccaagccctaagcagtcaatgtccagaggaatgaaatgactagagttgacttagactcaccggtacacggtggggaggctggaggagggtccatgaggtttataggtgtccagtatttaatgaggccatggttttgttaacaaagaagaaatgagggtgggagcgagatcaccactggctaggagactcagctgagtctccagcacgaccatgagcttctcatcctgatcctcccagccccaccctacttttctcccccagcttgctcaacaggtgaccttacaggctccctactctttgcagggaataagaaccagactgggggaactgacgggtacagaggcccaggtgtaggcgcaggaccacaggcagtgaagcgtctactgacccaggcgggtgagggtctggagagtgggcatggctgctgcaggcatggaaagcaggcacagatggcggcactcccagggcccattgtcagggtctccacatgtggacgtgtgcagaggtgggggtgctgagggaggaggggcagggaatttctcatcttctctctactgcctctgagttggagatgtcagagggagccatggcccactgtaaagtaacacaatgtccccacccacaggattagaacccctcccctggaagcagctctgaggggaacagtcacatgtagagagtgcagggcactgtgtccagccgggggaaggaggtcaccaagggggttgacccccctctggccaggtggctgccttctgacacaccagcctctgtctctagcacggtggcccccacacacccagcctgtgaaacctacagccctcaagaagactttggccaaattaatgagcggctccctctcccaggaggaagcacaggtgaaggatgtggagggcagtagagttgtgtgtgctccgccccctttctccgcagtcggatggaaagaagggggctttcagccaggctcgcccaggctggggtctgagtgtcactgtccagctattggcttcttgcttaatgggtgagcccagctgctcccgtgcagctgccgccctagtgagggtgaaccggcaggcgagttacatttctgaaagcctgggaatacagtaaatattaggctgtgggctgctgggccaggaagagttgtttatttttcagggtttgtttatctattgacttgatgagggagggttataggtacaaccagtttaaagatggaaattttgagagagcaggcagggatttagtgctgggtaagcctggtcaaagtggctcttttggggcggccagaatccagtaccaatgtcctcagcatgttcatcagctggctgggggagtgcgggacagcatgaaagcacaggagaactttctggatgatagaaatactctgtatcttcaaaggaggtgggttccatagtaatgttaaatgagttaaaactcatcaaaatgtaaaccagacctgtgcatttcactaatagaaattatacctccaattaaaaacatgttttaaaagacagatgggccggatgcagtggctcatacttgtaatcccagcactttgggaggctgaggcaggtagatcacctgagtcaggagctcgagaccagcctggaaaacatggtgaaatcctgcctctattaaaggtataaaaaaaaattagccaggcatggtggcacacgctactcgggaagctgaggcaggagaattgcttgaacccaggaggcagaggttacagtgagcagagatcgtgccattgcactagagcctgggcaacagcgcaagactccatctcaacaacaacaaaaaaaggacagatgaaggttttcaactttcaataaaggcagaggagcttgttacagattcgcctccccacaagagcagttagaaaaactggataaaaatgtgccccgcccccaatcaaaaacaattgttggaaggtaattggagacctcagtcaggacttgagtgaccaggcctaggaggtgatcctgacagtctgtagtgctttcccacatttggtgattggtcaacagtagagggctaagaggctaagaaactgagtatgaagtggtagttaagaggctggagagcctagctgaatgtttggcactctcacagggctgaaatgacctaatgagaatttgggtcccaggaaggagatgggaccttggtggggaccctggaagggccacccctgggagtccagatgaataaaacatagaccagccatcagaaaacctaaaacctgctttgaaccagcttagtcccaaagtagatgaaggcgatctgcccttactccaattgtgtgccataaactcaaagtcaatactctctggaggcagataaaagtttactatgaatgtcaaaagacaacacaagactaaatgagaaagaccaagaagaaaactaatagaaacatacatgtaaggaagaaacttttttttttgagacggagtttcgctctgtcacccaggcttgagtgcagtggcacgatctcagctcactgcaacctctgcctcccaggttcaagcgattctcctgcctcagcctcccaagtagctgggattacaggcatgcgccaccatgcccggctaatttttgtattggccaggctggtcttgaactcttgacctcaggtcatccatttacctcggcctcccaaattgctaggattacaggcgtgagctaccatgcctggccagtattttgccacaatttaaaataaataaaatttttttttcaggtttgtgctcagactatattctaaacagtcacatggcggcttactcttctccaggccttgctgccggcttttacatgtttattgtctttgccttcttgtcatgtgctcattagatggcagcttccaggtgctcctaaggggccaggaaagagagtgagaaggcacggaggttgccagatcatcccccttggggccccgccctcatcaactccctcaaccgggtctcctgcaactattggtgggccatctcggccaccgcttcgccctgagcttcctgctgctgcagctgggcagtgcctccttctcagaggccagctgctgataggcggccacgtactgctgcaggtgacccaggtaatggtctcgctgctgctgcagactcagcctcttggctcttcagctccacctgcaggataggcgtcagggtaggtagtggctggcttccagattctgggcccataaacagggtagtgagggcactgcggggctctgtcgcctacccaggcccctggccctggccccttcctccaggcctaaatgactgcctcccttgcctagaggcccatgcctccctccccagcctcaaatctcacacccttcttcccaccatttaaactgtaggccacagactggtggaaaagcagagggagccaaccaccatctgctaagttgtggtgaggtcgttctgtatgatctccagggtttgcacacacctccgcctgctccccccaagagctcggccttctgccccagcttccccagcctctcctccagctcctgcagcctcacctagtgttcctgcatcttctcctcctgctgccgcagcctcacttcctgctcccacatcttctcctcctgcctccgcatcttctcctcctgttcttgcatcttctcttcctgctcacacatcttctcctcctgctcccacatcttctcttcctgttcctgcatcatctcctcctgctctcgtatcttctcctcctgctcccgtatcttcttctcctgctcccttatcttctcctcctgcctccgcatcttctcctcctgttcttgcatcttctcttcctgctcccccatcttctcttcctgttcctgcatcatctcctcctgctctcgtatcttctcctcctgctcccgtatcttcttctcctgctcccttatcttctcctcctgcctccgcatcttctcctcctgttcttgcatcttctcttcctgctcccaaatcttctcctcctgctcccccatcttctcttcctgttcctgcatcatctcctcctgctctcgtatcttctcctcctgctcccatatcttctcctcctgctctcgtatcttctccttctgctcccgtatcttctcctcctgctcccttatcttctcctcctgcctccgcatcttctcctgttcttgcatcttctcttcctgctcccccatcttctcttcctgttcctgcatcatctcctcctgctctcgtatcttctcctcctgctcccgtatcttctcctcctgctcccgtatcttctcctcctgctcccttatcttctcctcctgcttccacatcttctcctcctgctcctgcctcttttcctcctgctcccgtatcttctcctcctgcctccacaccttctcctcctgctcccgtatcttctcctcctgcctccacatcttatcctcctgctcctgcctcttctcctcctcccatatcttctcctgctcatgcatcttctcttcctccctccacatctcctcctgctcccgtatcttctcctcctgctcccgtatcttctcctcctgcctccacatcttctcctcctgctcccgtttcttctcctgctcccgtatcttctcctcctgcctccacaccttctcctcctgctcccgtatcttctcctcctggtcgtgcatcttctcctcctgcctccacaccttctcctcctgcttccgtatcttctcctcctgctcgtgcatcttctccttttgcctccatatctcctcctgctcccttatcttctcctcctgcctccacatctcctcctgctcctgcctcttctcctcctcccgtatcttctcctgctcgtgaatcttctcctcctgcctccacatctttttctcctgctcccgtatcttctcttcctgctcccgtatcttctcctcctgcctccacatcttcgcctcctgctcctgcctcttctcctgctcgcgtatcttctcctcctcctgcctcttctcttcctgctcccgtatcttctcctgctcgtgcatcttctcttccagctcccgtatcttctcctccttctcccacatcatctcctcctgcctccgcatcttctcctccttctcccacatcatctcctcctgcctccgcatcttctcctcctgctcccgtatcttctcctcctgctcccgtatcttctcctcctgctcctgtatcttctcctcccactcctgtatcttctcctcctgcctccacatcttctcctcctgttgctggttcaggcggttccacaactcgttctcttccacctgggcttggagctttgctgacacactctgcagctccttacccaggtggtcagcctccgcctgcagctgctgctggaatagtgaaagtgtttttttgaacctcaga[224 bp omitted]gaggcaggagaatggcgtgaagccggggttggagcttgcagtgagccgagattgcgccactgcactctggcctgggtgacagagtgagactacttctcaaataaataaataaataaataaataaataaataaatgtaatctataaaataatggttttcatccatgatcctttaaaaaaatatttttaagccctaactcttgagattctgattccccaggcagggccccaatttgtacatttttagcacactctagaggattctatggcgggaccagaacaaggacccaaattttccagctcttggctggagcctccccataccctgcatgatccctagaccatggtcccagctggatgggtctcccacaacccccggggctgcagctgctcacctgtggcagcaggagcttggccctctccagtttcctttttagctcctttacgttgagctggatctcagacttttcagattctacaagttgaagtttttcttgtagtttggcatttttctccttcagctcctcatcagttatgctatggccagaggcagtagagaaaggaatgaatgaagaacataaaagaccactttggtgattgaccccctaccctcgccccacaaccacagaaccgtggcgctggaagggaccccaggaattaaaagtcccaggtggcaggccagagagaagacatgagttgcctgaggctaccccatgagtcagtggcacagccagcactagagcttccgtgtgcacacatgaaaacatgtatgagcctctccgcacactcacctggaccccccacctcccagcacaccacccatgctaagggcccccagacctcccattccaccttcccccatcctacgtgttcctgtacagttccagactcagggcgtccctctcctttgttaactcctcaatgtactgcaaatagagaaaggttaagtcaggatagagcaggcacagcagtagctggacgaccaggaacaactgctacagtgactactccacagtaacacttcctcactctcaatcacacctgacgtgttctcaaggcatttccaagcccatggtctcatttgtttttctttctttctttctttctttttttttttggcagagtttcattcttgttgccctcactggagtgcaatggcacaatctcagctcaccacaacctacacctcctgggttcaagcaattctcctgcctcagcttcccgagtagttgggattacaggcatgtgccaccacaccgggctaattttgtatttttagtagagacggggtttcttcgtgttggtcagtctagtcttgaactcctgaccgcaggtgatccgcccacctcagcctcccaaagtgctggcattacaggcgtgagcgagagcacctggccctcatttgtttttcaaagaactcagtggatgtggaagggacagggaaagagattgaatttagagctggctaacaggggcccagagcgatcagataatattgttattgctattactgttagtactaccactgttcgaacctttcttgagtgcttcaccaggcactatgctaacaatcccatttaatcctcacaacctccataggagacggttaccattattacctctattgtgtagatgaaaaacatgtggtattaaaggttaagtgctgcctaagatcacttggagctgggatttcaacacccaggtatatctgattctctaagcccattctttcgctggaggtaggggcacagttaagaaggaggaaattaatcctttgttgaatttttgaaaggatgatacgttcgcatagtccaaaactcagaaagtccagaagggaaatatctccccccaacactgtgcctctatcctgagttttttaatgaatccttacaaacgtgttttatgtatgttaccataatacgtacacacacacacatatacacctgccccctctctccacacaaataataacatactcaagatactcttctgtacctttatggtacaagtaccctaaccgccacttaggacttggccaaggccacagccaagtatgggcagggcgggcacttggcctctgagatctatgtccagtgctcgctcctcacagtgctccccaactcacccacaacagccgactcagccccagtctgcctctaacaaccacacacaaaagcagcaagaaatggccatgctgccttctgggcaggacactccatcctacagaagggacctttaggctcactcctccatctgcgaagctgggctcccaagggacggggccgtgtttggactcaccctatccgccttcttcttctgtgtagtgacagcagagagagcctgctctaactctcctgcaaacttccatgaatcatgcaggcggctgatcagatccctggcctctcctggaatgagagacattcagatgtggcccaaaggactccccctaaaggcctgtcaaagtgccaggttgaaggatgatggggtgccagattcccaccttccaactgcttgacagcatgctggctgtagtagagtgccatctgaagctcagttttctgacatgtaaggattcgtatggtatgaacctgggcctttgggagaaaagacaagcaaatgctgaaagagaagcaaagaaacattctccagagggcaggagggaacttcacaccctccactcacctctagctccctccttagggcttcctgatgttggtggcttgccttctgttcctatagaaagaggaaaacagagctcttactaggggtaggcagagatccacagcaagagacatgcccccagaatggcaccactgtcccagaacaggcccacccatgggaccagtttatcagggaccctgtggggatggggtggaatcttgggggtgagccttcttccccaggctgggagtgggtgaaatgagcctggggcctctacatctgagtgcccccaaacccagcggtcatgtcgtgagcaaagaaatcacactacttcttccagctgagctcggttctattgtttctgtggggagagtcaaaggaaggtgactgagggtggcccccttgactctattccccaggccaggaagcgataggcaggggccaggaatggatttaaaaggcacagttctcagacccaatgggaacatgaactggtcaactctcctcaactcccaaagaagaaggatttgggtctttttggtttttgcccacagccacagaactcaaagtctgaaactagattctcttgaaaagacagtaacagaaaccttcagaggtggagtgcgagaaaagcccacccttccgccagcttgtgatttagaaaggtgcattcactcagcaaacgttgagcacatacgggccagggacggttcttcacagcgggaatagaggtcagaaaaggcagacaggagcccttggccccgaggtttccattctagtgggcctttaactctcgggctctcagagctaacagaaacctctgatactctctaactctacctcaggaaacgcaagcccaagaaggagagtttacagcaggtcctggacgagggattaacataaaaacacaatgacaaatctcatttaaacttcacaaacgtaaggaaaacaatatcactcgtattttacggatgtgaaaagagaggcccaaagagctcaagcaatttgcgctaaatcatgtccctagcagatggaggggtaggattcaaacccagaattcttagccagtacctggcagttcttccacaatcttaacaattaccctccaccaccccttgggccctctgtccccaggagcccggccagccaagactcacatcctcaggcgagtggcaaccaccagaagtggttgtctcagggctagtgccattatttattttcttctttttggtgtcgcttgctgctgtaccaacactagggttggtctggggatgatggtctgtcaactgtggaaaggaagagcagtgatactcatgagaactacaagctcctacagtcacatcctgctttacagtttatactaaatactcttatagaccatctgatttaatgccaccaactgtaggaaatgttgtcacaatcacttagtgactgagagagattgataccatggctgaaaaaaaaggcagtaatggaacttaaacttagtcttctgactctgagctctgggattttgccctaaatcagcagctgccagggaccaaaaccagaggcagaggtagaaaagcaaatattaagtaggcaggaactgtgcactatgtggtttagggttattcaccctcacacgtctgttagtgttaaaaagtacaccagtacctctcaaacctttacatcaatgtctcctcatggcagaaggcagcctttctgctaaatctgggaatttaacagaaagaggacaacccaagcctcatttcagagagaagtcttgtatacgcttataaatctatgtgactttcatccctaagtacattaatgttttgcctctcaatagaatcaagggaaactgatgcttcagaaagatgccccatatttatcctgtggcactcaaagtaccccaggttgagatgagatgaggaagactcaagctaagttcagtttcccaagatctgttccacagaagataagcagatctcactccagaaccagtgactgaggggcactctggtcccagaacaatggagaattcaaatctgaggtgcagaactgagaaaaaatgttaaagtctctctggagagtagaagcctgggagaaaaccaaaccaaacccattctcccattgccacccagagacactgtcaacgtgttgagctcatgggggaggtgtaggcttttcacactgtcaaggtctgtggtaaggaagtcaggcagcctgaaacctctctcttctaggtcccacagtccccattccccttccagctggaaacctgtgctgcaaccagaggaaacagaagtgggcaagaacacttaggggactgggtcctaagaccaaaggccggtcttgtggtagtaatgacagtttgtagcgggactgtgacatcactacattctactcctcggtggagttgttgggggggacacatgagtgcaatgcccaagttgccgctttgagactggggagggggtcacaaaattgggagccaggtccttggagacgtgaccccaaagagccccgggaggtcaggcttggggcggcaggaggtgagggccaattaaggagcaaggagctccaggagtcacatccccaaagtcaccctgtggcaactggtgagggcaggttctggggcacccaggtccttggagatgtgagctcaaggagcccagggaggtcgggtttggggtagcaggaggtaagggcggagtatggagttggaagccccaggagtcacctgctcaaagtcaccctggtgtgccgggcagagcaggggcaggacttatgagggggttgggctggctgacaagattttggtgtggggagcccagaggcactggggtggggggcccagcctggtgtccctcaggagtggcacagactctggcagcagttcggctgtcagagggggcctcgggttgggttggggtgttggtgcgtttacctgttccttggcctcggccaatttgctctgtctggtttctttggacatcataggatgggtagggaggtggggatgggtagggaggtggggatgggtagggaggtggggatgggtagggaggtggggatgggtagggaggtggggatgggtagggaggtggggttggggccacatcagcatgatccaggtgaggacaagtatatacctccagtcacctctacgtcgctgtgtgactgagccagaggaggcgtaaccagggctgcactagaatgcagaataggggtgtggccttcatgcttgaagcccattggtcaatgagaaagatgaaaggaaaaggaggtgtggccagacagcagcgtgtcatcaaggacctgtgttgtcacaaggaaagctgcctatgcaaccgctgtccccgcccactccaggagaggggcggggctggctttcactttaaaaactttaaaactttattacctcaattgaggtacaagtcctattaaaatggaaattttatagtgtgcttgatgattgataaagcagactttattatccaacattccaataagataatcacaatgttttctcttttttggaaaaactttctcttattctcctacattagcgtttagtttttttaaaaaaaacaaacaaacaagaaacatgtctaatatctttaaaaatacaaagctttgagccaggcgtgatggctcatgcctgtaatcccagcactttgggaggctggggcgggtggatcacccgaattcaggagttcaagaccagcctggccaacatgatgaaatcctgtctctactaaaaatacaaaagtagctgggcatggtggcaggtgcctgtaatcctagctacttgggaggctgaggcaggagaatcccttgaacctgtgaggcagaggttgcagtgagccaaaatcatgccactgcacttcagcctgggctgctacagaatgtgactctgtctctaaatacacacacacacacacacacacgcacagacacacacacacacgcacacacacacacacacacacacacaaggctttccatttaataagcactcaaagttctttacaaggttaaagcaaatacaggacccttctaaagtaaggctaaatgctaagtgatgggggagagaaaaaggacataaataactcctactctcatgagttaatcactaaatccgatttttctagaatcacctggcctctaagccctgaaaatgaaactgaatttctcactcgatacttggctatgacttgcaatcatgaaaaccaagaattgtgttatgtcactgtgtattgcttgttacctgggatcaagggttgactttttcatgatttgctccattacctgtgtgcttcttctcccagtccaaactacgcttttttctagagttctacaatttacagttagtatgtaagggtggctctcaaacatgtagtctccggaccaggagcacctgggaacttcttataaatgtaaattctcaggccccaccctagacatgaatgaatcagaaactctgcagtagggcccagcaatccgtgctgcaataatccctccaggtgctcaggaacctctgccatacagcaggtagaaaaatgtgtttccttctgtaggtccaaagccagggatactatatgttctgtctcaatatgaaacaatgacatgcaattaaaagacataaatctccttcctacttccaccctccagccagtgtgttttatttttatgagttcaataagaaaacgtgtggcaatcagagatttcatctaaaaaatatatctacaggtatcagttctcatccagcctgatctcatccaatatcatttctatcctcttacatctaaagttttagaaaaggattttcacaacgtaagactcaggcgcactaggagttctatgataaaagaccaagtagatctgaatgtccaaacttactagagaagaaaagtggactcattggctatattttcaaattgcattcaacaggaaattaaagttttgaattttttccaccttcatccttccaagttaatagaattaaaccagaatactccattcttccaaagcctgtagccaggcaaacttttactgtattacttcttgcttttcaatggatataaagcagagtcctggtaggcacattttgtatacctgcaaagatgcaaaactaaacagttccctcggttcaatattaaaacaaaagtcctgtaaacctcagatggtgagtgtaatacttcagcactagcacgaaagcctcaaatataaaaagataccaagaaccttgctagcaaaccaaagtaagctcttggccgggagcagtagttcacgcccgtactcccagcatattggcaagctaaggtggggtaagtcaggagttaaagaccagcctgggcagcatagcgaattcatatctctacaaagaaaatttaaaaattagctgggcttggcggcacacacctgtagtcctagagctacttgggaggctgaggtgggaaaatcacttgagcccagaagtttgaggctgcagtagctatgatcatgccactgcactccagttggggtgacagagcgagatctaattattacattctgtcctgctcctgtttccactaaaatcactaacttaaaatgtgttcattcagcaggataaaaattaagtgaaatttgactttggtgctttgctagcaaaaaataaataaataaagtgaagtgacaaattacttactgggagaagatctttgtaacctcaatgacagattaaaggtttgtatccttagcctataaagaaatctttaaaattactcagaaaaaaaaatgaatgatttgcagcagaaaatgggcaatggagaaaccagcacttcccacaagaataaaaatggccaatgagcaaatgaaaaagattcaaaagcactagaaatcaaagaaaggtaatgaaaacaatgagattttctgcttaaagaccagcgaagacgacaaatggaaggcggaacctggagctctgtccctgttggtgggagcgtaaactcaaccaattttcctataggatgatttgaacatttgttttaaaaatcctaaaactgttttatattattttcttctagaaattctacttctatgaattcagtgcaaaaatcctcactcgagtccattaaaatatatatagaaggaaatccacctctggggtggcaatgattcacttaacatacatccagctgttgaaagtgatgatgccaggatatatttctcccatagaaacatgcttaaaatatagtaagtgacaaaagaccatgtattgtgattctactttttaaaatgtttacagcataaaaagtgtgaaaagcaacaaactggaatgttttgagtggcaaaattaaagatttttctttacattttgtcatccaaattattacaaaaacaatgtgatttcctttataatcatggaaaagtgttattttcatttatttatatttacatttcttttctttttcttcttttttctcctgtatgtatcccacataggctacagagcttaaatccctgcctcttgagagaaatcagcccattttcaggacatgcaatacacaaagctgccccatcttccctttatttttatttttatcttatttatttatttatttatttatttattatttatttatttatttatgttgagatggagtctcactctgttgcccaggctggagtgcggtggcgcatctcagctcactgcaacctccatatcccgagatcaagcgattcccctgcctcagcctcccgagtacctgggactataggcatgcaccaccatgcccagctaatttttgtatttttagtagagaggaagttttaccatcttggacaggctggtctcgaactcctgacctcaagtgatccgtctgccttggcctcccaaagtgctgggattacaggcatgagccactgtgcctggcctgtcatattatttctaaacatttgagtgacatttcaattaagtgaaatttaattcttactgatctgatctcttatcctctgtttaatgataccttccagttgaaaggtgtttcctctgtaatcacgggtgccaaaggaaatacaacatgtattcattaggtggatatccactaaaccacggattcatgcattgtagtccttagaccctcagcatcagaaacacgtgggaacttgttagacatgcaaattcctgggccagccccacacctcctgaatcagaaagtggggaaggacagctatctgtgctttaataagccttgagatgctccctgaagtttgaaaactacagaactagaatacatatggtagtaagtgctcatactttatccaaggtactagggactcttcccctcttttccattctcttttctgttgaaataaaatgagagctccttttgacttaatgggtataagaaagaaggcaatgagatgaccagggtttcaagttagagttcaaaatttaatcagtggacagtgacaggatgcaagccttctaaacagattgctgcaaggaagctgattataatctatacagtaggtatcattagtgtattgatgttaaattttgggggtggattaatggtattgtgattatataggagaagtcctggttcctagaagatatctgcgaaagtacttaacagtgaaatgctctgatactgccaacttactttgaaatgattcagagggaaaaagggcacatatacaatcttccatacgcagaagacagaaaacaagtgtgacaaaacattaactagtgaatccagttgaatagcatacagatgttcactgtatgattttatcaacttttctgtgtttgcaagttttcaaaataaaagttgagggaaagaaacatcaccccaaatctttctatgaaatgggaccacagaaaaagcagagaagtgaacactttgcagaaaagagcactgcacccatccggacagcatggtcaaagtgcaggctctcctccaggaggctcttctctggtctcttctgtgctgtcacttcccccacatgcagccaaggcttttttctaacaactctttttctaaagatgtaatttttgtcattcatctaagaaagagaagaaaagaattagtatacatttagaaaataaaattacacttacatttgtgaaaaagcaaaaaatactttgaaaagtggggaagcaagaaatgtactgttctacaattctgttctgttcttaccatctttttattctgccaatgacttcctattcctgctgtgtatggtggggtgagctgcaaatgatttcttttcctcattgatttaaaatgtcatgtttataatgtaccaaactcccccagaagcatttgggtttatttctgggctctattctattcaagtaatctatctgttcacaagccactatcaattttgattattggagcatcctaaagttaagtaattgttgtttttgtttttgagatgcagtctctcactctgccgcccagctggactgcagtggcgtgatctaggctcactgcaagctccacctcccgggttcatggcattctcctgcctcagtctcccgagtagctgggactacaggcacctgccac[187 bp omitted]ttgtcaccacccatatctgacacatcctcctccttctctaaatcttctaggtcctcctggccatcagcctctgtttctgaaccagcctcttcatgctcctgttcttcactctctgggagaagactgatatcttcatctttctttcactaaccgcattctggaagcactgtaaaattgcttcattttgcaattccagttgttgcaaagtctgctcatcatcaaaactttctatcacaagtttttgtaaagagctgccatggattctaccattctctactgttttattaaagtcataaagcacttttgttaaagaagtgaactttggttccaatccatcttgaaacctattgggaggaattaaatgagatttagaattatagataataatttcacagccctcttaattaaaagaaaaataaaaacctcaactcttctgtaaaatcaaatttgaataaagtgtaagtatagattctggccccaataatatataagctgatgagccacaatgatatataaaacctgtcaaccaagtatttgtgaatcatctgtatagattgttggcaggaaaagcattacaaatctatttgcttggagatatatagagaattagccttaaattttctactctgctacattatataccactccattcattcattcccttattcactcaatgatcaacatttgctttggctacagtggtcaaggaaaacctctcctagatgtgacatctgagatgaaacttacagacaagtatagtcttataaagattgggaaacatgtattccaggcggaagaaacagcaagaacaaattctctaagatgcaattgagcttggtaagcctgaggaataaaaaagtgagcatggctatagcgtgaaggaggcagaaggtgaagttggagagactgatgggagccaaattctgcagggctcaagggtaagagtttgccgttttaagtgtaataagaaaatgtgagaagattttaagcagaaggatgaaatgatgatttatacgaaggaagaagaaagggaggaaggaggaggaggaaagtagagtgattagaaggttgatgcagcattccaggcaaaggatgatggtgatttaagctggagttagagcagtgaatatgctgagtacagtttggaggtagaactgacaggattgctaaggaattagatacagaatagagaaaagtgaagacatcaaaatagcagcctagttttatgtgcgagcaactggagagacagaactgccatttactgcgataggcaaggcttgagtggtggagcaaggggaaaggacttcagcggatggcagagtgtaggtgggtagaaacaacattctactgtattttggacacagtgaatttgtgatgctgagaggatcaaaatttaaaaaattgttaaaagccgtacggtgcggatatcccagttgtgcgctactgaattccaactaagctcagtctggagttgcttgtgagcaaggaactcaagggagaggttggagtttgaaacataaatgagtcataattttataggtcatatttgaagttcttcaacaaaatacacataaaacgtttgtgttgggaagagacatgaaagttctaattctcaagaagcttagtggggtagacagacaagtgacaagtttgtgctttcaataaagtatgatggcaggtaaacactgagtgctttaggagcacaggcggaaggagaaaccaacacagttgtgtgtagggggatgggggccgtaataagcctcaaggggagcttataggcgtgaataactgaggttaggttgatttcaataacattcatctgagagatccatactgtaaaagttttaacaatttttaaaattttgatagcctaggtcctctgaaatgtggggaaaagtgatttacatttccccttaccttcccccagctccacaatttgccaggggtctgcaacccgtgtccacgtgcgaccgcagtcgcacccgagcccgggatctgtgcacttacgtgaggatgcactcgggccagccagtggctttgcccacctccctcagacaccgctccagggtccgtcagcgccaggcccatgggccatggctgtctgcaactcccgacacaagctgcaaggcaagagagccgctgggaaaccgcaccgcaaggatgctggcattggaacaggaattaaaagaaatgaaaaaatgtgtaagcaaaaactcagctgtatgtaaaaaaaacccaattccccctgagaatgagaaagagccttagtcctttaaaaaaactacctgttttcctatggctagtgagccttatcgctcccttcccaggcattatcaaaaccctaattccctaactgtgcaactgcaaggtcactaaacaaacaaatgcaagtcacaaaacatatttttcctaaaaacgtaaaaaaaaaaaacataatgcgtgcttcaattaaataactctctgtttctcgcttctgtaatatgcttccccctgcacagatctacccgggctccacaaaatgctaaaagataactctttattcagctcaacgctttgatctgcctggcgtggtggctcactcttgtgatcccaggactttggacggccaagtagggtggatcgcttgtgccttggagttccagacaggcctgggcaacatggtgaaacctggtctttttgttttgtgttgttttgagacggagtttcgctcttgttgcccaggctggaatgcagtggctgggtctctgcttgccgcgacttccgcctcccgggtttcggtcgttgtcctgcatcagcctccagagtggctgggattgcaggcataagccaccaagcccggctaattttgtattttttttttatttttattttggtacagatggggtttctccctgttggtcaggctggtctcaaactcccgacctcaggtgatccacctgcctaggcctcccgaggtgctaggattgcaggcttgagccaccgctcccggcccaacttattaatcagaaaggaatagatcgtcctggtgtggtggctcacgcttgtgatcccagtacttcggatggcccagcgcggggtatcccttgagcctaggagttccagacctgcctgggcaacatggtgaaacccggtctctctctctctctctttttttttttgaggcggagtttcgctcttgttgcccagggtggagtgcagtggctgggtctccgctcgcagcgacttctgcctccagggttttagtagttctcctgcctcagtctccggagtggctgggattgcaggcctgaccaacattgctctgctaatttttttttatttgtttttggtagagacggggtttctccatgctgggcaagctgatctcaaactccagacctcaggttatccgcccacctcggcctccggggatgctggaattgcaggcgtgagccagcgcacacacccaatttatttttatttcattttttatttttatatatatatacttttgagacggagtctcactttgtcacccaggctggagtgcagtggtgcgctgtctcggctcactgcaacctctgcctcccaggttcaagcgattctcctgcctcagccgcctgagtagctgagattacaggcgcccgctagcacacccatctaattttttttttttttttgtatttttagtagagatgggttttcatcatgttggccaggctggtctcgaactccggacctcaggtaaacccacctcggcctcccaaagtgctgggatgacaggaaggatcggcctggcgtggtggctcacgcttttgatcccaggagtttggacgggccgagcgtggcggatcccttgatcctaggagttctagaccagcctgggcaacgtggtgaaaaccggtctctctctctctctcctttttttttttgaggcgtagtttccctcttgttgcagggctggagtgcagtggtgcggtgtcggctccccgcggcctctgcctctgggtttgggtggttctcctgcctcagcctccgagtgactgggattgcaggcgggagccaccatgcccggctctttttttttttttttttttttttttttttttctggtagagacaggtctctccatgttggtcaggctggtctcaaactcccgacctcaggtgatccgcccgccacggcctcccggggtgctgggactgcaggcgtgagccaccgctcccggcccaatttattaatcagaaagaaatagatcggcctggcgtggtggctcacgcttttgatcccaggactttggacaaccgagcgtggggaattgcttgagcctaagagttccagacctgcctgggcaacatggtgaaaatctgtctcttattattattttttttttttttgaggcggagtttccctcttgttgcccaggctggagtgcagtggctgggtctccgctcgcggcaaattctgcatcccgggttttggtggttctcctgcctcagcctcctgagtagctgggattacaggcgcctgccgccacacccggctaatttttttttttgtatttttagtagagacgggttttcatcatgttggccaggctggtctcaaattcctgacctccggtgatccacccacctccgcctccccaagtgctgggatgacaggcgtgatcggcctggcgtggtggctcacgcttttgattccaggactttggactggccaagcgtgggggattgcttgagcctaggagttccagaccggcctgggcaacatggttaaacccagtctttt[131 bp omitted]cctcagcctcctgagtagctgggattacaggcgcccaccaccacacccggctaatttttttttattttttagtagatcgtggtaactgccttaaaatgatgattgttcagaaagtcagtttaatttagatactaaggatattgaggttatgtaacatttgagcaagttctaaaaaaaagagaaatagtatatttaattgctaataaagtattgtcaactcacaaatatattcacatagcatacatttcaagagcagaataaccatgaatataaaaggaattagcaaaaacgaaacaaaaaagacatgaagaaataaaaacagatggaacaaatagcacaaaatacgatgaaagttataaaagaaactatgccaacaatcacaataaatgtaaatagactgaataattaagagaaaatgactataaaacagaattagggcacgcgtggtggctcatgcctgtaatcccagcactttgggaggatgaggcaggcggagggatcacaaggtcaggagttcgagagcagcctgaccaacatggtgaaaccccatctctgctaatacaaaaattagccggcgtggtggtgaacatctgtaatcccagttactcaggaggctgaggcaggagaatcgcttgaatccaggaggcagaggttgcagtgccgagatcacaccattacactccagcctgggcaacagagcaagactccgtatcaaaaaaaaaaaaaaacacacaaaaaaacacaaaaaacagaaaataaacagtatgaaaagacatctaaaacataaagtcacagaaagactgagagagattgaaaaaagatacacctgtcatatgtacctaacccaaagaagggttggaagctatattattatcagataaaataggctttgggcaaaaagcaatatgggagattttttaaggccacaatataatgataaaaattctaataaaccaagggagaaggtaatctaaaatgttaatgtatctaataactagcactcaaaatacatgaaagcaaaatatgacaaaattgcaaccctcagagggcaatttaaatacatatctcagtatctgataaaagagacaaaaaacaatcagcatagacatagaagatttacatctctctagaaaattaacaagcttgacttaatgtacagaaaaaacatctctccaaagtgacagcattcacccccccaagtacatatgtactgagccataaggaaaatctcaacaaattccaaagaagcggaatcatgcacccatctttctctctaaccataatctcattaaactaaaaacaataataaaaagataaagtaaaaagccagaaaggcagatgctaaatgagaaagtgacagaaaagttacagattttgttaagcatacaaagcttctatggggtaaagcagtcaaagggatatgcaaatttacacagaaatccaaccgatataaatccttgaaagatactacatacagatatttcatcagttctcacatgccaaacccagcaaagccaaactttggagcctcccctgcgagcagacctgccacaggaggagaggcagcacaaacctccctttgcagtgaaaatgccacattgtgtgtgcttcttaccccatcacctctttggaagtggccccactcagcgctagctgagaatcgcttccctcataccactctcagtagttcaccccaagacacacgggacaactctgtacctggtaagtcattgtgaatccaattaataatggcattcagaaagttaggaatctttgaattattagattcatagtgatattcaaaagaaagaaaacgacatcatttctgttccacgcatgttgcccacattcactgcgtaaaaggcaaagggaactgtgagtacccacaaagaacctgatattgacggcacatacatttcttcattaggaagaataaatttagactgtaacaatttaaaaaaccagaaaatacaactgtacattttagttcttattaaaatccaagagttttaacttatttgctccttgtttaggtaattagtgtctaaaacatttcaaagataacatatatagtggctacgatttctagtactttttaaaaattcaagcccagtctcttctaattaaatgtataaatgatttatctctgtctttcttaaaaagaaccaagagccccaatt[187 bp omitted]gcgtggtagcgggcgcctgtagtcccagctactcgggaggc[144 bp omitted]aaattatctaataaaccatagttcagaaaataatttctgaattaagaaaatatgaagaataaaaccaacagtttatgtgctgaatttcacatttttattttttattatttttaaaattttgttttaagttctagggtacatgtgcaggagtgttacgtagggaaacgtgtgccatggtggtttggtccacctatcaactcatcacctcagtgttaagcccagcacgcattagctatttttcctgatgctcctcccccacccgccctgacaggccccagtatgtgttgtttcccttcctgtgtccatgtgttctcactgaacctcacatttttaaatacagcatatgccaggtgtcatttcagtacccataattatacatagtatatgtatatgtgtaaatatatgtatatgtgtacatatatgtatgtaatatgtgtatgtaaatattatgtaaatatgtatgtatgtaaatatatatgtaaatatgtatgtgaatgtatgtaaatatatacacatgtaaatatgtatgtaaaaatatgtacgtaaatatatgtatgtaaatatatgtatatataaatgtaaaatatgtaaatatttgtaaatgtaaaatatgtaaatgtaaaataaatgtagaatgtcaaatgtaaatgtaaaatgtaaaataaatgtaaaatgtaaaataaatgtaaaatgtaaatgtaaaatatgtaaatatatgtatatgtgtaaatatatatgtgtaaatatatatgtatatgtgtaaatatatatgtgtaaatatatatgtatatgtgtaatatatatgtatatgtgtaaatatatatgtatatataacacagcatacagcatatgccaggagtcatttcagtacccataattatacatagtataattatacatagtataattagactactatgttagctaaaaaatgttgattagatacaaatgtataaatttatcttctctaaacgtggaaattctctagaggctatttccagcttctgtgtggattgtagagcaggctgctacctgtaccccaaaaatgaacaccttaaaaaaaagacaactttctcagcctccctattgcacacacatatgaaaaatatgttaaattcaacgccaaatattcctgagatcaacacagcagtgatcccaaagagaaaatttctctttgctaatgggcacaaacttgaagggcaaagcagtggaagggtaagtctgcagactcgcgtggggctcaagtcagaatcacgtggaagatcattgccacatgtttttgtttttttaaatagcaaccaccaccaagtggagcccgccgggtttagtagatattaaacctctaaggagtggcacatccgagactgaaattcccatcttttgattcccagctcaaggtctctgaaatgccagcaccagctgtgaaattgttcttctgcattttcatggagaccttttcttctatactgccatactcttttttttggaacagttatacctgatcttcctatttttgtgtgtgttccaccgaaactttttcactctaaatacttccctctttccaactgagcatttacatctgtaacaaggacaaaaacatctaacatctctctcacccttggtttgtgttttgttttgtttgtttttgagacagggtcttgctctgtcacccaggctggagtgcagtggcgtgatcactgttcactgcagcctcgagctcctgagctggagcaattttcccacctcaacctctgagtagctgagactataggtgtgtgccaccacgcctggctaatatgtgtattttttgtagagatgagtttttgccatgttgcccaggctggtattgaactcctggcttaagtgatcctcctgcctaggcttcccaaagtgctggaaggaattacaggtatgagccaccgtgcctggcctcaccattgttaaaattatggaaatcgtgtttgcaaagcaggttggcctgtttggaaaagggtgtcataatttctcaggtagctccaaaaagagaaagctacgaaaattaccttaatacattcattacagtctcagtataagattatagcttcctctcccaaagcgtaaccacaacctgacgcaggatgagttggtttgaaaataccgcatacaatatcctcttgagtagaatcataatttagaactctaaaaatgaccggaaacaaaactgtccaagtttgtttaacgtaatgtgtttcaacttatttgactagaaaacccttcattcgtgcaacacttataaatatcccatggcaaatctagttttctatgaataatgaacgaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatagcccatgtctggccaggctccatggctcaatcacacctgtaatcccagcaatttcagaagctgaggcgggaggatcactggcctttagtgatccttgaatgaaactccatctctaaaaaattaaaaatattagcttagagaatcatttgggcccaggagtttgaggctgtattgaactatgactatgctactgcattccagcctgggcaacaggctgcttaaacctggaggggcagagcttgcagtgagccgagatcgcgccactgcactccagcctgggcaaaggagccagactccgtggcaaaaaaagaaaaaaaaaaaaaaaaagagattctattcacaatagcaacaaaaccctgagaatatatctagcaaagtatacacaggcctttcatgaagagtattgccatagcctgaatgtgtctcccaaaattcatgtattaaaacttaattcccaagatgatagtactaagaagtggggcctttaagaagtgattaagacataagggtgagccctcatgcatgagattagtgccttccttataaaagggcttgtgggtggtggtaaatctgtcccttctgcctcatgagaacatagcatttgcctgctccagaggaagcagcattcaacgtaccatcttggaagcagagaccaggccctcactagacactgtgtctgctggagtcttgatcttgttcttcccaacctccagaactgagaaaataaacttctgctctgtgtaaattacccagtctcaggtgttttgttatagcactatgaagggactaagacaaatataaaaattacccagggacttaaaggaagaactgactaaactgaaatatatgccatatatattatgaatcgtaggactcaatgctataaacatactacttctcaacaaattaatctataaattcaagaaattcctacacaaatcccaatagaatttttttgtggaactcgagaggctgatcctaaaattcatacagtcacttgaggggccaagaatagtgtaacagggctggcggggctggtggctcacacctgtagtcccagtactttgggaagtcaagactggaggatggtttgaacccaggagttcaagaccagcctaggcaacatagcaagatgttgtctcaaaatattaaaaataaataaataaataaataaaaagaaggttaagtatgcacattttgttgtgaatttcaattttatagtgatttttttttttttttttgagacagggtcttgctctgtcacccaggctggagtgcagtggtgccatcttggttcactgcaacctctgcgtgggctcaagcaatcctcccgcctcactctctggagtagctgggaccacagttatgtgccaccacacctgactaatttttatatattttttttgtagagacggggtttttccatgttgcccaggttgttctcaaactcatccacctgccttggcctccgcaagtgagatcacagacatgggccactgtgcccggtctagtgcgcttttttttttttttttttaaccaaacaaacgatgaagtctcaggagtaaaagttgatacacaagtaaattttattggtaatgtttttgtgtggtctttaagcagagggaaaattagtctgcattatggtgtatccagactaaataactgatattaaaatgaaattatccttaggatttacaatcttagagaaaactttttcattttttttgagttacaaattatcttcacttacatttgagaacagtgagtcacagagggattaagtatcttactcaagatcttgcaagtgtttggtttgaacccaatcttttcactctgcagaactcagagtcactcttatttggaaactttttaactgatgtggatcctctaatatgggcttcctattattcattccgtattagtcagaagttttgcaagcaggcagaattcattttgccaattacgggattttccctcagttgcagtcaaggttcataaaactataactatttatctttaattataaattttgtttttgagacaaagtcttgctctgttgctcagactgggatccagtggcacagtaacagcccattgcagctttgaactcctgggctcaagggatcctccgcctcagcctcccaagtatctgggactacaagtgcatgccatcatccctggctaattttgttaaaaaaaaaaaaattgtagagatagggtcttgcttcgttgcccaggctggtctcaaactcctggcctcaagcaagccttcagccttggtctcccaaagtgctgagattacaggtgtcagccattgcacctggccaaaactgtaactatatatacacacacacataactacatatatatgtgtgtgtgtatgtatgtgtgtgtgtatatatatttttatatataaatagatatatctgaaaggcatcaaaagaaaaaagctgtaacttttagtcttgatcttgatagtgacttgattaggctatctgtttaacatcaaagatgcaaattaatgctttctttgggtgagcatattaaaaatgcagaaaatattggagtagttttttatgttaaataaattgtattctgtgtatttaaggtatacaacatgattttgtgggatgcatatagatggttaaaaaaattactacagtgaagcaaattaacgtatccttcaactcagatagttacccgttttctttttgtttggtggcaagaggagcttaaaatctcatttagcgtgaatcccaatacagcacaattttattacctatatttcttgcgttgtacattatatttctaggcttgttcatcctacatatctgctactgtgtaacctctgagctatgtccacccattttctctcttgccccccaagtaatttcctaaagtgtctcatataaaaaggcagtagctttcagcttaaactttttctctgtatatatttaagtcaatttctttgaggtatgtttttctctccagaatagttagatgtaggcataccactttaatgttgacactagttcacctagaacttatcttctgcaaatctgtctctatgtccatctctgtctccatctttgtctctatctttatctctgtctatctatctatccatccatccatccatccatctatctatctatccatctatctgtctatctaactaaagcaaattcatgcccttctcctatttatggaatcgagaccataaacagaggtgagggaaagaatttggcaggaattgcgatgtgtattacctgtggcataaggaaactttacagaactagggtcaaaagtatactttctagttctttcccatggcttttcactttgatgtagtccttatcaggcaactgaggttttatataagtcccctgattcttagaacatgaaggtgtagtattcaagtttggtcccttgaaagcacaatttttgttaaaaaaaattaagaaaattgtatgatttcctcagcaaatacatattgatcatctgttatacagccatgagaagtggttctgttgaacacgtttattttatcagatcccaattctaaaccaggcatagaatggaaaccatgaaggtaggatgaaataacttctgaatgtttgaaaatagtgtacttaaaaataaatatcaggtgtttttgttttgttttttgttttttgtttttgagacagggtctcactctgtcacccaggctggagtgtggtggtgccatctcacctcattgcagccttgacctcccaggctcgggtgatctcccacctcagcctcccaagtagctgggactacaggcacatgccaccatgcccagctaattttttgtattttttgtagagacagggtttcaccatgttgcccaggctggtctagaactcctgggcttaagcgatcttcccacctcagcctcccaaagtgccaggattacaggcatgagccaccatgcctggctgaaaataccaggtttttaagtatcagcactgcctcttcaatcttttctattactatgttgtgctcagtggtattttttattgaattagagcagtgctgttcaatggaaccttctttgaggatggaaatcttttatgtctctgctgtgtgggtatggtattagctgggtatggggcacctgcctatagtcccagctactcaagaggctgaggtgggaggatcacttgagcccaggaggccgagtctgcaggttcgtaccactgcaattcagcctgtgtgacagaatgagactcagtctcagaataaaatgaaataaggaaataaaaatgtaattgttgaaataagaaactagtggatggattagacacgagaagaaagaattaattgtttagacgattctctccaaaaagtaagtcagcatgtcacacagagagacatgaggatagatgatagggcagaagttggtgggcttggaggggagaggaagatcagaatgaggtccaaaatgtgtcttagtgaaatcccaggaggagatattaaaattatattagaaagtgaaagaaatagaagttttatttatttatttatttatttattttgagaaggagtctcgctctgtagcccaggctcgagtgcagtggcacgatctgagctcactgcaagctccacctcctgggttcacgccattctcctgcctcagcttcccaagtagctgggactacaggcacccaccaccacgcctggctaattttttgtatttttagtagagatgtggtttcacctttttagtcaggatggtctcaatctcctgacctcatgatccaccagcctcaggctcctaaagtgctggaattatacgcataagccactgcacccggcccaaaagctttgtgtttttacaaatattacacgtttcttgtttaagaaaaaaagtcttcacaataacgtaggagaataagagaaacatttttccaaaaaagagaagtcattgtgattattttatcttattggaatgttggataatatagtctgcttcagtaatcatcaagcatgctatggattttccattttcataggatctgtatctcggttaaggtaatactggtaatttttgtactctatgaaaaatataggccaaaatcatagaccttgcatagaagctggatcatgaagacagctctggaggaacacacaggtacacacacacagacacacatatatataaagtatacacatatatattttttaaaagcttttaaagcaaaagccggccctgcccctctcccagagttggcggcctctcccctctcttagggtgggtggggacagtggttgcatgggcagctttccttgtgagccaaaggtccctctggacacatgatgcctggccacgccccctttccctttcatctttctcattaaccaatgggcttggagcattaaggccacgcccctattctgccttctactgcatccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccaatcccgaggttcaccggactgggacccccacaccggtgcctctgggctacccccaccaaagttttgccagtcagccccaccccttcagcaagcagcccagtctctgccctcaccaatcaccccagggtgactttgggcaggtgaatcctggggctccccgctcctttactgggccctcatctcctgccaccccaagcttgacctcccagggctttttgggctcacatctccaaggacctgggtcccacagccccagaccccaccctcaccagtcatccctgggtgactttaggctggtgaatcctggggctccctgctgctgactcttcccttccctcctgctgcctcaaggtggacctccctaggctgtgtgcactggcgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcaagactggcctttgatcttatgacccagtcccctaagcattgccaccccatttctggttcctcttgtcacagcacaaatttccagctggaaggggaatggagattgggacctaggagcaagaggtttcaggctgcctcactcccttaacataaacattgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagtcagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaagagtataccagacctctctctgaaatgaggcttgggttgtcctctttctgataaattcccagatttaacagaaaggctgccttctgccatgaggatacattgatataagagtttgagaggtactggtgcacttcttcacactaacagacgtgtgaggatgtatgactctaaaccacatggcatacagttcctgccaacttaatgtttacttttctagctctgcctctggttttggtccctggcagctgatgattcttggtaataccccagagtttggagtcagaagactgagtttcaaagttcgtctgtcgcctttttcttttcttctttttttttctagccatgatatcaatctctttgagtcactaaatgattgtgacaacaccttgtacagttgttggtatcattaaatcagatggcgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagattgtggatggactgttgggtacctgtgaagaattctgggtttgaatcctgcctctttgtctgctagggatatgaattagggcaagttgcttgacctcatcgggcctctcttttcacatctgtataatagaggtggtattgtttcacttccatttgtgaagtttaaatgagatctgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccgcagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcagggcagccctccaacctcctcctccaggtgggacggggtgcccctctgccagctgagacagtccacacacaccccagccctaatgattgctctctctacctctccccccactcctcctccacctcctcctctctgcatgcgcctcagagcccgtgccaagaactagcagtagtcccagactcgaggtctgtaaaagtcagtcaactgaagaacaccatcaaatctttggtaagagtccactggggtcccctgattccacgctgccaatcctgggctctagtttctccttggggccctgaagaaaggggacaggggcccctggtgccaagggcgaatagggagctggggcacccaggcctcacctggagggaccccggagcatgcagcatggctctttttttgctgccctgtttgctgactctcccctctccagacgcccctgctcgagtccttgctacacacgccctgggattgttgcctcttggggaagtgctagcctgactggttgtcaggggccctgtatttctgccatgactcagtccctaatttgctctttgattctggacaagccacctctcctttttgggctcgtgtttccagaggaagtagtgagtatcataggtctctgttagctctgagagtctgagatttaaaggcctcctagaatggaaacctcagggccaaaggctcctgtctgtccttttccgccctaaatctgctgtgaagaaccgtacttggcccgtacgtgctcagtaaatgtttattgaatgaatgcacttttctaaatcacaagctggcagaagggggggcctttctcaaactccatctctagaggtttatgttactgtcctgtcaagagattccagattcagaccttgagttctgtggctgtgggcaaaagccaacaaagacccaaatcctctgtccttgggagcttgaggagagtttaccagttcgagttcccactgggtctgagaactttgcctttaaaatccattcctggtccctgcctaccacttcctgctctggggaatagagttgagggggccaccctccatcaccttaatgtgactctccccacagaaacaacagaagaaacaagtggtacatcagctggaagaagtaacatgatttctttgtttgctcgcgacatgactgctcggtttgggggacactcagatgtagaggccccgagtctcgtctcacccactcccagcctggggaagaaggctaaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacggtgtgcagttttctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctgggactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccccgtcccctgggagcctggcttcgcagacagaggagtgagcctaaaggtcccttctgcaggatggagtgtcctgcccagaaggcagcatggccatttctcactgcttttttgtatggttgttagcggcagcttgggactgagtcagctgctgtgggtgagttggggggcactctggggagagaacacaggacgtagagcttggaggccaagtgcctgccatgcctttacctggctgtggtcttggccaagtcctaagtggggtattggctacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtttgggactatgtgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtggttgcgaggattaaatgggattgctagcatggtatctggtgaagcactccataaaagttcaaacagtggtaataataacagtaataacaatagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctccccagattgaaacttctcactcttcagcagttctccagccgcagtaaagcacgtatggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtagagccagaggtggtcctgggactgggctttgtggaggtgggggcagagagggagatggtagcatgtccagcctccagcccctctctccagggccctttccccctgtgctttgggcaggtttgctcgttgaagaaggagaagaagcatgataaatatcgggtagagacgctggagaggagcttgtccaaactcaaacaccagatgggtaagatggggctggcgtgacctgacagcaggactggcatcagagggctgtgagggtggcttggagtgccccagcgaggtgggtggatgggaagggctttgaggcagagggaaagaggtctgttccaggagacggcaagtcttgtcatctcaatgagcctcagtgtccccatcagcaaagagggcccgttgtcagccacccgcagtgctctttctctgaaagtggtttggaagactggctaccatctgggtgcgaggaatcattagcagtgaggccaagtttgaggagcctgagaggagctgtgcgccaagaggagggtttttcttttccgagaatccagaggcccttattatctgcttcctttctcagctgaacccttgcccccggagcccccagcagtgccctctgaggtggagctgcagcacctgaggaaggaactagagagagtggcaggagcgctccaggcccaggtggagtacaatcagcgcataagtctcctgaatgaggggcaaaaggagagacttcgggagcaggaggagaggcttcaggagcagcaggagaggcttcgggagcaggaggagaggcttcagcagctggccgagccacagaacagcttcaaggagctggtgcgttgccccagctggggagcctgccctcctccctagccctccaggcctttgtttccccacctataaaatgtggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggcaccagcctctggggaggggaggtgccaggccagaggcagctccagcccgggggcaggtgaccccagcaccctccagggcagtcctgtggctgtttcttgcttcctgccctctgattttagaggtgggtagccctgggctcctcccaggtctggacatcatcattccagctagagacatggagcaccgccaatcacaggggaagagacagagtggtataacagtcttcttatgccagacgcggtggcttacgcctatagtgccaacactttgggaggctgaggcaggagaatcacttgaggtttggagtttgagatcagcctggccaacatggtaaaacctcatctctactaaaattacaaaaacaaaaaacaaaaaaaggaagaaaaattagtggggcatggtggtggcgcatgcctgtaatcccacctactcaggaggctgaggcacgagaattgcttgagcccaggaggtggaggttgcagtgagctgagattgcaccactgcactccggcctgggccacagagtgacactctgtctcaaaacaaaacaaaaagactccttagattaaaactggattccagcctcagttccactggtcaccattcaagtacttcacatctctaagtctctgtttctttaacttcaaaaggaagttagcattttccttacagaggtgctgaggattaaatgagataatacatgggaagcattaggcctgtagcacatttagcagatggtggttggctcccactacttttctaccattctgtggcctacagttgaaatggtgggaagaggacatgagatttgaggctggggaaggaggcatggggttctaggaaagggaggcagtcacttaggcctggagtaaggggccaggggcctgggcaggcgacagagccccacagtgccctcgctaccctattaatgggcccagaatctggaaaccagccaccacgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtgactgcagcagacccagctaatgaaccagctgcagcagcaggaagcttggggcaaagcggtggccgagatggcctgccaaaagttgcaggaggcccaggggagggagctgccgaggatggggccgtgagggggacgacctgacaaactctgtgccttctcactctttcctggccccttaggagcgcctggaagctgccagccagcagaaacagcagctaacggcccagctgagcctcatggctctccctggggaaggtacgggagaccgcttagaggaagaggagagagccccaggaggaaggggggactgctagcagcataggattgaggagttggaagagacctttagaacagctggtcattatactaaccgggtgcctgcactaagttcagcatcaatatggtgacctcctgggagcggggggccaccaagttgcctaaggatggctgaactggccgaggtcagaaagggagcaggtcagaactcccacaccgaccagtagtgggaatgtgcctgggcagtatagcaagatcttggttcttcaaagtaaaaataaataacagcagctcattcctctctggggagggcctggctcagggttacacaatgagggtggaggcagaggtgggcccacaatacttcccttgttgagttgtctgaagacccctctggccacccccaacaggacacggaggagaacatctggacagtgagggggaggaggcacctcggcccatgccgagtgtcccagaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtggccaacaggtgcactctctgaggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagcggtcccagccccagggcctgggggcgagtctgtgagtggggagacccaccgggccctgcaggaagtcatggagaagctggcccatgccggaactcacctccgccttctccatgacttgaaaatgccacctgagggcaggtcgctgccgagatgtgaccccattattttggctccagagcggctttatggaccacctggaggagaaggcagacctgagtgagctggtggagaaagaagaacttggattcttccagtactacagagagagatgccatcagtgagtgggaggccagggcgtggcagggggagctgcagggctgttggaggggccccagcgtctgagccctgtcctcccgcaggaaagtttatcaccctataacaaagccagggggcagtgccaaagatgcagcaccgggaggaggacaccatcaggctggccctggacagggaggagatgaaggtagagtgtgcaacatctctgcgggggtgggggtggctgtgacggtgagcgctggcagcagcgtgacagctgagcacccctccctccaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtggtgagtagagccctcaggcggggtgggcaggcaggagcaggggggctctcactgagctcagatccccgcctccctctctccaaagatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatgaccatcgtcaaagacctgctcaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggtcattagcatgcatattgagtttgcccttacgtggtgggagttcaaacacacaaagacccactatttgcacaaaactattcttgctggtttggaataggctgccatgtgtttttaatgttattgaagcatgtatattcattacagaattcagataaaatttgcctatgttctgctattgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctatggattaaatcacatactggcatatttaagctgaatgtcaatctggaaaataaattgactgtattaacagaaataccactctttgtgtagatatttgtcatatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagaaggcaacattggaaggttagagttcatcagaaacagaattctaaaatgtgagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgcaaagtgctgtttttgccttaaaattttattctgtgtgtcttgaaaaatatagtattaaaggtattgatactgtgcaaatgctgagcatgcttggcatgagataatgtttcatttttacaaaattgtaatataactatgcaagagtttattaaaagaacacaaaataaaaaagttatgggattaacaaaagttatggggtgaaaaagttatgggataaaaaatgtaaaaaagttgtggcaaaaaaatcttgtgaccaaaaagtagaaaaaagttttatgaaaagttaccaaaaatagttatgaaaaagaagttatgggatttaaaaaaaaaggcatgggataaaaataaaaattaaaattaaaagcaggcccctgtcagcaaagcctggagaagtggggctggggtctctccaccaccacactgtccctatctccccttcccagtcacccctttacaattagggtagcaagacaagaccactgtctaacgaggaaagacaaacagaccctttgccaccttgaccagagctgagtccttaaatttctggatgatattgttatttaagagccagaggctggtggagttggtttgtttggaggaggcctcatggcctccttactctcaccatagcaacttttccctcagtgggggctcgaatcttcttattcagagaggtagctgaggcaggacagtggggctaactgtggaccaggcgaaggcatgggctgctggggtggccccccttccccggtgtatatattgtgtctgtgtaaggttttgtatattccagagggtagggccacccctgtatcatacctagcggtggttggaggtggcacatggggaggaggttctaataattatttgtggctgggaaacttacttattgctagcataggacagaggaagaaggcagggatggggtcatggcttcccagtggtgtgatcacagttcactgcaacctccaactctcatgctcaagtgatcctcccacctcagccgcccaggtagctgggagtataagcatgcactactatgcctggctaatttttaaattttttgtagagaaaaggtcttgctatgttgcccatgctggtcttgaactcctgggctcaagcgattctcccatcttggcctcccaaagcactggggttacaggcatgagacattgctcctgtccataagattttctctttattactgttttgttgttggtggtggtgttttgttttgtttttattttttgacagagtctcggtctgttgcctaagctggagtgcagtggtgcaatctctgctcactgcaacctctgcctcctggttcaagcaattcttatgcctcagcctcccgagtacctggggttataggcataagccactgcgcctggctaatttttggatttttagtagagacagagttttgccatgttggccagattggtcttcaactcctggccttaagcaatccgccctcctcagcctcccaaagtgctgggattacaggtgtgagccactgctcctggctaagatcccatctctatttaaataaaaaaagaaaattcagaatctatggaacacagaacaccaaaggccagttatttacctctctgaggtaatctgtgtaaacaatttgatatatatcctttcaagttcatacttgctatgcatacatatatatacacacatacattgacatattcccccttccctgctgtcatgctattagtcttcttttttttgtagaaattggaccaactctatgttctttgctggcccgtatttctcctattcagtgatgtgttatgaatatctgtttaagtcaatgtatgcaactctttaatatcattttaaaaggttacgacatacgatcatatgaaggcattagaatttattccaacagttcccttttgcacatttaataatttccattgatttgccaggaagaacattctcgtgtcatggctaaatccttttgtatggacatccttaattattcccttaagataaacttttaaataaagttgctagattagtctcgtttcttaagttcctttttggtagtttatatgtaacactgtagttttatatgtacttacaaatacctatagtgccagtagaaaatgggataaaattaaactctttcacatatgccaaatatattttgatttagcgctttattaagtgcatgattacagtctctgtatcttttgatttacctttctatctttacaattttcagccgagacacttagcggtcacataataaattaaggttttctttttttaataatctccatctttctaaatatggtgagtcacagtcagctatttttggattgttgaaagctgtgactgttctaaatcggagcccagaaatcatgccacttaccaaatatgctttgtcttccaacatcagagtgtctggtagaaggtgactgttcttggaatttaaaaaatctgaacaggacaagacaagaatctggacactttttctgtttctgataatatgattgagtaggtagacatgctggataatccttgcaaagacatacttgaacttccccaaaaaaaaaataaaatccagaatctctaagaatgaagatggagtgaaaatcagaagggctgctgagagaataatggggaagcagccccagttatcaagggacatgtccatgtgttcaatagaaagtttcagatgtaaaaaaaagttgagaaaaataatatatatattatatataataaatgatataattgccctacatatacacatcatcaacaatttttcattcatggtatggacagtttttttttttttggttgttttttgtttgtttgtttgtttttaaaggtgggattttgctgtggttgcccaggctggagtgcagtggcatgatcttggctcactgcaacttccacctcccaggttcaagcgattctcctgcctcagcttcccgagtagctgggattacaggcacccggcaccacatccggctaattgttgtatttttagtagagatggtgtttcaccacgttggccaggctggtcttgaactcctgacctcaggtgatccacctgcctcggtctcccaaagtgctgagactacaggcgtgagccaccacacctggccacagccagttttgtttcatttacattcccacttcatttatatacattccttcttcctctgaattattttgaagtaaaacctatacatcctatcatttttaattaccttatatgtatctgtagaagacaaggaattcttaaaaataaatatattcacaatgccattaaatatcaaaaaattaatattctgaaaatagccacaaatccagagttgacattttgttgactttctcataggtgattttttttctagtttatctatttcaatcagataactgtttgctcatatttacattccttactgaacaatgtctaaacttaaactgacataaaatggagatgatcttctaaccagatgcttagtgtaagaaaaaacttcaaactgcaagaggagtccctccaaatacagaaaggatcagtattttaagaggtatgttaactaaaatgtggcaatgtaaggagcaaagcaggaagaacctttaagtcctcaacttacaagtcaatttcatagtcagtttccctggtccttccacaacaacctcccccatctgttttctctacaatggaggtaacaatagtagctattccagagcaggaaaaggcttagagcagtgctagaagagggtcgtggctatataaagtttagctatttgtatattgtaacaaacctacaacttttttttttttgtcaataatacatttcttttggaaaagtggcaccctcctgtgggggacacctgcagttccactaagcgaacatcggtgtctgctaacctttgcctctttgtctctcaataatatactgtcaagctgttccttgatttagcacttttgtatacttttttttttcctctcccgtttcctgagacacagtccctctctgttgctctgtctggactgcagcagcgccatcatggctcactgccacctccacccccgggctcaagcaatcctcctaggtcagccttgggagcagctgggactacctgtggggcggctaatctttgtggtttttgttttgtttttccgttatgggaccgggtttcgggccaggctcagtgactcacgcctgcaatcccagcaccccgggaggccgaggccggcggattacctgagggaggagctccagaccaccccgaccaacatggagaaaccctgtctctaccaaaaaaaataaaaactaaacaactaatggggtatggtggcacatgcctgcaatcccagccactcaggaggcaccatttattaatctttttgacatcagatgctcagtggctcacacctgtaatcccagcactttgggaggccaaggcaggtgaatcgcttgagccgaggagttcaagaccagcctggccaacgaggtgaaaccacgtctctgttgaaaatacaaaaattagccgggcatggtggcacacacctgtaatcccagctactcaggaggctgagacaggagaatcgcttgaacccaggaggtggaggttgcagtgagccgagatcacagcattccactccagcctggacaacagagtgagactctgtctcaaaattaaaaaaaaaaaaaaaaaattaaccagccatggtaccacacacctgtagtcccagctactctggggctggtgggggaggactatttgagcccaggaggtcgaggctttagtgagtttgatcatgccactacactctagcctgggcggcagagtgagttcgtgtctcaaaacaaaacaaaaatagtttccagccaggcgcggtggttcacgcctgaaatctcaacactttgggagtccaaggtggcgcatcatctgaggtcaggagttccagaccagcctggccaacgtggtgaaaccccatctctactaaaaatacaaaaattagctgggcatggtggctcatgcctgtaatcccagctactcaggaggctgagacaggagaaccgcttgaacccaggaggcggaggttgcagtgagccaagatcgcaccattgcattgcagcctggggcaacacagtgagactctgtctcaaaaaagaaaaaaaaaaagctaggcgtgagaagtgccttgattttgtattttcaatctgccaatacttgcacaggctctggctgcaaaacttttgccggtcaaacattcgcatttgagaaaccacgtccctgctgagagatagatctagacacagccttaactacatcatcagtaga[138 bp omitted]gcctcagcctcccgagtagctgggactacaggcgcccgccaccacggccggctaattttttgtattttttagcagagacggagtttcaccgtattagccaggatggtctggatctcctgacctcgtgatccgcctgcctcggcctcccagagtgctgggattacaggcgtgagccaccgcgcccagcgacatatgactgtttttaaccagagggaggaaaatggctttcagatggttgtgtagctggttttaacagccttcagcagcgacactggcagcctccgacctctcagaccgagtaagccaagcgaagcctgtaggcgcacgcttgcagctcagcgcccgcggggactccggaagcctctcccaagtggcgcggtccgcaaggggcggctacagcttgggcgcaggcgccgctggctcaccggttctcttgggctcccctgggacgccgtaggatcgcaggcgcgcagccctcccggccgctctggccgccctgctcctcctttgaagaaagatagggccgctggcaggggccctccgcagccaccggggatggggctgaggccagtttttgtttttagtgcagccgccgccaggccgaccgccgggcttggctgcagccacggcgacactggcccgagttctgcgaggctgggggtgctggcgggcttggaggttgcctggcagctgctgcctgcaaaaagaaaaacaaacaaaaaagcagctgcagcttgggcgcccagggctagcggggcatggcctgggcagtcttgggattgcgagcgcgcgcggcctgagagtccgtacccttcgccgtgcctcctgccctcctcctctgccggacctcagaactgctggccaggccgtccgagggagtccggaccccactccgcagcctacagagatggggttgagcggcaggttctcagttctcgcccctctgcagccgccgccgggcagaccgcctggcttggccgcagccacggtgacatttggccctggttctgcgatgctgggagcgcgagcgagcttgggagttgccaggcagctactgcttgcaggcggagggcggctacagcttgggtgtccaggcagtggaacatggcctgggcggcctctggatcgcgagtacaccgagcctgagagcccgccaggccctgcccccgcctctgccagagctcaggaccgctggccaggggccctccgcagccaccggggatgggattaagtggcaggttctcgcccctgtgtagccgccatcgggcagaccatctggcttggctctagccaccgggacatctgtccccggttctgagatgttacgagtgcaggcgggcttagaggttccccagaggctgctgcctgcacacagagggtggctgcagcttgggtgcccaggcgggctggaggggcctggcccgggaggcctgcggatcgccagggcgcccaggctgagaagccccaagccgcgcatcccgcccggctcttccaccacagggagacaggagctgctggcatggggactccgcagtcacctgtgatggctttgagcggcaggttctcagttctcactcctgtgcagccgccgggacatctgaccccggttctgcgacgctggcagcgcgaccgggctcgggagttgacaggcggctgctacctgcacacacagggcagagggcagctgcaccttggcctgggcagcctccgaaatgcgtgcgcgccaggcctgagggcccccctggtggtgccacccgccccgctcctcctctgcaggagcctggagcagctggaatggccactctgcagggttatggttaagtattcttatcccatgcatgcacacaaaaaaggtaactattatgcgaggtaattaatatgttaattgacttcattttggtaatcatttcaaaatgcgcatgtagatagaaacatcacattgtaaactttgaatatgtacaatatttatttctcaaatatacctcagtaaagctgaaaaaaaatgaacaggattgaaaggataagcacacagttctataatagtagttggacacttcaatacctcattttaattaatggatagaaaaaccagacagaagcttcatgagaaatagaagacttgaacaacagtataagccatttagagctaatacacatatacagaacagtccaccccaaaacagcagaatatacattccttttaagtggatatggaactttctctaggataggtcatatcttcgtccacaaaaatatgtcctaatcatttacaaaagttttaaatcatacaaaatataatttacaaccacaatggaggaaacataaataaaaaatgaaacctgaaaaattcacaaatatgtagaaattaaacactacactcttaaactaccagtgaaagaataaatcataagtgaaattataaagtatcttaagacaaataaaaacaaaacataccaaaacttagtgactgcagtgaaagtagagtttgaaggaaaatgtatggacataaacaactacatttaaaaaaagctcaaatcagtaacctcactctacacctaaaaggcagtataaaaaccagagaaaactaaatctgaagctagcagaagtaaagaaataataaagattagagcataaatcaataaaatagaaggttggaaagcagtagaagaaataaacgtagctaaaagttggttctttgaaaagagtaatctcacctcagtagcctaagattcttctttaggaacgtagagaaagaacaacaacttaaatctaaggaactaaagaaaggagctaataacaattagggcagaaataagtgaaattcaaaaccaaagagagaaaaagggaaagagaagagagactacagattactaacagcaggactgaaagacaagctatcaatacacactataccataaataagtaaagctaaaaataattttatgcacacaaatctaatagatgagatgaaaaaaataaattcctctagagacacaacacatactaccaagtctcactgaagaagaaacaggtaacaaatagtcctgtattaattaagaaattgcatttgtaaataaaacctaccaaaaaatctagtcacatgttctttcactactgatttctatcaaatatttgaaggataaataattttgactgtacacaatcttttagagaaaatagatgagatgggagcactcccaactcattttataaggccagcattacaataacaccaaaaccaaaaaatgatatggagagaaaagaagactatagacaaatatcagtcatggacatatatgaaaaaatatcaacaaaatattgtgacatcaaattgaacatctccccatgtaggatgattcattatgtccaataaaaacaaggctgattcactattaaaatccaatccaagtaatctgctatagaatatttttaaaatattcttctcaagagatgcaggaagagcattcgatgaaatccaacatctatttctgaccaaaactcataaaattaggaataaaagaacttaggatatatgtttatatctgtatactatatggtgatgactgaatgatttttccttaagactggggacaggtcctattcgatattgtattagaaaatttgcaaagtgcaataagacaggaataagaaataaataacatacatattgcaaaggaagaagtaaaactgcctctatttgctgataaaactaatctttatatacacagtctacagtatttatgaaaagcttctaaaataaatacgtgaaattaagtgttttattatcaaaggtcaatatagaatgtcaataattttcctatgtgtgagtaattaacagttgaaaaaattaaattactatttaaaatagaagcaaaaattaagtgcttaggtattaatgtaacaatagaagtgcaggatctgtatgctgaaaactacaaaatataaatgcaataaatagaaaatttaaaaagaggggaatgaaatatttatgaattcagagtctcaatatagttaagatgccagtcttttccatttctgcttgtagagttccttcattaacaatgaaaattcctgtaagtttttttttttttgtagatatcaccaaggagattctaaaatttacatggaaaacaaaataactagaattgtcaaaacacttctgaaaaaaagttagaggacataaactactgattacaaggcttactattatgctacagttctcaaaatattgtggttttgttaaaatattgttaaaacactagatacgtagaccaatggaatgaatacagaccccagaaatagacccacacaaatatattcaactgcattttgaaaaagatgcagaggaaaaggggaaagtataatctattctgtaaatggggatgtaataatgggatctccccatgtaaaaaaaaaacgaaacttaatgcgtattttacaccttttacaaaagtggactgaaatagaccatataaaagtgtaaagtatacagcaataaaatactatcataaaacaggggaaattaggtatgactttggggtcattgatgagtttttagataaaacaccatacacatgatccataaaagaaaaaatgaaaaagcagactttgttatatctaaaaatgctcattctgtgaaagaaccattacaagagcaaaaagctaaaacaatcagggaaaaatattaagtcactgtattagtctgttctgctgctgctataaagaactgcttgaggctgggtaatttaccaggaaagaggtttaattgactcacagttccatgaggctggcaaagcctcaggaaacttacaatcatggcagaaggcaaacaaacatgttgttcttcacatggtggcaggagagagaagtgcttagcaaaggaagaaaagccctatataaaaccatcagattttatgagaactcactcactatctgagaacagcagcatgggggtaacctgcctccatgattctactaccttctgccaggtccctcccacaacacatagggattatgagaactacaattcaaaatgagatttgggtggggacacagtcagaccatatcagtcacgtatcttatacaagcttttatccaaaatgaataaagaacccttaaaactcaacaatacaaaacaaacaatccaatttaaaacaagcaaaaatcttgagcacgtacatctcaaaagaagacagacatatggcaaataagcatatgaaaacatggttattgttattaataagggaatgcaaaacataactacaatgggatactactacatgccattagaatagaaataaaaaattaaaatatcaagtgctcctgaagatgtgtagcaacaaagattctctttcattactgttgggaatgtaaaatgacatggtcactttaggagataatttggcagctttttataaagtaaaacatatgtccagtgtgaggttcagccattccactcctatatatttatcaatgtgtaatgaaaacaaattcacataaaagcccgtagtctaggcaaatgttttagcagctttacttataatctccaaaacctggaaacaaccaagacatctttctttttttttttttcttttttgagacggagtctcgcactgtcacccaggctggagtgcaatgtcacgatcttggctcactgcaacctccgcctcccaggttcaaggaattcttctgcctcagcttcccaagtagctgggaatacaggcacccaccaccatgcctggctaattttttgtatttttaatagagacagggtttcactatgttggccaggctggtctcgaactcctgacctcatgatctgcccgccttggcctcccaaagtgctgggattataggcatgagccaccacacccagcctaaccaacacatcttacaacaggtgaacagatagactattgcatcaataccatcaactgctattcagcaatacaaaggaacagactattcacttacacaacagtacagatgaacttacatgtgttttgctgtgtgaaagaagtcagccccaaatgtctacatattgtatgatttcattcgtataacattccggagaaggcaaaattataggtcaagaaaacagatcagagtttgcccacaattgggagaaagggaagggttgatcacaaaggcatcacacacagaattttagggtgatgcggctgttctgtgcagtgctggagggtggacacgtgtctctatggtttctcaaaccctaccaaatgctacactacaaaacctctttcttattttttgcaaaataaaaataataataaaaaaatccaccaggaagtcagaggattccaagaggaaaaagaaactgatcaaagacactttggaaaatggtattttgattggatactctaaggttaagaccaaacaagctgcatagaaacactccactttggttggtaattttgtttatcacaggggcaaatgataattttgacaccaggctagaaaaaataagtaagtaagttgcagataatgtgagctagagtttttactgttatgaaatgactttttcttgtagtgttgagaatgtttctttttttttcccaatcatgtgttaattctccccaggattctcaccaacctattcaagtatattttaaaatacttatgattttaagacaaaaacacatgtgttttcagcccagttggagaagcctcattactatcacatcctttgtgttctaaatgaaagtctgcacgtaaaacaacaaaggagcatgggaagtgttggaaaaatataataaggaagacagactccctggggaatgacacagtggtatgttccttgggtctcctgttcttctcatctgccctggagagagtgctgcagaagcctccaaccagaaaccacacccaacaaaaccaaacctaataaaaccccagctgtctcagccaaagaacctggaaaataatggcctagcaaggaatacccacctgagtgtagccaaacatcaatggaaaccccctctgcgaacaccatagttcagtgaaatcaagtgtggagctgatgatccacttcacttacacagagtggaaggaatcagcagtgctctgattcccttgccggatggtgtcagtggggccaagaagggagataaatcttctgtctcccacattgcaaaagaaggtggcattctggtatttccattttttttttttttttttttgagacggagtctcgctctgtcgcccagcctggagtgcagtggcgcgatctcagctcactgcaagttccacctcccgggttcacgccattctcctgcctcag[177 bp omitted]ggcctacagttatcttaaatataaattgtgtacatgtgtcaattaaaacacaaggaatatcaacctgaacacggaaacacgatacaaaaatacgtacgttacttatctcaattgatgcagaaagagcatttgccaaaatatagcacagttttatgataaaaactttcagaaacctagaaatacaaggaaacttcctgaactttatcaagagtatttatcaaaaacaaacagctatgtcatgcttaatgatgaaagaatgaatggttttcccctcagggtggaaacaaggcagagacacctgctctcaacaatgctatttgacagagcaccgaaagttctagtcggcacaattgggcaagaaacaaggcatactgattgaaaaaaaagagaaagaaggaaagtggcctctattgcagattacacgattgtctttgtaaagtctcagagaaactaaaaaaagtcttgtagaaataatatttagcaagttcacaggataaatgatccatcctccaaaattcatcatatttctatgaactaaaaatgaatgtgtggaaactgaatatacctttacaattgctctaaagaaaatacttaggcataaatctgacaagacatgcagaatcaagatggcaaaaattacaaaatgtgcatgaattgagagaagaactaaaattcaaacataccttattaatggtttggaagactcacgatagcaaatatgtcaactctcttcaaattgatgggtagacttaatgacagtcatatcaaaacaccagctacatatttttatgcatatagataaacctattttaagtttatatgaaaaggcacatgatactggtggagagatggacacataggtcagcagaacagaatgaagaactcagaaattgacacaagtaaatatgcccaactcatttctcatttttgacaatggtacaaaagtaattgaaagagaaagaatagtctttttaacaaatgttactggagaaaataaacacaggctcaaaatctcagtgtaaaccttgcactttatacactaattaactagaaatggtttgcaaacttaaatataaaaggttgtactataaaccttttaggaaaagagttctaaagaagttattgggatctagggctagataaaagtcctttgttcttatttacatgtatcttttaatttttttttattttcagtaaaagatcaatgtgtacgtgtacttattctaaaaaagaaaaaatgttcaatgtgctcttccaggttaatagacaaatcaaatagactcacctttctttatgaacccatagtgtatcagtgatccagccattattgttttcctgagaggaaaattctctttatgctcatcacacttttggagcattgaaccagagggcctaacgtgaggtgaacacgctgccagtggaggtgagcaggaaggaaatttccaaacccaagaactgacagaaactgctggagagagaaagttacttgggcaagtctagagaccaattgcgttgtgcccttctctgtagaataataaaaacggagtattcaagaaaaaaaataggacaagtgatactaaccaaatgatgttacaacacacccatgtctgtatgtgtatacagacctatgcacatatacacacatagatatgtgtaatatgtgtgtatttataactgaggttaaactgttaggcaataagaatgcagtcctatttttctaccctctcttttctaacatctttcaaacagatgatgttttgtaagattttcaattattttcaataattaaaaaaatttcaaacagaacaaatatgcatgctgaattatttctcaatcccctgttttacatgtggctttaagtacgtgacctgttatatagatatttcagcatcttagatgttaaagtaaacacatagctgctcctcatttttggaagggtgtatttacaatatatgtgtctgatgcaagttgtatatttaaattacttaaaaatacatcttctttggtaagagtttttaaaaataaatttgtggcacattagaatgtttttaagaaaaattgctttttaatttgtattatctaaacttcagaattttactctgaagtatttcaaaacttacaagaatattcatatttgatctataaaataagtaacttagatggaataatttgaatttggaaatttctttataccactaaatttgaagtatcaatgccacatttatttttacaaattttccttgaaacattatattggctactggaaagagctaataccctttatgaaaatatgattttagtgatgcaacttatatatgaggtagattaggaagctttacttcctgtgcccattaactaagaagattttatgaaacaatttttaacaggggccacagtcagtaccgggagtgtggtcaggtggtgaggcacgcctccctcctcattgggcccaccagaagatttcagggttctaggagaaacatacccaggcatgcagagattgtcacaagggaggaagggccagggtggggaacccagcacagggggcctgccctcacaggggagtcggacaaggttttctgaggaagctgtgtccaagccgagatccttcccgctccatgtgctccagcacaaggcctgcaggaggagccctgtgagcaaggccaacctagaccagccgggtggattcccttggcattgagggggagcatggcctgaggagctgagcgcggtctccgaaggacggcatcagaggaactctcaccgtttctatcatgaacacttacagtttgacatcagcatgggagttgtgattgggtgatcttgggaagggtctgtcagcgggtcggggggtcgctctaagttggacgctgtctgatagaggaggcttttctattgttcggcatctcatatctcaaggaatcttatctagaagagggcagagggccgccaggagaaagccgctgctggtaatgaggaagatgctgctcattttcaccaagtgcagtgctagggattttagcgggtggcaaagtgaccttgatatcttttctctgtgcaggtctctgttagagtcactgtgagtgtctctgtggggatctctgtgttggttttgaagggtctccgtgtgcgtctctgtcagaggtttctgtgggggggtccctctggggggtcttcatgggggggggtctcagtgttggggtctctgggggtcactgtggggaatctctgaaatctcaatgaatgtggggtctttgtgggaatctttgcgtgttggggtctaccgggggtccctgtggggttcctctgctgcaggtcacaggatcctgggtcccatagatgttgggcccacactggagctgcccaggtcaccaccccagacaggacttggctccaacagtagcctggacacccaaagtgacaccagggcgtgttcgaaacaggtccccggtgtgggtcccgccaggcctgggtacagacctgacaccttgtcctcagcctctgcagcccctgcaggtgcagagctctccctgggcagaaggcccctgggcagagccctctgaggaactggctcctgcctgccctgcccttgctcctgccttccctggggatggccaggaaggacccagtaccaggacgaagggagtgcaggactgggccctgtggggactgtccctgccaaccatgtgaccagattctctgagccccaatgtgtcccttgccagcacctgggcctggaaccatagatgtgctttgtaacccaggccagcccttgccttctgggtccccctcccctggcagtggcactgaccacttttgcttgtaatggtcaccagactgcaaggaccctggttacagctgtgggcagcttgtggatcctgcacttgcaaacttatgctcgtcttccctgattcttctcccacctctcaccctgggccccaaggtctcctcctgtgattcctgaccacagagtcctgccagaggggcaggcagcagccctaggtgcctcctgaaacagacaccccacactagtgggctgggagactgccctggagagtgaggcaggggacaccagacatgaacccaggggtgttatcaagcctgagccaagtgctggaggggcccaggtccatcccagatccggaactcagcagtcaggaaagggtctggggagggtgtcatctcttccccaccaggagatcccagaaagagcagtcccccctctgacccagggccagcacaagacaccccctacattcccaggctactgtgaggcagggaggctgctgggatccatcactcctccagcctgaggggagcctaccaccccccagtccgtgacgcccctgtagacccatcccctacagcagcacagaagtcgccttagaacagggaatgcagtgagccagagcccgggtgggatctccgtaagtttgctgtccttacatatcctgaaggctctgggtcatgatccagtttggaaaccagacacagtgtggggacagggagaaaagggggtcctccaggtccctgtcagcttcctctaggcccagccattctggaagccgcactcaggaggagctgacactgagcccttgcctgcagcctagcatggaacagacagaagccaccacctctgcagggaaaacaggtatattgggaacttctccgtggaagtcaggaacacatggggactgttgtcacccacgcaggacaggtttgttgtgtaggcgtccagtgttatttggatagaaccccctgtctcctccaggagaggtgtgggaagcctggtctggttcaggaggcaagacacctctgtgtagacctcagttcctgcagctgtggatggggctgcccgaggtgcttgccactcatggcctgtggtggtggggaccagctggggacacaagctccctgggaggtgggggcccaactgctgtctctgtctctgatgcccttgtttttgacaggacatttgtggcccttgggggtggctttggggctgcagaccagccccatctctctgctatgttcctggtagtagtgactcctgtggcagcaggaaggcacattctcctgggcgtggaggtcgcctttgtggcgactgacctctgagggaccacgtccctgctgaatccccagtttgtccaccaggatttgccccataactctgatgatggtctgggcttcatcagccatgctgtccataaacaaccttgctgggccagacccccagctctggacagcatctgcccaggcttgcctttctgcaggacgtcttcctgccctgagcccctcttcctgggatgtagaccctgtggacggtgactgatctttctctggaagttgctttctggtggtgcctgtcccttctctggctgaggctgattgtatttcctttcttgtttgtctcctatttccctcgtgtgggcagggtggctcctcccactggcttgggaggtcctgggtcctttggacctgtgtccctgctcccctggtctgggcctcctgtgggccttgcccttgtccaaagagcccagcatcttctgactcttctgtggggccttcacttttgggctcccaggttcctgctgccccagtctgtcccctcccttccataggagggcacatggcccctgggaagctgtcgtgttcctcctactgagcacactctgggaggtggacagaggggcctaagtgggtggcctgtatgtggctgggagcatgtccacatggcggcctggaaggcacaggcctgtggcgccctcctggaggaggatgctggaaacacggcctggcagctgctcctctgagtccacctgcactatgagcgcaatctcactgacaacctgtgctttcaggcacagctgccctggatcctgagcaacacagattgtagacactgaggggttactagtggtccccagagtccctgtgctcctcagatccacctgaacacttcctgatcttgccctcacactggctcccaaggtgactttccaatcagggggcttttcctccttggcctccagtgcctccagggcatctctggcccttgcccactgggaccccatgctgagctcttgcagggctctgctatgacaggggtctcctggggacatgctctcagtctcaagccatgcctcattcccagccatttctgaacccacactcccctcgagtctgggtttcccggaccccaggacagtccctctctgccaggttctgcctacaaggttgcatatgggggactgagaagatgccctgccctcctgtccagtcagagaggcctctgattgctcatgggtgtcagctgactgggaccctcttgggaccctctggacttcctcctgctcagttggtggggcagggacagggccactcatggtgggggctgacttgcttgttgttctattgtctcctggaccattctggggaggttttcccgacaaaatggcaaccttggctacagattcagccagagattcccaggaggcccaggggagaatggtggagtgtgggaggggtggaggctgagcctcccctgactagacatttatgggctctaaggactgaagttctggaccccacctgtgcctcacacagaacttgaaaagatgtgcttccagcatctgctgggtgcagggatggaggaaggacagctcctgggaggtgttcacgtgggctttcccacccctccaggatgtcacctttctcgatttcctgtgggtgtcagacttgggaatggcatgtttggccatgaattaggagcgatgcacagacacagggatccagccctccttgatctcccccaccttcctgtccagatggacctgtggcttgttttccagatgctgcttttctgggtccctgggtgcagaacttactgattggtacttccagggcctcctgaaatcaccttctgcttcctccttgtctttctccagaaccttcactgaagtccttcctgagccttgatcctggttctggctctagtttggaccctaagcaccccttcccagagaaccttccagagctcctgagccctgctttctgcacatccttcgtgccctttcctacaaattcagaatcccgggagggcaagagggccccctgcgtggcttctgcctgactctggggcctccctgggaattcccccttaggctgcagcaggtctccaggtgccttgaatctgctgggaggccacgggactgctcctggtggatggcactccttccttgccaccggtgctctgggagctcagggctggtggcaatcccgggaaggatgggggctgacttagggttcagggaggctggcctctcctggggaaggtgggaagtgggctggctcaggacagcctgagactttttgaggagagagggcaaaaccctcttccactttggtcatttctgcaagggccactcaagatacttttttccagtggggatgacagactgtgccctcttctgggatgtagggcaagatgctccacagaccctaatctggggtggagaagaggttgggacaggggttgagatttgccccactgtgtctggatcccagctagaggcgggggctgggactggggccaggttggagtgaaaggttggggctgggccacgtggtggggctggggccgtgcctgggaaagctgtgagggtgtctcaacctcagtttcacctggaagggaagtggaggctttatccgatggtacagagtgctcattctgtgaggaaatgttcctagaaacccaggccatggtcaccagggactcgctattgaaagaggggagatcccagaagagatggctgcatttctgctctaagtggtcccacatggccatggcgtcagagacctgctgaggatggggcagcttctgtggtaggtttgccacgttccagaagggatttagagtcgtgatgtcccactccttccccagtgatgtcatctgcgggtagtctgcccacccccattctttctcctgccacatcttcatcactgctctcttggagatgagtctccagcagcttctgcacgttgggatggaagaatgtgcggccacctgcctccatctgcctgggtgtggggtctccccagaaggaagcctctggggggtggttgggaagatgctgttgctgggatttgccctgtgagcaggtggagaggccccaggtggtggcagcctccctccagcgggagaggtcccggatgggaccgctggagcacccaaggccagagatcaccctggttggagaaggtggcccctggttgtgtagaggggagctctgggggacagggcgtattgtggagccacactgaagtccagccaggctgtgttcgggtggaggtggagaggaggccacgggaacatggggctgtggtgaagaaggaaaagcatatgtggccggactgcagggcattttaggggaagcaagggctctggaggcctggaggcactcagggttgagcgtggtccaaaaggctctgagaaggtcattgtgtctggtgacaggttggaggccagaggaactgggggagtccttggggacaagctgtcaggagatggatcttgcatgcatttcctatgcggctggtgggccttagcaggagctggtttgtacatatcacccagggctctccacctaagggcagatgggagccaccctccccagtgagctttctcaggtggctgcacaaggcacaagctgcagccaggggcaggtggggttgggaggtcgggagggctgggcacctggtgcccacagctcctccacctccgccactgctggcttcacagagctctgtctgtgcctgcccagggcttcagtccactcccgcctcttcccaggacctccccctcccaggtcaacactggaccctggggctgcctcagaggccctggtagaaaggacgacatggagagaaggggaatctcatctttccagaaggttggtcaggtcctgagtctcctccagctccctcaggaggattctgcaagctggaagtaaggagacagagttatggcggggagggcggtgccagcgaacctcatgggaggctgagtggtggatgtctctttaggggacaccatggggaactagaccctgaagcccatgcatctgtgtccaaggccacatggccccaatggtgacagcaaggtgtgcattgtgcagaactttgtcatttgcaaaaagtgcttccatgtacaacccctcatgggtgtcacaaccatcttgtggggagagtggatggggtggtctctaagaagagtcagccatggccgaggagaacagctgtccacgtggacctggggtctccctgacctccccccatatcctggcaggccttggtcccttccccacagcgcccccttatgggcaataccggttcccgggcccatggcttcattcccacagggaatatgaggaggccccgggttctgatttccctcccaggagcttccctctcaggcctctgcaaatgattccctcagggacagacgatgctcagtcacctctggggagtctcagggattagtagggcctcacaattcagagctgggatcttcttcctgctcctgggcctcccctatctcttcctttgatgccgagaggcaagcaagggtgaggggctgggaccagttctcagtctcctcttcccagaccagctgcacacacgcagtgctcttgaaggacacggctttctgcctgtagctcagggagctctgcgtgcgtttcttttactcatgtttaccattgatgaaatgttttctgttttccttcttagggaaatgcaagcaggggttttctgtgtgactccaccctggatatccccagtccctgctcctccgctgaaggcatacccaggctcaggcctacaggcacctctgagctgccagtaggattctgcttcagaggaggccagacgtgaatccaggctctagcgggaggctctcaggggttcagcacagctcccagatcaccccacacagaggagcctggacccccaggcacctgccttggaaaggggctgatgagccagagctggggcctgtcctcccacagagacctcacccctctcctgatctggtcctcgccactgagtccagtgttgggttttgccctgatgcctcccgcgcatgtcacagatagtctgggagctgaggatggaatcctctgcccactcccacccctgcctgctctgcccttccctagagggatgatgagatttcccatcgcaggagagtctctcattacttaggaaaagtggaaatgaggggaggaaaagaagagagaatctttctctgtggggctgggctgagggctccttaccttcctgctgctcctcttcctcccatgcgggggtgagggtgggacactggggaggtagggggctaataggaagaggaagcccaggctccacactgaggtgaggatgaaatccacaatccagggagtggagctggggcccagccacgtggcactagggctcttcagaggaaagagcattttttccatctgaagtgcaatgttgccctcaagcaactgagccctgggcatcgcttttgggactagggactggagcccaggcctgcatcacagagctggggcctcctcctcaccaagggctcctgggggcaggggaggggcagtgggaggaggaggctgaagcgcagcccctccttcaggtcccagttccagtccctccaccctcctgggtcccccagatctttccttcccactccagttgctcaccctgtcagagacagccctgggtccattttctattctgttccctggaacacagatgttacctggttttgtggagatctctgtgccagtccctcaatctcctgcatctttaaatctagacttctccctggagtttctgttatttctccagtttcttgctcttaggaactcatttgtttgcagttctaactttcccccttaatatgttcttgccctgcatcaactcagacatagaatttacattttttgtacttattgatcgttgtgaattttgattacaattttcatagttttttaaaagtttaatatttatttttgtgggcacacagtaggtgtatatgttaatggggcacatgagatactttcatacaggcatgcagtgtgtaataatcacagcatggtaaatggggtgtccatcacctcaagcctttttcctttgtgttacaaaccatccaattatactccttattttttaaatgaacaattaaattattattgactataggcattctattgctgtcaaatactacaaatacccagttttattcattctttctaattaccttctttatccattaaccatccccgtctctctccccctgtgccttcccagcctctagtaaccatccttctactctgtatctccatgagtttgactgtttaatttttagctctcacaagagagaacatgtgatgtttgttagtctttctttgcctgatttcacttaatgacctccagttctatccatgctattgcaaatgataggctctcattgtttttttatggctgaagagcactccactgcttatatgtaccaccttttctttatcctttcatctgttgatggacactcactaggttgattcctaatcttggctattgtgaacagtgctagaaggaacatgggagtgcaagtatcccttcaatatactgatttcctttcttctgggtgtgtacccagcagtgggattgctggatcatgaggtagctctagttttagtttttgaggaacctcctaactgttctccatagaagttgtactgactcacatttccaccaacagtgtatgagggttcccttcacatcctcgccagcatttgccattgtctgtcttttggatgaaagccattttaactggggcgagatgagatctccttgtagttttgattacctttctctgatatcattgatgttgagcaccttttcatatacctgtttgccattcatatgtcttcttttgagaaatgtctgttcacatcttttgtgtattttttattattttattttaacttccggggtacatgtgcaggatgtgcaggtttgttacataggtaaatgtgtgccatggtggtttgctgtacctatcaacccatcacataggtattaagccccgtatgcattagttatttttcctgatgctctctcctgcttctgacaggccccacagtgtgttgttcccctacctgtgtgcatgtgttccctttggtcagctcccacttataagtgagaacgtgtggtgtttggttttctgttcctgtgttagtttgctgaggataatggcttccagcttcattcatgtccctgcaaaggacataatctcattcttttttatggctgcataatattccatgttgtctatgcaccacattttctttatccagtctatcaccgatgggcatttgggttgattccatgtctttgcttctgtgaatagtgctgcaatgaatatataagtgcattcatctttataacagaataatttatattctttgggtacatacccagtaatgggattgctgggtcaaatagtatttcccattctaaatctttgaggaatcgccacaatgtctgccacaatggttgaactaatttacattcctgccaacagtgtaaaattgtttctatttctccccaacctcaccagcatcagttgtttcttgactttttaataattgccattttgactggcatgtgatggtatctcattgtggttttgatttccatttgtctaacaatcagtgatgttgagcttttttccttatgtttgttggctgcatctatgtcttcttttgagaagtgtttgttcatgtcctttgcccactttttaatggggtcttttgttttcttcttgtaaatttccttaaattccctgtagattctggatattggacctttgtcagatggatacattgcaaaaattttctcccattctgtaggttgtctgttcactctgatgatagtttctttgctgcgtgaaactctttagtttaattagttcccatttgtcaatttttgcttttattacaattgcttttggcgatttcaacataaaatatatgcccatgactatgacctgaatggtattgcctacatttttttctagggtttttatagttttggcttttacatttaagactttactttatcttgagttagtttttgtatagggtgtaaggaaaagatccagtttcagttttctgtgtatagctagccagttttcacaccatttattaaataggaaatcctttccccattgcttgtttttgtcaggtttgttgtcttgcctagaggttacacactgaattaccatttggagatcatccattcccacctggtgtggatcaaagataacaggggccaacaggagaaagtttgagccttgccaggtcaacactggtgctgaacaaagtgacttgcgtctgttttgctacatgtattttgctttggctgggatggaaaatattaatttgattccccatgcagcctgttgagcagcatcttgcaaaattgggaagcttatgcctatggttccatcaaacagaaaagcataattttattttgtaatggaacttggctcccatagctatgttacactgagcaaggtcatcaaagctgctctgttcttctgaaagctgcagagaaagggaacccagaaacctggtatgctggcgaaaaaagggtaagaaattcttaccaaccaagtttctcatatttctctctctctccctgtctctctccctccctctccctctgtgtgtttgtgtgtgtgcgtgtgaatgcaaatggtaaatatcactgtttgtcttctctcctctgttttctcttttctacaaatagaaaaaaggatttgtgagactagtcttaggctgtagcaaatctggagcactttgtgctaagaatttatctttctgctttgttctttaatggagagagaggtatcacaggagagaaggtgggcttaggacccctataagcctgcctttcaagccagcctggcagctggtcatttacaaactttgctgggggtccccaagaccagtgccatataaagtttccatcttttcgttttatgcccttgagagcttaaccttgtgaccatgtggggatactttctcttggtgtctgccattcagcggacaggaatttggggattcatgtcatagcactaaaaattatcttgagcaggtagaagcttttgcaaggtcaaaattggcacctctaggctccttctgggaagagcaacagaacctgctgaatgatgtagctcaataaccaaggcttttgtcttttgacagtggctgccccaggttcaattcttggctttgggaatgattcccttcttgtttgttatttgtgtaactgccattttttgagggattcccccctttctatggataatttctgatttcctgtcttgaattttcctttctgtgaactaccctggggaaattctaactcttgtttaaaaaaaactacttaccatctctttgaaacacatcatgagttcatggttaagttataaccttagttaaaacttattaatttcatgtgagaggttacctggtatagaattcaaaagccagaaatgtggggtgtcctcactagagcctggtaataagggattttgaaagtttttttttttttttaaacagcagagctctatggttaaaagtggcttaattaaaaatagacatccagggttgggtggggtaaccctagatatctattttcatgcctgtaatcccagtacttcagaaggccaaagcaggaggattgcttcagcaggagtttgagacaagcctggaaaacatagaccacatcttaaaattaaataaataaataaataaaagtacccaaactatatctatttaaaaggcctttatcttttcctcttctagattcatgtctttctggaataagttcttttcttctgaattgattttctccattttttcttcttgccatgcttaaagcacacctgagagaacctagataaattctaacagcctgggactcatagggaaaaacagaggaggcatcacagaccccattctgggaaaaacctccattttcctcatgaaaccccaggagctgaaagttgatagatctccctcaaaatctaagtctcggttcaattttcaattttacattatgttacctgactttttttgttttttttttttacttttgggtatatcagaaattgcttcacattatgggagagcttttagccatggtttataataaccagataggaaatacactataagggactgctaatggcaattaggaggaatacttggctccttgcatgcttggatcagagaagcacactcttgaccacctagaaggtatgaaaacatccctatcccccactgagagatgagaatcccatgggggatgggctgattacaaaatgggctgattggctttggattgtcttgcaataaaatgcagggtagaagcactgcactagcttcttctgtagtatttccctctttttggggggaatccaggatcccatataaaatggcacccttaatttgggggatctgtttttgccttccagctgtgcctgcttattaggccctagaaattgcaagctttcccagccctatttttcaaagggctccagcctgaatctagtaatcccactaggaaacttaagaactggcaaatgaaaaatcttacaactactggatcttctgtctgtctatgtatttatatatgttttgtgtgtgatgtttacataaaagctctaattaattggtttaaagaaaagtaggcacttaagtcaaatattttgtcagtaaaattaaaactaatgccctttagttcacctaactttagtaatcttttggtaataaagacagattaaaaattattgataaaataggctgggcacagtggctcacacctgtaatcccagcactttgggaggctgagctgggcagatcatgaggtcaggagatcaaggccatcctggctaacacggtgaaaccccatatctactaaaaatacaaaaaaattagccaggcgtggtggtgagcacctgcattcccagctactcgggaggctgaggcaggagaatgacgtgaaccctggaggcggagcttgcagtgagctgagactgcgccactgcacttcagcccgggtgacagagtgagattttgtctaaaaaaaaaaattggtaaaataaaatgtcttcaaaatttagacatttggtctaaattgggtctgatgttaggtttgctaaatgctttaagatcataaactgcttctttaacttttaaaaattgttcaatttacctagcttggagtcattactttctagataaggcccggtgacatgtgaaattagccccctagctgctcaaagaaggttaaaaagaaaagagattttgtataagaaaggatcttgtatggtaaatttttgtcctaaagtgaaatgactggttgttgaaatgaccgttgtccaagcatgtaatagatggtctaagccatgaaaggattcatgaaagggaatttatgcaagaaacgttgtacaatttaaaggttattaggctgcctaaatgcttcacaaacgccactgtgactcttaactatacacttacctgcgttactgctaggtaagtgctgggcatatgtggagatagccacattccatagctatgctggaaaaagtcagacttgatctgcacttctgtcctttgtctgtcctaagctccacacttggtacataattaaaatgtcctactaaccaggtttttcaccaaaaatagaagttgcacagagttaacagtgtaacatgtattgaggctactgaagaaacatttccacattcaaggcatgtaagaaaagtagaatgtacttttggtaaaagattataagaagacctgggaatatggatttctttcccaagtttagagggttattgttttaagtgagacagg[139 bp omitted]cctc[224 bp omitted]tgtaaaagagattctgtgtgtaaacatattggctaaagttaaaggggtattagtcaatgtttccataagttgaacattggaataaaagcataacagagttttcttaaaacatggttctgctctgtaacaacaacaactaaattgtaaagggttataaaaggtttataagaacattaacttatggtcaaactaattaaaactggatagatttataaaattttaataaaaactagctttagcattaaaggtgcaataatgcaaacatgaaatttggttttctcttttgaaaaagattcttgtgtaatattgagaagcaatgaaaaaattttgtttgccttttaagggaggggagagagaagtgaccaattcaggggacggcttcactgggtcttgtagtttgagaagctgagtctcttttctatcaaactaaaggttttttcctttttaaaactttgtgagttatcattttggctaaataactgacttatggtgacctggcattctattttgtgacatccagtgttttaaaccatatttgacaaacctgacaagatcaaattagaagttaaacaaaaataggtcccctacagtccaaaaagatataatctgcttatttaatgtattaaaatcatgcagaaaacatggccaaatataaaatgatgtttaactttctttgggttatattcatataaatacgttattagcatgtgtttcaaaactgtataagattcttataagtttgatatgccttagcatatgttatcagtaataattataattgatacattaaattattgtgtgccacagaggttaaaaattttcttgttttataatcagctatgaaacttggatgggtgctcttgaatgcaagtttctgatagctttggagattgcaacattagaataaaggaaaaaacgttcaggactctcatggagagctgacttgttcaggaacattaagcagaacaagagtttactgaatggaatgaactaatagaaaactgaactaatcttttccttttttttttttgcttaaaatgtggctgttccttttcatttttcagagagccaagaaaacttttcttttgattacagcttttaacaactgagaaaaatatactcctgtgaacaaaatttggagcatgtttgtttctctctacctgatttctcaagaatctggaagctatttgcaagtattcttaatttatggcaacataattatttgcataagtgcaataagaatgttttcttttgcaacaggacacaattggagaaactgtttattttactaaggttttgactgggatggcatgcttttgtttaaggaatcaaacttgatttacaaagccaataaaaacccctagggtaaactggcctcataccttgtctacgcagtccctgtacagggttcctaacgtatggtaagtaaagaatgtcactttccaaaaggccccggaatcttaagttatcttgggatctcaagaagaggggaatgtacccaactcataggcatttgagggtacaaacccatggctgggatgggctttaaaaaaagtctatctaagactctttatgcagagttccatcaaagccaacttaaaaggcccatgtgaaaaataattattcttgctgtgctctttgcaaataatcatgccaagtataataaaattaaagtttatttcacaaacaaaatcggtcctatcaggatttgtttttaataaaaataagaactgaagagagaaaaaattgtttcaaaaactacagtacacctgttgttagttgtttttgaggatttttttttctgccatttagactgaatcctaaattttgggaggctacaagtgctcaaactaatgcttttaagtctttacttttaaaactgggaatggcactccttgttccggaactcattacttaccttattgtacactgtttgtgtaaatgtcgtactaaaactgtagatgagaatacgaatgcctttgtcatgaaagccttggaagctcagcctggcctgcgtgagtacactcaaacagctcagacagctgcaaagcagttccactcctctcaccttggggtcaacacctaccccactatgccccctgtctgcaggaagaatccagagtgatcgacggccttttcccatcttcatagcccacaccttaagaataaggtgctatgaaaccctaagggagggattgaaacagcctttgcaaaaattataactgagaaaataatgacagtgaaagagatcagacctaaccgactccatcttgcttctaacctttaagctgtccttgttcattcctgggcataggccgaactaacctcgggaaggaatttgcagaccctgcactccatggatcagctgacaccgcctagactggtaatctggctcaatcagttctgagatcctacccaggaacagaagatagcaaggaaacctcacttcgaccccctatgattccatctccaacttgatcaatcagcactccccacttctctagcccctacccgtcaaattgtctctaaaaacttaagctgagcacggtggcttacgcctgtaattccagcactttgggaggccgaggcgggcggatcacgaggtgaggatttggagagcagcctggccaacataatgaaacaccgtctctactaaaaatacaaaaaaacagctaagcgtggtggcgggcacctgtaatcccagctacttggaaggctgaggcaggagaatcgcttgaaccctggaggcagaagttgcagtgagctgagatcacaccattgcactccagcccaggcaatagtgcgaggctccatcttaaaacaaaacaaaacaaatgctcaagaagtctgatttgaataataatgaaactctggtcttccgcaaaaataaagtaaaaatacaggtaagttaattctaataaggtctattgttacaaagtctttttgagtttctatacagcagaacaatattacaagacagaaccttcaaaaaccacttcattgcaactctgagtccctaaggaaaagagaaaaaaatgtggaaaaatcaaacgcttttttaatggcacagaggtcattgttttcttctataattgcaacagcaaaatctagatatctgggtatatatacatgtatatgtgttttttacattttagatagcatgccattctccattttatgaaaatttcatatagaatacatatatttgaaatatgaactgaaaaacattaagcattaataaagaaaataatgaacatctcctactggaataacttaccattattgtttttatatttatcaacagctctagaactttaacatggacatatataaaagtgaccacttccttagaattccattttgagttctcgttttgt[137 bp omitted]tgcctcagcctcctgagtagctgggattacaggcgtctgccaccgcgcccggctaatgtttgtattttttttaggtttcaccatgttggccaggctggtgatttcccgttttgaaaagtaaaggtttcagccgaacggagacctactttctgctgtgtcacatcgccctctggtggctaaatggctttcttacacagtaaccccaaataataactatcatataaaagaactttttaaaaaatcgtgataacattaaaatgattagaaatatataactcataagcaaagtcacagcactatgatatttacatgtttatcacacgtcaaatacatttaaatattttgtgatgtgtgaatcttcacattcctgaaccacctataaagttccatttcccaaggttaaattgaggcaggatttttaaagacttttaactagctaacagagaaaaatgtacaatttccattaacctccccagtgacaagctttctcaagacccagcgagg[139 bp omitted]cctcagcctctcgagtagctgggactacaggcgcccgccacca[175 bp omitted]tgtataaaagctatacgtgttcatcttagaaaatttagaaatgacagaatttgattttgcttattctaaatcccttgggattatttccagtatagatggcagtgaggaaggaataatttcaggacactggctttcttcttccacaagaccccagctgggcaaagggaactggatggccttgggcctgtggccccagtgcaccctcctctggggcctgtacctggctctggatagtaatccccactgcagaatggaagaggctgctcccacataagccattgagtccagactccagaaacctgggtccgtgcagtactcaaaaaggaaagtaccgaccacccagaccagagctggcaagaaggcgaaatgggattgattcattcattcaacaaatactcgctgagctccagccgaatgctaggcaccatgttcaggatagagatgattgatgtaatccctggccttggcagtttggggtaaagagctatcatcactgctgacttcataacaatcacatgccttcagagataaagtgaacactcacttctaacaaagcaaaaataagaagaaaaagaaatgcacactcccgatttctttgtccaaagtggtatgactgggtgatttgtgaccttcccatttgcatgcccgattgccaaaaagcatggcaattaccccacacacctttactcatcccaaactaactatgctgaaaacactgcacaatggagatttcctttatgcctgctcaggcctaacagttccatattcactggcctggctgtcttctccaagctgaaagaggcagagccattaccagtatttttcttggaagggcaggaagtaaaaacacatctgagtaacactcaagaaaatattgtttatgtccaagatgatgaattaatctttttttattctctctttctcttttttttttttttgagacagtctttctctggcacccaggttggagtgcagtggcatgatcacagctcactacatccttgacctcccaagttcaagccatcctccatcagtctccagagttgctgggactacaggtgcaccttgcctggataaattttttattctttgtagaaatgggggctcactatattgcccaggctgcatctttattctttcatcccatcctcaactaaagtcatgttactgtaatagaagtgaaataccatagccccgtgtgcctcagcaggcaggggctgtcagcactcttcatattgctgagcatttcaaagctgtgttggcagctgttccacagtcgacttcagggtccctgagatgattggctcttggagatgatccagcagggttctggtagctgagctcatccaccaagtccacactggcagtgaaaatggcttctgggcttggggctttctgggcccagccccagggcagactgagtcaacacacgaaggacagccttctgcacccacagcagacaggggaggggcaaagggagacacgcggtcccagtggggcagggaggctagaacacggccacaccctttgcgagccacaaacatttttgctgagcacaaaattctctccagctgggcagacagaggaaaaaagcaaaatgaatgagtagagcacgtggcacatcatcagggagttccatggaggaaagtggagcaggtgaagggcaggacgagggacatggagtgccagctaggggcttgagaaagtgatggcaagagctatgtaaggctgacattgggatatggttctgaagggagtgaggatggtgacgtggctgtgtgtggaaagggaatgtcaggcgggggtgacagcagggataaatgcctggagagcatggctgtgtgtggaaagggaatgtcaggccggggtgacagcagggataaatgcctggagagcagagtggcccgctatttcccaggaggaaggacctgtggctcaagtgtcaatgaaagtgagcggagagggctgaagtcggggtaacagggccagcctgtgtgcagccccctggatgtgggtgagggagttgtctctgccgtgtgagaggaacagccacaggagggctttcaggagagcgcatggtgtgaggtttttcagactcactgtggctactgtgggaagagtgttttaggtgcctcccctttaccccactgggtgagcagggtttctgccctaggcctagggggatggctgcacacacacgcacgacacttgacagaggagatgagcactggcttattagccacatagacagactcataccccgaggaggagaaccccaggccatgcagggggaatccgcgggaatgaacagccctgagctcaggagagggt[132 bp omitted]agaaacccggtctcaactaaaaacacaaaaaaattagccatgtgtgatggtgcatgcctgttatcccaggtattcgggaggctgaggcatgagaatcacttcaacctggggggcagagattgcagtgagctgagatcacaccactgcactccagcctgggtgacagagtgagactgtgtctcaaaaaaaaagaaaatgcatgccgtcaagtccgctcgtgccgagatgaggtgtctccagttgtccagcatcacatcgcggtacagggtcctctgaacagggcccaagcgctgccaatcctcctggcggacccccagccacgtccttgaatgacactgatacctgtaattgtgcatttctcagcactttgggggttcggaaacagggacatggaaaacacatttgggatgtgattcctactatgtttattgttgcaaatctaaacaagttactgtaaggtatgcctattttagttctagttttgccttacgcttttggggtaactcaagcagtaaacatattttgaacatcgtaactcatttgtacatgagcgtgcattagatacatatactatcatgtactaagctaacactagtattgttttaaaaaattcttatttaggtgaaaatcagtgtaattagagttttcacaatttcctttccacactttaaaagatcatcttgggcattccctgggctgtacacaccctccttgaagatcctgctgtggctactggggagtctgtaaagtgatccatgtaaggcctgaatgtgctgtatcagacttatgtcaaagaagcaatgcttcagaagagtggacggtggctgaaggggaagccagaaccagagacctgaaaaagagatgaccgccttcactaaagcaacagcaatggggaaaggaatcggggactagtcccatggcagaagccgcaacggaatttgtcatccatttcttgagtggcttccctgaatgagtagctgggtcaatgctggtgccatctatagtattaagggaaagatggcaaagtcagagtctataaatgaggattctacggcagttctggaccttgtggaactttatgtctaactggaaagatccagaaatggcagttttcactaatctgcgaagtgcagaggcaggggcagcacgggctctgaggactgagatgaggaaggacaagtggaaagagaagaggatcggttttgtggatgaggccatcagacttgactcatgacaaaccaggaggaatggagaagctgatggggcagggttcaaggtccatgcagccccagtgagagcatgaggtgaagctgtgtcagaacagcaggatgtgtccgggatttagtcgcacctgagaataaagttacatggtgaacttttctcatcactttccccagtggacagtaaaccccactgtgggaaacggcattttcagctgtaactgtgcagatgccacacccctgggcagtcctcactctgcaggctccgattctcacagcgcccagtgatgccagcaaaacactttatcaggagtgtccaatcttttggctttcctgggccacactggaagaagaactgtcttggactgcacataaaatacattaacactaacaaaagctgatgagctaaagaaaaaaaatgacaaaaaatacctcataatgttttaagaaagcttacaaatgtttgttgggcctcattcaaagctgtcctgggctgcatgcagcccgggggctgttggttggacatgaaggggattcttagagagatttcactgcactgaatgctcacagtttatttacataacagttcaaactccagttatcactgtgccttcaaagtgcacacgtcgctcctagcacctctgcccaccagcctctacatgaacaccaggagcaagtggcgatcagtgaccaaccacaccactcccttcagaatctgcagggcccttccctccgcatgcacagctcggttcctgtacagacaacaccacgtgtagtcatcttgcttcttagattcctagtaataaaaccactcggaatgttacaaagataaaaactggaagagtggattggccaacaaagaggaaagtgcaggaaagaaaggaagagtgacagcctcggaagtaccattcagacctccaggaaagggcactgtggtgctgcctctgtgggtgctgacattgcactggtcaggaggtgcaccaagccaggctaggggccaccaagcctggcttttaatacatttttataaagaaataagcttgaactatcagtgtgtctaaagattttaaattacaatatatgaaataaatatcagttttcctgagtttcgttttcatgtgttcatatgaagacaatatgcaatggtaagagacatgttaacgtgtggataaaaaaattcaaaggttgcagaacactcatgattttctccactgattattaagatcactttatagttttggcttgcatggtcgttcttatagtcacagactactatgcgaagtgaggactatgtcgatataaggaaatctttgttggatagaagaacactaggagtttcaaaaggagacatgggaagaagtcatgtccccaaagtcctctatttggtactgagaagctactcacttcggtataaggagggggtgacagactttccagagggaggaggcattatctgagttcagacgaaagatgtgctgagcaggggaagagacaggtgacctggttcaggagagaaaacaaaactttgaaatatatttaagaatataaaaaactggccgggtgcggtggctcatgcctataatcccagcactttgggaggccaa[132 bp omitted]aggcgggagaattgcttgaatttggatggcagaggttgcagtgagccaagatcatgccactgcactccagcctgggtgacagagtaagactccgtctcagaaaaaaaaaaaaaaaaggatataaaaaactgatagttttgacctaaaaacagcaaaactagaaagacccaatgcccaactggatgtggcaggagctgagagggcgggagggtgggttagggtgacattgtccccagggagcagggggatgggtgtgatgtgggagccaccccaagccgtccggtgcctggccctggggtgaccaggtgagggaatcaatattcctgcaggataagagccacataaagaaggtagtggaggggggagcctataggagcagttaatttgcttgtgaaaggcgtgtttatcacctctaagaattagctggccctgggaggagcagtctttccccagccagagaggccccagatgccagagcaccaagaacacagaaataaataaaaacatgggtaacgtatttgtctgtagtcaagtcactggtgggtggaagccataggcaaatggtttccatttgtgataatggaatttccacgagagaaaatgcaccaccaaacagggatttggaacatgaatgataagcgtggaaacattttgcagagagcaggatcgtaagctgtcaagagacttgcagatcacaagtattactatcttaatggacatccattctccctccaggtattccagactttatccccgccagaggcaagaacatcataaagacatcgacctccacttctggaagccagtactgagctctggcttgccacactgccttcctcttccattgaagagccagcagggacagcagcctgtgtgagctcagggttgtcactgcaaggtggttgctacatgacttacacaaagacatttttcagatttcacttttctttttctctcacgaggaatcagttaggtttatgcttcttatcaatgcacatatttaaacacatagtatccctcatggccttggctatctggcctggcctggctatctgagctatgctcagaaatagctttgtaccaagagtaactgtgtatgtctacatgccaactttgccttgcaattgatcagttctatgttttctctggttaattggaccattggactacatttagacacacagaccttgaacccccctacagaagccattgtaaagcaaggtggttggttcctaaacagatcacctgaaaccttctcattttctgttgttctggaaggagtgaggaggacaggaaggtgtcacagagcggggaggaaggagaagtggagttgagtgagacctgaatggtcttaccgctcctacatcgcatccacatgcctgaaaccctggaccctgggccaggtgaagtcttccctggggtgtactcttccttggcccttgagccgaagcaggagggccccgtagaggcagcacagcctgtccacccacaacgctcatgagtatgtggactcacatttgtagttttgcagagagttaatgtcaactttgttgtccattgacttattaacaacttatttctcctttgcacggaaaaaattcagagaattgataatatagattacagtagccaaagaatgaaacaacatggtatagaaaaaatagccttattgtttggctgcattcccactagcgctgttgagacttgggagcaccaggcaagtctctgaaaaggggatgaggaagccgaaagcaagctgcattttgcttggctctaacttcctctgggttttcccagtgaatcttttgttatgaagtttctggtcatttactgcgacagagagaacagcagagccctgaattttcctcctggccctgttgtccacacatgggctatcttagatatattattcattctcaagatgtctttcacctttcaagctcagcacctttctccagaagcctgctcctctgtgctgtgtttctggcctcagtgagtgaggacagtcacccagccatcacgcgaggaactcagcggccatctgtgccttcatcttccttgcagtcagaggatcactaagtctcactgttcttctttaaagccctccccatttctgccctgaattactgcagccgcctccctgctctgccatccatctgggcattactgccagggtaatctttccgtatgtgagtgctgctgatattggttctccaaaaggactgctgtggctcctgtctccttcggggtgagattcgagccatggagcagcagcttcagcatccagtccatttgttgggtctcaggtcctccagttttccttggattctccttcctcaccaatccaccgcacacttcactccaaccacacaaaacacagttttcagaacaagccacactgcttcatgcctcccatcggggtctctcaatctccgtattatttatgctcggggctggagagctgtgttgtaggggcctggcctgtgtgctgtaggatgttagcagcaaacctggcctctacccaccacgtgccaatagcatacccaccccccagttttgataacaaaacacctttggacattaccaaatgtgccctgaaaaatcatccccagttgaaagcagttgctctttgcttttacaaatgctggtccttttacctggaataaccttcccttcatactgaactcctacccagtcatctcttcgaaacttcaacccagtcatcttcaaagcttcaaaagtcaacccagtcatctcttcttctctggtgacctccttgctcaggcacagccagagctaatccttattttcctggtgaagccagcattctttgtaatacctctaaaatcaagctcatctcactatactggagtcttttgcttgcaagtgtctttctttgcactggcctatgagtgtccaggagaaatggcagagatcatggcttctttgtgccctccttgtctggggtagatcctagcaaggcacacacctggggaaagtttgttcaaagaaggaactgaattcatcttattctctcatgttaatggcaattaaaacatgttcctttatggtgatgttgacaccaatattttgtgtttactaagataaactctaaaccaaaactggagcctaattttgcttctgaggttctgatttagaatgctaaaaggaaacaggtgtgaaagctaagcacttattctacaggtgggaatgtcaatgatggggaacaaaatcaaaattccttatggagcccaaccaagccgtcgtttcttctcatcataaaactgatcttagcggcatttatttagggtctaatatatgtcatgctatactaagatttaatgagatcactatctgatttcccaaatctttctgaaacaaatagattagcaaattctaccataaacttacacaaattggcatcaacttttgaaaagctggcatttgcacataaattactatttcatgatgactctatgtacaacagatgtctgatgtattctcccagctctagaatagtcaatagaggaataagaatatcaaaattattaagcaaatccagaaagtgaaatttttacccaggcaactggtcttatcccttcaaaaatcgatgtaaatcactagacaaggaaaacacgttaccaaacactaaagaattaatcctggaaaagggaaacatacaggtaaatataaaatacttttatcttgcttttcataattttttatgaaataatttacagtttaagcaaaaataacaaagcatgatggtgtttaggacgtatgtagaaacaaactgtatgaaagtatggctgtggcatgtcattgaaacatatacatatatgttttcatccacagttccttgttcataactctcatagcccttgtgacagtaaacagaatctctctctcacaccttctcctgcccttctttcccctgcccatggctggattctgtgggtcatgagaccctcattccaaagagggttttgtctcataacctggaggaaggaaggctacacagagaggccaagaagaatctgaacacacaggccttgctgggtttagaacccattttgtccaatcacatttccacagtcacccatgcttcaatcaggcctatccaacaaattccccatataaagacccaagaggacagggtttggaagcttctggagagctgaacacatgaagggtgactaaaaggtgaagaactcattcacgtgctgagagggtggtgctccctgaatccacatggacacaagctcctgcacctgggacccttcaaaatcttccagacctcatcctgtgtgtatctcttcatatggctgtccatccgtatcctttaaaatgtccttcataataaactggtaaacaacataagcatttccctgagttctgtgagccactccagcaaattaatcaaacccatagaggggattgtgggaagcccagcttgaagccagttgattagaaattccagaagcctggacttatgactggtgtctgggggtggggaagtggcagccttgcagaacgggccctctctttgtgggatctgatgccagctctgggtagatagagttggaattgaactggaggacgtccagctggtgcccactgcagaggtgactgcctgcttgctggtgaggagaaagcccccacatactcagggtctcagaagtctgctgtgtagattgctgttgtgttggtgtggacgcagaggagaaacagttcgggtttttcctaagaatgacagtagcacaaaagatgggaggaggagatagaaatatattgttgcaaggtttttacaatatacgtgaatgggtatcatattatatgaaattaaatggtgataagtttaaattgcaaaatataaatccagagaattcttctggcccttatccaagaccatcaaggcagtacttctctgagtctgcaagaatcacagtgttactgggtttggggtgccccctaatacagatatggcttagactgcaacacccaagtcccttggaatacctggaaagctttcccagaaaggatgggtacaaacaagcccaactgcaaagatgacactgcctaactcttcaatgcccagacactaccaaacatccacaagcatcaagactctccaggaaaatatggcctcgtcaaataaataagtcaccaggagccaattccagaaagacagaggtatgtgatctttcagagaattcaaaatagctgttttgaggaaactcaatgaaattcaatataacacagggaagcaatttaggatcctagcaaacacatttaacaaagagattgaaataatttttaaaaatcaagcagaaattctggagttaaaaaatgcaactgacatactaaagaatgcatctgaatctcttaatagcagaattgatcatgaagaagaaggaattagtgagcttggggccaggcctggtgactcacgcatgtaataccagcattttgggaggctgaggctagcagatcacctgaggtcaggagttcaagacttccctggccaacatggtgaaacctcatctctactacaaatacaaaaattagccaggtatggtgatgggcacctgtaatcccaggtactagggaggctgaaacacgagaatcacttgaacccagatggcggacgttgcagtgagctgagattgggccactgttctctagcctgggtgacagagcaagactttgtctttagaaaaaaaaaaaaaagatttagtgaccttgaagacaggctaattgaaaatacctcctagtcaaaggagacaaaaggaaaaaaatgaaatagaatgaagcaggcctagaagatctagaaaatacccttcaagtggcaaatccaagagttattggccttacaaggaggtagagagagataggggtccaaagtttatacaaagggaaatttcttacaactgcatgtgaaatgaatctataattatacacacaattttagttgtaaaaaactagataaaatagtctttttgaacagacatttcacaaaagaagataaaaaaaggccaataagcacatgaaagattctcagcataattagttctctggaaatgcaaattaaaatcataatgagatactactacatacccattaacatagccaaaattacccaaataaccacccagaaaaataccaaatattggcaagcatacatttctgtatgagagaagcaaggatgtcatatatttaatggaaactatcacacattcctggtggaaatataatgcaatgagttttattatcattctatttatacatttttaaaaaagggagcaacggcaggtcatttacttataaaagtctcaaaatcattctaccggtgacttcctttcataaataaccactctctataaaacacttgccaagaaacacatggatcctacaagggtcgggtgttactcttatcaatcattattgataaacaattatgatgaggggacccaaagaaggcgatgtacccgctgtggcaccggtggccacaaggtggcgtgaatgtcgagcggctgccccagccacctagaaagagattggagcagccaggcttccagaagcagaggaggcctcacagagggcaccgagactagacaggaacctctcaccttgtgaatttccctaaagaggggtcttcctagataagctttgaaggaagacccagtacctacacagtaaggcacaagttactgtgaagaaatctacgtcaaactagatgaggcctatgttaccttaactacggcctcatttaccctacctaggacctgatggggcttaaattatcctacacccacattattctagatcagggtttcttagccctctcattattgacagtttgggctggagaattctttgactcctcggtttggggagcctctgcccacctgcccaactgtggcaaacaaattcatctccagtccttgcccatgacccttactgggcaaaattgctcacagttgagagccactgccccaaataaggcttaaattactagtaaggctgatattacaccaaaaccagtctccattttcttagatcaatggttcttaaactagagcctgcaaagaatccccgaaggagcttgtgaagctgcctacacctgagccttcccccggagttcctggtttctgtgtctaacctatttctagatgatgtagatgctgtcgatgcaaggacctcactttgagaagcactgtcccagatggtgactacattacccatacgcacatttctctaaagcctccatttccctaggaccaccttatcctaattgaggcttacaacagacttgaggtgttcatgttactatttttattattaaggtaaaaccaggaaattttcatagaaaagaattcaaaagcttctgaacaaggtattatatgcatagaaatacctcaacataacatagatgctgggaaacaaaggcattgtcagccttgggcatgaggaagggcagggtgcaggcagggcacaggcagggctgctggcttcagccctgggtcttctttgaagatggaaaaggaaaacaatagaagacatcagtttaaacaaatacttcagtaattttcatgttgaaattagaagagcttctgttgcactttgggaattgctactttattttgactctagatatgaataagcaaatagcatgctactgcaatcaactttgacaaagacaaaattgtactggtgactttttcaagggcagcttatggaagacgtccgattacaaacttggtgaatggcgaagaatattcatccctcacagattttttaaaattatcttggtttttagtaaaaatcacgttgtctttaacagccacagacaccaaagaagttccaccacatcattttttcatatgattacggctcatttataagaatttctactatttcaaagtgtatttatttgtaactcaaaagaagatcagtctatttttctgcctactcggctgtagaataccaccctctactaatggctcattgactcaaggttaccttaaaggaaaccagacccagggtcaagaaggaatcaagccctgtgcatactcagtgctattcatgtgttcacagaatgattatgggacagacattgcacgtgggcatttgtttcatatttgcatcacgtggaggtttacatagcaaatattaactattccaggccaggcctgatggctcacgcctgtaatcccagcgcattgggatgcagaggcgggtggatcacctgaggtcaggagttcgaaaccagcctggccagcatggtgaaaccccatctctactaaaaatacaaagtgagccgggtgtgacaccacacacttgtaatcccagctggctcacagagcatttttctccaagcatctcaagcccagtatgaagtggatgtgtcctggctcagaatgttccctcagtgacagcaattgcttctcacaccacctcttacaataggaataggccttagaaaacccagcaatctattgggatacttcagcgcagcaagcaaggaatcactaaagccaccaggaggcccctcccctggagctccatatgcactgatacctccagacacatggcaagtgcaggaactgatggggactttggggcagcctcttttttttaggattctgtggttgaagattatatcagattagaactttatgcacagaccctgtttctcaaagcccctgcccccacactcacagtggaatatttgcacagtaacaaacctcaaatttgccctccttcctagtgtcttgccaatgaaaagtgcttccgactctgaccctagtcctgcttatgtttgttgttttgttgtttgttttttccaagcagagctaaagcaagctcagtactattggagatttggaaagtgccttcacattctttgccaattctcacctgagagccctgcagacgccccacgagaggaaaatctaaggtcattgagggaggggccgtgatcttggtcctgaagctgttgctttcagaggctttaaatcacttcactgtacttgacttgttctctcccattgcctttggtttccctaagttctagtccttagacagagcatgtgccttgcaaaacttttctctttaatccatcttaatcctagtgagcaggtgatatggtgggcaggggagcagtatatgttcaatgatttcttgctgtgctttctttaggctgtaccctttacaaggagtctccagtcatacagctgattttcctctgtcctctactccacctcctggctgtagcatacacagattattgtcttgaatctgaccccagttgtttattaattataccccttttcatgacacgggaaggctaagatgaagctgtctgggatggaaaagaatcccttcctctcacatagaataaagatcttgaaaagtattttttctttgtagggtctgtctggagaaagttctgggcatatttatcagaaaatagttctcctgatgacagagccatgagggcatctgtttgaattctcgtcttgagaacccagaagcttttggagggaaattccataaaagtgtgaggtgtgtggcccccagttcttaccctaccctttccctgcttctcctccaggcatttatggaattaccatgtaactcttcgcaccagcttgtgctttcaatggaagaatcacccaatctatcaatttagaaaggagattttatttctgaaaaagggttggagctgcaggacggccatcttaacaggctggaaagcaaagcctcccacagagactgtgagcaggcacttcaagagagggaaagacaagaaatgaattcatgcgaatggattggccaagcgtacacactcagcaggctatagaaggacctattgatagtcacatgacaggcaggctctcatgtgtaataagcaaacacaaacgttacatgcatttcatatttgcttttgggtgaggacatgagaactagacgaattacaatctggctctgtacacgaaaacggctttgtgcaggggcagaaagacacacagtgcacagcctccggaaattggccaggacaagtccatggtcagtctcagctctttttcctcaacttcagttctacctggttccacttcagcactgtgcctggaaactcccttaaggaagcatctgagcgtgcattcatcagaggactccttttgtttatttcccacctctcagcaattactgtccttgttacctgttgtcacacatcataaaattgaatttaagaaatttcactatgttttacaagtatttctggtggaaagatacatctggtctctgttgtcaaacctagtttgaaagtgatcatcttgcacaaaaaatattagaattaattttatgatgttcaccaagatttatcttggaatgtatacaaatattcaaccttaaatttcaaggtatcacaaaattttgttacatatatatatatactctatatatagtgtttattttgtcttacatatatattaattataccaatagaattatatagtgttattttgttttatatatatataaacattatatatagtgtttggtatatatatagtgtttattatatataatatatatagtgtttattttgttatatatataaacactatatatagtgtttggtatatatagtgtttattttattatatataatatatatatagtgtttattttgttatatatatataaacactatatatagtgtttggtagaatatcatacctaattttaaaatattcaaaatatctatatctgtcacataagtaaagcacaagctctacattgccctaatagaagagcttcctatttgtctttctcccacaatgtcaggggatgaaagcaggtggtccccactgagagtacttcctggattagatccttggaatgtcagtttcctgcctgatcatctcattttcattcctcaaatcagaacatgaattccatcttgagttaacttctcctccagagtatgaaagcatcattcctgctgcttctcctctaggctgattcaacaggatgtgcttcatcttttgcactgtgaagatattctttggggtcaaaagccccttcctggctatctggttgtctggcgatgcgctcattattgtccctagaaccttcctgtatcctggtccctggagtatgctcttggcctgggggttcagttccttcctgaaacatgatgttttgctcagctccagcatgaggctgtagaactggctcagttcctaatcctggaagctgggaggagtttttcaggtggtagtggcacagagggcaggtctcctggacatacagccatttcttaagacagcctgcatggaaaaaatgaacgcaaggcgtgatcacagcagatttcatgtcccaaacagattcttatcgaaggagttacctgataacagatggcacaaatatcattgtgtttctcaagctgctctttcgtagcaatgggtaacgatttaatcttattcacagcatccctgtggagaagaaagctcttccaccccagctgggcctgaagccacacgttatagtaggaatgaatggatgatcattgagcccatcactgtccattctccaaagatggtctctgagacgcaataggccaccatacagacggccgcaagaaactccagcaggtggtaagtgccattcacatagtagatgacatcatccatgttttccaccggctcttttctgaattcctcaaccataaatcagacataaataaaaagtgttcccagaacctgaagagaggtaagaatgctgctggaaataatgataagaagccaaaaatccaggtggaaaaactggcaaatcatataagccatatgagcagggaataccaataaaaataaacaaagtcgcacagcacggaagtgtttccacaagctcttgtctctggatgctcccagtgccaaaacaataggatctgcaatttctaacatagactgtaggatagaagctgcaacaatgaaaaggataatactgagcaggaatgcccgatgaacaacctgcagttctatcagcccagtctgcactgccaggattaacagcgttactccttctgtcatgctccaattcatggcaggatcattcctgaaagctcgataaccctgcaagtaaaactcgcagagtgtgagaacacccaaggcaacaaaagaaaccgtgaagaccaaacccaaaagagagtaaggagtgctgcagcattctgcaatacttgtcagaaaaaggaaaagaagcctctcacgtgatgccggctgatctcgagtactgaaataggagtaaatctgaagagcaaataagatgagccagaaaaccatgaaaagaacagggactaccagttgattccacaaggacattcccaaggtgagaaggccatatacctccactacctgaaccaattctctgtatgcagatttagcaaggttataaggtagcaaaagattagacccaagaaaatagagaacttccaatccagtaaaaatcatagcaaatttattgatgataacaattgtctccaaaggaaccaggcagagtcgtgctagcagaggaagcacgtgagctgaaaacagccaaatctgctttgttttcatgacacaggagcataaagtacacaccaccaactgacctattaaggctgtggtaaaccgattcatagagagaggttctaaatacattggtccctcataggcaaaccgcagttcactccgaacgtagtccctggaaatttgatgtccagtatagaaaagcagagcagtcaaaaaatatagataaagctgaaccagatgttgcctgggcaatgttagcagcaccacacttaagatataacctcaggctgtggactccctccctggggagcggtgctgccggcggcgggcgggctccgcaactccccggctctctcgcccgccctcccgttctcctcgggcggcggcgggggccgggactgcgccgctcacagcggcggctcttctgcgcccggcctcggaggcagtggcggtggcggccatggcctcctgcgttcgccgatgtcagcatttcgaactgagggtcatctcattgggactggttagacagtgggtgcagcccacggagggcgagttgaagcagggtggggtgtcacctcccccaggaagtccagtgggtcagggaactccctcccctagccaagggaggccgtgagggactgtgcccggtgagagactgtgccctgaggaaaggtgcactctggcccagatactacacttttcccacggtcttcaaaacccgcagaccaggagattccctcgggttcctacaccaccaggaccctgggtttcaaccacaaaaccgggccatttgggcagacaccaagctagctgcaagagttgtttttttttttttatactcctgtggcacctggaacgccagcgagagagcacctttcactcccctggaaagggggctgaaggcagggagccaagtggtctagctcaatggatccccccctacagagcccagcaagctaaaatccactggcttgagattcttgctgcccggacagcagtctgaagttgacctgggatgctcgagcttggtgggcggatgggcgtttgccattactgaggcttgagaaggcagttttcccctcacagtgtaaacagagtcacctggaagttcaaactggccggagcccaccacagctcagcaaagctgctgtagctagactgcctttctagattcctcctcgctatgcagggcatctcggaaaaaaaggcaactgtcccagtcaggggcttatagataaaacccccatctccctgggacagagcacttgggggaaggggtggctgtggacacagcttcagcagacttaaacattcctgcctgctggctctgaagagatgagcagatctcccaacacagcggtccacgctgctaagggacagaccgcctcttccagtgggtccctggcccccatgcctcctgactgggagacacctcccaacaggggttgacagactcctcatacaggagtgctccagcaggcatctggcaggtgcccctctaggacgaatcagaagaagaagcaggcagcaatctttgctgttctgcagtctctgctggtgatacccaggcaaataggatctagagtggatctccagcaaactcagcagacctgcagctgagaggcctgacttttagaaggaaaactaacaaacagaaaggaatagtatcaacatcaacaaaaaggacgtccacacagaaaccccatctgaaggtcaccaacatcaaagaccaaaggtagataaatccacaaagatgaggataaaccagttcaaaagggcttaaaattcccaaaaccagaacacctcttctcctctaaaggatcacaactcctcatcagcaaggggaacaaaactggacggaaaatgagtttgacgaactgacagaaggaggcatcagaaggtgggtaataacaaactcctctgaggcaaaggagcgtgttctaacccaatgcagggaagctaagaaccttgaaaaaaggttagacgaattgctaactagaataaccagtttaaagaagaacataaattacctgatggagctgtaaaacacagcacaacaacttcgtgacgcatacacaaatatcaatagttgaattgaacaagtggaagaaaggatatcagagattcaagaccaatttaatgaaataaagtgtgaacacaagattagagaaaaaagaatgaaaggaatgaacaaagcctccaagaaatattggagtatgtgataagaccaaaccttcgtttgactggtgtacctgaaagtgatggggagaatggaaccaagttggaaaacactcttcaggatattatccaggagaactttcccaacctagcaagacaggccaacattcaaattcaggaaatacagagatactcctcgggaagagcaactgcaagacacataatcttcagattcaccaaggttgaaatgaatgaaaaaatgttaagggcagccagagagaaaggtcggtttacccgtaaagggaagcccatcagactatcagcagatctctctgcagaaaccctacaagccagaagagagtgggggccaatattcaatattcttaaagaaaagaattttcaacccagaatttcatatccagccaaactaaacttcataagcaaaggataaataaaaacctttacagacaagcaaatactgagattttttgcaccaccaggcctgccttacaagagcttctgagggaagcactaaatatggaaaggaaaaaccagtaccagccactgcaaaaacataccaaattgtaaagatcatcaacagtatgaagaaactacatcaactaatgggcacaacaatcagctaacatcataatgacaggatcaaatttatacataacaatgttaaccttaaatgtaaacaggctaaatgccccaattaaaacacagagactgacaaattagatcaagactcaagacccattggtgtgctgtagtcaggagacgcatctcatgtgcaaagactcaccaaggtctcaaaataaagggatgcaggaatatttaccaatcaaatggaaagaaaaaaaaatagtggttgcacccctagtgtgttataaaacagactttaaaccaacaaacatcaaaaaagacaaagaagaggattacctaatggtaaaggtatcaatgcaacgagaagagctaactatcctaaatatatattcacccaatacaggagcacccagattcataaagcaagttcttagagacctacaaagagacttagactcccgcacaataatagctggagactttaacacctcactgtcaatatttgacagatcaatgagacagaaaattaacaaggatattcagaacttgaactcagctctggaccaagtggatctaatggacatctacataaatctccaccccaaatcaacagaatatacattcttctcagcaccacatcacacttattctaaaactgaccatattattggaagtaaaacactcttcagcaaatacaaaagaatggaaatcagaacaaacagtctcccagaccacagtgcaatcaaattagaactcaggattaagaaactcttcaaaactgctcaagtacatgaaaactgaacaagctgctcctgaatgactactgggtaaataatgaaattaaggcagaaataaataagttctttgaaaccaatgagaacaaagatacaatgtaccagaatctctgggacccagctaaagcagtgtttagagggaaatttatagcactaaatgcccacaagaggaagcatgaaagatctaaaatcaacacactaacatcacaattaaagaactagagaagcgagagcaaactaattcaaaagctagcagaagacaagaaataactaagatcagagcagaactgaaagagatagagacacaaaaatcccttcaaaaaatcagtgaatccagtaggtgattttttgaaaagattaacaaaatagatagactgctagccagactaataaagaagaaaagagagaagaatcaaatagacacaataaaaaatgaggaaaggcatatcgtcactcatcccacagaaatacaaactaccattagagaatactataagcacctctatacaaataaactagaaaatcagaggaaatggataacttcctggacacacacaccctcccaaaactaaaccaggaagaggtcgaatctctgaagagaccaataacaagttctgaaattgaggcagtaattaattgcctaccaaccaaaaaaagcccaggtcaagacagattcacagatgaattcttccagaggtacaaagaggtgctggtaccattccttctgaaactattccaaacaacagaaaaagagggactccaccctaactcattttatgaagccagcatcatcctgataccaaaacctgtcagagacacaacatcaaaaaaatttcaagcctatatccctgataaacattgatgcaaaaatcctcaataaaatactggccaaccaaatccagcagcacataaagaagctgatccaccatgatcaagtcggcttcatccctgggatgcaaggctggttcaacatacacaaatcaataaacataatccatcacataaacagaaccaatggaaaaaaacacacaattatctcaatagaagcagaaaaggccgtcaataaaattcaacaccacttcatgctaaaaactttcaataaactaggtattgatggaacatatttcaaaataataagagctattcatgacaaatccacggccaatatcatactgaatgggcataaactggaagcattctctttgaaaaccagcaaaagacaaagatgccctccctcaccactcctcctattcaacatagtattggaagctctggccagagcaatcaggccagagaaagaaataaaggtattcaaatagaaagagaggaagtcaaattatctctgtttgcagatgacatgattgtatatttagaaaacctcctcctctcagcccaaaatctccttaagctgataagcgacttcagcaaagtctcaggatacaaaatcaatgtgcaaaaatcacaacaattcctatacaccaataatagacaaccagagaaccaaataatgagtgaactcccattcacaattgctacaaagagaataaaatacctaggaatacaacttacaagggatgtgaaggatctcttcaaggagaactacaaaccactgcccaaggaaataagagaggacacaaacaaatggaaaaatatttcatggacatggaaaggaagaatcaatattgtaaaaacagccatactgcccaaagtaatttatggatttaatgctatccccatcaagctaccattgactttcttctcagaattagaaaaaaaactactttacatttcatatggaaccaaaaaagagactgtaaagcgaagacaatcctaagcaaaaacaaacaaacaaacaaagctggaggcatcatgctacctgatttcaaactatactataaggctacagtaaccaaaacagcatgatgctgacaccaaaacagatatatagactaatggaacagaacaggggcctcagaaataatgccacacatctagaacatctgatctctgacaaacctgacaaaaacaagcaatggggaaaggatttgctatttaataaatggtgtatggaaaactggctagacatatgcagaaaactaaaactggaccccttccttacactttacacaaaaattaactcaagatggattaaagacttaaatgtaagacctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctgcacagcaaaagaaactgtcattggagtgaacaggcaacctacagaatgggagaaaatttttgcaatctatccatctgacaaagagctaatatccagaatctctaaggaacttagacaaatttaaaagaaaaaaaacaaacaacgccatcaaaaagtgggtgaaggatatgagcagacacttctcaaaagaaaacatttatgagaccaacaaacatatgaaaaaaaggtcatcatcgctggtcattagagaaatgcaaatcaaaaccacagtgagatagcatctcatgccagttagaatggcaatcattaaaaagtcaggaaacaacagatgctggagaggatgtagagaaataggaatgcttttacactattggtgggagggtaaattagttcaaccattgtggaagacactgtggcaattcctcaaggatctaggcctagagataccatttgtcccagcaatcccattactgggtatatacccaaaggatgaacaattaatccactataaagacacatgcacgtgtatgtttattgcagcaccgttgacaatagcaaagacttggaaccaacccgaatgcccatcagtgatagactggataaagaaaatatgtcacatatacattacggaatactatgcagccataaaaaagaatgagttcatgttctttgcaaggacatggatgaatctggaaaccatcatcctcagcaaactaacacaggaacagaaaaccaaacactgcatgttctccctcatgagggagagttgaacaatgagaacacatggacacagggaggggaacatcacacaacagggcctgttggggggtgaggggctaggggaggaataacattaggagaaacacctaatatagatgacgggttgatgggtgcagcaaaccaccatggcatatgtatagctatgtaacaaacctgcacgttctgcacatgtatcccatcacttaaagtataattaaaaaaggtaactttgcaaaatatttagagagatttattctgagccaaatgtgaggaccatgccctgtgacacaccttagaagaccttgagaacatgtgcccaaagtggtttgattgctcttatatctaatgtcttagagagacatttgacatcaatcaatacatgtgagatatgtgttgatttggtctataaagacaaaacagcaagaagtgaggcagtgtggggaggggattacagcttacaggtggattcaaagtttttcttattggcaattgattaaaagacttaaggttttatctaaagacctgaaatcagttgaaaaagtttctagatttagagagcgggctttggagaacaatattcttattatgcagatgaagtctcttatgtggccacccttagaggcaatagatggcaagtgttttctattaagacctttaaaagatgctagactctcagttaatctcctccatataacaaaaacacctggaaaggtaaagcgattctctacagaatgtaaatttctctcacaaaatataactgtgcagggcaatttaaaatatgtcaaaaatatactttagggcaaaagactttgattcctctcaaggcctgctgtcatgtgatgctattcttgagtcaggttagaatttggtatcttactgctacaaagaatctgttttctgagccttaagatctgtttgaatgaaaatgctggttagttgtgcttgaattccaaaggcaggagtgcataatgaggcatttctgatcctttcttgctaacatggcctaaactagcttttcaagtatctctggaactcctttttgaagaggaagggtccattcagccagttgggttgcttagaattctatttttagtttataggacatatatgagacttatcctaatcaggggtatcagaaaatattcattgaggtaatcactttaaagttgagacatgaaagatggtcccagattcctccctgcaaaccttctctcctgatactagaagaaaagttacaagaaacaaatgttaacatttcttctgtgttcaaaattgccccccattaggaaaataattaaacttgcaagacttatctttagaaacaagtaatctagttgatttctaaagtccttttacaaacccacagattctgattagtttacagattacatagagcatcccatctaatgggaatctgcaattagctggattcccctgcatttgatttttaaatgttgaatttatacagatacataacagttcaaaacctttatgtggtacatgtgatattttgataaaataatatgtgcagtgatcaaacctggataaccgggatatccttcatctcaatcattgattatttctttgtgttaaggacattctaaattttctcttctagctattttcaaatatacaataaattattaactgtagttgtctatgtaccattttagcattcccaacagcagtaagtgaaagttcctgattttcagctttctcttcaccatttggtattgtctatattgtttattttacccattttagcaggttagcagtattttttgaatattaaatgtacatttacctaataaaaatcaaactgatcactttttatctttacttttagatgtggtttctcttcaggtctttgcccattttaaaaataaattttgtggttttgtttttgttcaattataagtcaatttatatatttgtgataaaagcccttttccaaatattggatttgcaagcaaattctccaaatctatggctgatcttttcagtctcagttaagggtttattttcaaatatctaggttagtttgtccatctatgaaaagaggataatcttaattctaaattcttagaattattagaataataatgtaagttgaaattattccagtatctggcccttcacaagttttagtataacaccagtgagaaaaatttgcagattgttctgtgtagaccagaaatcagaaggtgataaaggggcaattagatttgaataatccggagatatgaagtgtatttggtattcacctccttctatttctctatgaagacaaaatggatagatgacctctccatgtgaaatgggacacataagtttttaagatgattctgaaagaaagttccttatacaatcactcaggtgatgttccaaacacagggctgtggaggggatggtggctgccggtggttgctgtcagccacagggttggtttgtttcccacaggttccagaaatagtttctaataacaaatgtcatattttgtttagaattgatttattttttataatttattttctccctgtaggcagcactcagaagtatgttctcagaataattcctgatcctctgtgagttcctggtgcagctcctggaggcaaagcctgcatgggggagggagtcctcctcacatgcagccctgaggctgccacgtcacttcacccaccgttgcccttcagtcacttcctgaacacttatgagttgatcttcctgaaacatgtggtatttggcagtgtctttcccaggtaagataatacttccattctgtttatccctgcaggcacctgtccctttctggaatataaattggtttcgattgtgtggtagtggataagtggggggaggaggtttgtgtgcatcttgtcatcttccagagtgcacccctcatggggttgacagtgacaagcatgcagatgggcttgctcagctggaagatgacaggcattttggtaacctgtgaccccagtgaggctctctcgctgcaagatcaatcaggctcaggcctctggctaaagtgcagccagcaaggggtccagtgcccaaccctgagagctccttccaggtaccaaaccactttctaagggaagcttttttcctgcctggatcccatgcatgtgtttgtattttcttcacaaaggcctttatccagaaacaccccccaagagcttatagtgttttgaattcaactgaagggcattattcatgaaagccctcatggccaaagtcttcacttctcattaaaggacattgattatgggattcaccagaagctgctggcctttcacaggcacagaccttcctctacaccagtggtccccaacatttttggcaccagggaacggtttcgtggcagacaatttttccatggatgatggcggtgagtgattatgggatgaacttactccacctgcattcatcaagcattagattctcatagggagcactcaaactaggtcctttgcatgcccagttcacaatagaatttggatcctaggagaatctagtgcacagctgatctgacaagaggcggagctcaggcagtgatgctcacccgccgctcacctgctgtgctgcctggtttctaacaggctgctgaccagttctggttcactgcctaggggttggggacctctgctgtaaatgcttggagaccttaccctctgggaaggggcatagaaaaacaagtcagatgagctccaaatcaatgtacattttatggattcttgaggaaagagtgcaaagaggaacgtccccacccactttccctctacctggcatcattcccagtaatccgcttgaggaacccggggtgtttcaagatagtttaggcttgttatactaggggacgccagaaaaggaaacaattaatgtgtccatgcgggtttgtcagttgcaagttattacttcagtgcagggtattgatcacggagaagtctgtgcgtatcttgggcaggaatacatgggaactctgtttcttctactcaaatttgctgtgatcctaaaagtgttttaaaataaatgtaatgtaaaaaaagtggcaaagacattttggaagaaatgttggccacttcttagaaattatgtttagtcttaccacgtgataaagcaatcctgctccaaatgatttatccattcgattttaaaatgttatgtccccacaaggcttccatgggagtgtttgcatcagcctgattgattgctgcctttcccactctgtgaattttacttacagggtgaaagttgaaaagactatttcctatataattagagtgtatacatctttctattgcttcttttcctcaattacttaacccattttctaaacacgtttaaacctcataaatcctgtcatcttctcacccccagcacagctgcctccttcctcaaggtttctgacactctcaggatgtgggttttcacactgcgtgtcttgcacattaatatacggctgtgtcctcagatctcaggctgctcagctccatgtaggctgtgtctgtagacgtgtcccaggtcgtggtgactctgccctggaattctgtgcatatattgtttcaccatcttcaggatcaacacgttccatccactcaagcccttttccaggggcctgtcgcccccagtgtatgtagtggaaggtgaaggtgtatctgggatcaccttcactgaggacccaggtttcctcacctcagccccagactgcaccgattggacctgggaatgggcacctgtggagaggacagagaagtggttgagactccacttaactggacccagtcccctcatcagccctggaacttaggattctcttccctgtggctgctgccaccaagaggaggatcctcccggtccagtccatggtgaggtgctgtgctctgggggcttctgtaggggagggatgtggttgttgtgtgatgctctctgggcaaggacagatctgtatgtacctcggtagacagcagtgcatttgcatattcacgaggcaggtatttcatagctcaagccacctcaacctgaggaagaagataggtgacacacggaccacgccacagtgggatgcagagctccctgccctgaactttgtttaatgatatttgccctctgttatgctcagaagtccatgaagacagaactcgttttacagaaaaccagaatctcccaggacattgtcctcaatgtcatttcttgttcatatggcaccctgacaacctgaacttttcctgggccttgacctctgcacatctaaattctgggatgagtgtatcttccgacagtaacacccattgaattaataaaaccactcttcaattcctaactataaatacatttgaaaagaccagacatttctccttttaaatgctgtttgcattcaattatttggttaggtataggctacatatataatagaatacttaaagacacatcagtacttactacattcttatttagattttaggttattattgctttgaaataaagaacattcaattcctgagagaaaacccctccccagcctcctgtgcacctgctccagggctggatcctgtgctgggtgcgccctgagcgccccctgcagctcagctcctgccctgcaggaaagttcctgtctgggctcatagagaattctcctcccagcgtctcaagcacagtatgaagtggccttgccctgactcagaatgctctttcaatggcagcaattgcttctcccaccatctcttacagtagcaaataggccttagaacacccgacataatctaccgggagacctcagcacagcaacaaggaatcactaaagccaccagggagccccttccctggagttctaggtgcactgatagggtccggacacatggcaagtctaggaaccgatgggaactttggggcagcctctatttttttttaggattctgtggttgacgatcacatcagattgtaactttacacaaagaccctatgtctcaaagcacccccccacacacacacacacatacactcacagtggcacatttgcacagtaacgagactcagatttgccctccttccaagtgtctcaatgaaaagtgcttccaacactggccatagtcctgcttgtgtttgttgttgttattttttccagacagagctaaagcaagctcagtattactggagatttgggaagtgccttcatgttctctttgccagttctcacctgggaaccctgcagatgccccatgagaagtaaatctaaggccattgagggagaggctgtgaccttggtcctgaagctgttgttctcagaggctttgaatcacttcactgtccttgacttgttctctcccactgcctttggtttccctaagttgtagtgtttggacagagtctgtgcattatcacacttttctctttaatccagattaatcctattggtgaggaggggaggtaatgcagtggacaggggagcagtatatgttctggaaattgacttccaatgttttcttgctgtgttttctctaggctgcaccctttacaaggagtctccagtggtacagcggattttcctccatcctccactccccttcctggctgcagcatccacagattattttcttgaatctgaccccagttgtttattaattataccccttttcatgacacgggaaggctaagatgaagctgtctgggatggaaaagaatcccttcctctcacatagaataaagatcttgaaaagtattttgtctctgtagcatctgttaggagaaagttctgggcatatttatcacagaatagttctcctgacgacagagctacgagtgattctgtttggactctcatcttgagaacccagaattttctggagggaaattccatgatagtgtggggtgtgtggccccccaggagttcttaccccatccctgtctacacctgtcctccagacatttatggaattaccatgtttccgccagcttgtgctgtcaactgaagaatcacccaatttattgatttagaaaggggactttatttctgagaaaggattgaagctgcaggacggccatcttaacaggctgggaagcaaagcctcccacagagacattgagcaggtacttcaagacagggaaagacgagaaatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattccaaggacccctctagctcctacactctgggccaaggtttcctctgagccgcagtcagcctagaggacctaggatacatcttccttggacagagacccaccataggggcagcaggaggtaggggtgggggtaggcaagattcctgtggggaggtggagctgtcatcagagatggtgtctgcaggcagtgggtgtatcgtggctctgctactacttgctgggtggccccatgacgtttctttccccactctgacctcagtttccctatctgttccgtggagataagatgcctgcctacatatttgtggactgggatgtgtgtgggccagttgcagtgtttcttggtgtggtcctggggcaggctgcaccaccccatagagatttctgggccccaccctaggctcacaggaccagaatctctgggaatgaagcctgggaatttgcatttccacaggcatctggctgattctgacatgactgaaaagcactaatagtatatagcaagctctttataaaaggtaaattcatagctgccttttactaaacataaatctcaccttcccttcctcagttaaggacacacaccgcagttgaaaatcactgtgcctttccagatgcagaatctgacctttccgataagattctgttaactgctgctttctgcagtttgtattccaaaacaaggggaatatgtttccattttttcaatacaaatgtttaagtcggatatgctttctcaaactggacacgcactcacacagcttagggtttcagctatggcttcctctcaaattattagcctctttctgccagggagcagtttttcccagacaagaccctggacagaggttggtggggccctcctcatcagaatcactagattatgactgacccctagaggtggcttttctgcttaagtgtcagcccatgggctgggttgtgacccccaaagctgcggcagaagcttccacccatcctgggccccccctgccatctatggggaaaggcctgtcccttgtcttctgggcccagccggcctcacaggcattcagcagattggaaagtcgaagcatgtgctgtgcttggctgggctctcctgcgcccctttttggggtgaggtggagtgcatccagcccccagcatccctgccgtttattcccacccctcatccccacccccatacacactcacaagtacaaacacaagcacagtcactggcacacaccactctggacagcaccatttccagcctcagcggggcagtttccttacagggaagttaatgaggcactaacgaaggctcaggggacagggggaacctctatcgagaagaggctcctagacctggttctgcctctgaattgctgggggtccttgagaaagttgctatccctctctggtctcagtttcctcaggtgagaaatggggggccggccaaatggtctaaggttctgggaacctctaaatcagagcccgtagctggtggtcaagatgagggagaggccctcagggtcagccgaatgcctgagaggccggacaggcccaaaggtgagcaacgtgagcacatcaggtgggctcagagctggcgcatgagccccacagcctgcagagcagccctgtactcgggagcccgctcgcaccaacccagtgggacttcagagatgtggggtccagcctttcctactattgctgggctgagggctgggagctgcagattctgaccccacagctgccttagacatgccagatggtctggggcaagacacacccctctctatgaaatgagcagccagtccaaataggtacattagagaagggctgtgggatggacccagctgtagcctggggctacagactggcttccggggtactcaagcagctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggcggctgctccccacagccaggagtccggcccagcacccacctgagtccgcctcagtcctgctcaattgggttatccgtgctcttggccctctggtcccacccacagagggaggtctttggggcgaccaggtgagctggcccttgtgggaggatgtaactgactcctgagcctggcgagccaggcagcccctcgccaacgtccccacccctacctctccagcccccccgcattccctgatcctcccatccgctcccctgacccagcagttgcctctgctcactctcttttcctgctcccaggctcgcctggtcatgtgtccttcactctcctctgagtctccctctttccaagccgcctccactctacttgacacagtctcccttaagacaccagagtacacaagcgcaagtccctgcacctcacctttactcccagacatgggagggagatgacatgaagacccaaacgccacttagcaggagatctggggtatgcagaggggcagaacggaggctgtggaagctccaggggctcccttcaggaggccacatgtaagctggctattgaatgtggctctgagctgagacctctccttgaagctccagaccaggagccagctgatagctggacccctccatttggtgcctcagagaaactttgcactctctaggtctaactttgaacccagaaaattcccccatgtcggccctgtctcttcacagggaaagcaccacctcagacccagttctgcaccaaacccacatttgagtcacgaggctcctgccctgcactgtgagcactctggataagccagtgctgagggggaaagagctctgaatgccaagccaaaacatgagcttcaactccacctccagctctgagagctgtgggtagggaagggccctagtccagtttgctgtagaaagaccagtctgccactgtatggcacatggatggcaggggcagagtgcaggtggagagaacagaaggtgggcagggcgggggaggcagggacatggctgtagccgtggagatgggaggacagacaggacttggtggccacttgggtgaaccaagggaggagtcaggaagagacacccagttttgtatcagatgtgtagagcgtgggatgctgttcattgacggagggaggaggaggaggaagaggtatggcatggggaggaggtagctgagctctgtcgtgaatgtcatttgaagtccccagggaaagccaggccggccagcaccttcactgcttcagccagctctcagggtgtctgtgctccctggccctctcagctcctgcttcatagctgtcagctgcagtgggagacagctgcacaagggcccagcatgtctgtgtgtttacccaggggactgccgcatggcccatgccgagcagaaactgatggacgaccttctgaacaaaacctgttacaacaacctgatccgcccagccaccagctcctcacagctcatctccatccagacggcgctctccctggcccagtgcatcagcgtggtaggtgcagagggtacctgtggctcaggctcaggtgaagaggcagctcatgcccaagccctaagcagtcaatgtccagaggaatgaaatgactagagttgacttagactcaccggtacacggtggggaggctggaggagggtccatgaggtttataggtgtccagtatttaatgaggtcatggttttgttaacaaagaagaaatgagggtgggagcgagatcaccactggctaggcagccaatgggcctgcagagactctgctcagctgagtctccagcacgaccatgagcttctcatcctgatcctcccatccccaccctacttttctcccccagcttgctcaacaggtgaccttacaggctccctactctttgcagggaataagaaccagactgggggaactgacgggtacagaggcccaggtgtaggcgcaggaccacaggcagtgaagcgtctactgacccaggcgggtgagggtctggagagtgggcatggctgctgcaggcatggaaagcaggcacagatggcggcactcccagggcccattgtcagggtctccacatgtggacgtgtgcagaggtgggggtgctgagggaggaggggcagggaatttctcatcttctctctactgcctctgagttggagatgtcagagggagccatggcccactgtaaagtaacacaatgtccccacccacaggattagaacccctcccctggaagcagctctgaggggaacagtcacatgtagagagtgcagggcactgtgtccagccgggggaaggaggtcaccaagggggttgacccccctctggccaggtggctgccttctgacacaccagcctctgtctctagcacggtggcccccacacacccagcctgtgaaacctacagccctcaagaaggctttggccaaattaaggagcggctccctctcccaggaggaagcacaggtgaaggatgtggagggcagtagagttgtgtgtgctccgccccctttctccacagtcggatggaaagaagggggctttcagccaggctcgcccaggctggggtctgagtgtcactgtccagctattggcttcttgcttaatgggtgagcccagctgctcccgtgcagctgccgccctagtgagggtgaaccggcaggcgagttacatttctgaaagcctgggaatacagtaaatattaggctgtgggctgctgggccaggaagagttgtttatttttcagggtttgtttatctattgacttgatgagggagggttataggtacaaccagtttaaagatggaaattttgagagagcaggcagggatttagtgctgggtaagcctggtcaaagcggctcttttggggcggccagaatccagtaccaatgtcctcagcatgttcatcagctgctgggggagtgcgggacagcatgaaagcacaggagaactttctggatgatagaaatactctgtatcttcaaaggaggtgggttccatagtaatgttaaatgagttaaaactcatcaaaatgtaaaccagacctgtgcatttcactaatagaaattatacctccaattaaaaacatgttttaaaagacagatgggccggatgcagtggctcatacttgtaatcccagcactttgggaggctgaggcaggtagatcacctgagtcaggagctcgagaccagcctggaaaacatggtgacatcctgcctctattaaaggtataaaaaaaaattagccaggcatggtggcacacgctactcgggaagctgaggcaggagaattgcttgaacccaggaggcagaggttacagtgagcagagatcgtgccattgcactagagcctgggcaacagcgcaagactccatctcaacaacaacaaaaaaaggacagatgaaggttttcaactttcagtaaaggcagaggagcttgttacagattcgcctccccacaagagcagttagaaaaactggataaaaatgtgccccgcccccaatcaaaaacaattgttggaaggtaattggagacctcagtcaggacttgagtgaccaggcctaggaggtgatcctgacagtctgtagtgctttcccacatttggtgattggtcaacagtagagggctaagaggctaagaaactgagtatgaagtggtagttaagaggctggagagcctagctgaatgtttggcactctcacagggctgaaatgacctaatgagaatttgggtcccaggaaggagatgggaccttggtggggaccctggaagggccacccctgggagtccaaatgaataaaacatagaccagccatcagaaaacctaaaacctgctttgaaccagcttagtcccaaagtagatgaaggcgatctgcccttactccaattgtgtgccataaactcaaagtcaatactctctggaggcagataaaagtttactatgaatgtcaaaagacaacacaagactaaatgagaaagaccaagaagaaaactaatagaaacatacatgtaaggaagaaacttttttttttgagacggagtttcgctctgtcacccaggcttgagtgcagtggcacgatctcagctcactgcaacctctgcctcccaggttcaagcgattctcctgcctcagcctcccaagtagctgggattacaggcatgcgccaccatgcccggctaatttttgtattggccaggctggtcttgaactcttgacctcaggtcatccatttacctcggcctcccaaattgctaggattacaggcgtgagctaccatgcctggccagtattttgccacaatttaaaataaataaaatttttttttcaggtttgtgctcagactatattctaaacagtcacatggcggcttactcttctccaggccttgctgccggcttttacatgtttattgtctttgccttcttgtcatgtgctcattagatggcagcttccaggtgctcctaaggggccaggaaagagagtgagaaggcacggaggttgccagatcatcccccttggggccccgccctcatcaactccctcaaccgggtctcctgcaactattggtgggccatctcggccaccgcttcgccctgagcttcctgctgctgcagctgggcagtgcctccttctcagaggccagctgctgataggcggccacgtactgctgcaggtgacccaggtaatggtctcgctgctgctgcagactcagcctcttggctcttcagctccacctgcaggataggcgtcagggtaggtagtggctggcttccagattctgggcccataaacagggtagtgagggcactgcggggctctgtcgcctacccaggcccctggccctggccccttcctccaggcctaaatgactgcctcccttgcctagaggcccatgcctccctccccagcctcaaatctcacacccttcttcccaccatttaaactgtaggccacagactggtggaaaagcagagggagccaaccaccatctgctaagttgtggtgaggtcattctgtatgatctccagggtttgcacacacctccgcctgctccccccaagagctcggccttctgccccagcttccccagcctctcctccagctcctgcagcctcacctggtgttcctgcatcttctcctcctgctgccgcagcctcacttcctgctcccacatcttctcctcctgcctccgcatcttctcctcctgttcttgcatcttctcttcctgctcacacatcttctcctcctgctcccacatcttctcttcctgttcctgcatcatctcctcctgctctcgtatcttctcctcctgctcccgtatcttcttctcctgctcccgtatcttctcctcctgcctccgcatcttctcctcctgttcttgcatcttctcttcctgctcacacatcttctcctcctgctcccccatcttctcttcctgttcctgcgtcatctcctcctgctctcgtatcttctcctcctgctcccgtatcttctcctcctgctcccgtatcttctcctcctgcctccacaccttctcctcctgctcccgtatcttctcctcctggtcgtgcatcttctcctcctgcctccacatcttctcctcctgcttccgtatcttctcctcctgctcgtgtatcttctccttttgcctccatatctcctcctgctcccttatcttctcctcctgcctccacatctcctcctgctcctgcctcttctcctcctcccgtatcttctcctgctcgtgaatcttctcctcctgcctccacatcttttcctcctgctcccgtatcttctcttcctgctcccgtatcttctcctcctgcctccacatcttcgcctcctgctcctgcctcttctcctgctcgcgtatcttctcctcctcctgcctcttctcttcctgctcccgtatcttctcctgctcgtgcatcttctcttccagctcccgtatcttctcctccttctcccacatcatctcctcctgcctccgcatcttctcctccttctcccacatcatctcctcctgcctccgcatcttctcctccttctcccacatcatctcctcctgcctccgcatcttctcctccttctcccacatcatctcctcctgcctccgcatcttctcctcctgctcccgtatcttctcctcctgctcccgtatcttctcctcctgctcctgtatcttctcctcccactcctgtatcttctcctcctgcctccacatcttctcctcctgttgctggttcaggcggttccacaactcgttctcttccacctgggcttggagctttgctgacacactctgcagctccttacccaggtggtcagcctccgcctgcagctgctgctggaatagtgaaagtgtttttttttgaacctcagaagg[221 bp omitted]gaggcaggagaatggcgtgaagccggggggtggagcttgcagtgagccgagattgcgccactgcactctggcctgggtgacagagtgagactacttctcaaataaataaataaataaataaataaataaataaatgtaatctataaaataatggttttcatccatgatcctttaaaaaaatatttttaagccctaactcttgagattctgattccccaggcagggccccaatttgtacatttttagtacactctagaggattctatggcgggaccagaacaaggacccaaattttccagctcttggctggagcctccccataccctgcatgatccctagaccatggtcccagctggatgggtctcccacaacccccggggctgcagctgctcacctgtggcagcaggagcttggccctctccagtttcctttttagctcctttacgttgagctggatctcagacttttcagattctacaagttgaagtttttcttgtagtttggcatttttctccttcagctcctcatcagttatgctatggccagaggcagtagagaaaggaatgaatgaagaacataaaagaccactttggtgattgaccccctaccctcgccccacaaccacagaaccgtggcgctggaagggaccccaggaattaaaagtcccaggtggcaggccagagagaagacatgagttgcctgaggctaccccatgagtcagtggcacagccagcactagagcttccgtgtgcacacatgaaaacatgtatgagcctctccccacactcacctggaccccccacctcccagcacaccacccatgctaagggcccccagacctcccattccaccttcccccatcctacgtgttcctgtacagttccagactcagggcgtccctctcctttgttaactcctcaatgtactgcaaatagagaaaggttaagtcaggatagagcaggcacagcagtagctggacgaccaggaacaactgctacagtgactactccacagtaacacttcctcactctcaatcacacctgacgtgttctcaaggcatttccaagcccatggtctcatttgtttttctttctttctttctttcttttttttttttttttggcagagtttcattcttgttgccctcactggagtgcaatggcacaatctcagctcaccacaacctacacctcctgggttcaagcaattctcctgcctcagcttcccgagtagttgggattacaggcatgtgccaccacaccgggctaattttgtatttttagtagagacggggtttcttcgtgttggtcagtctagtcttgaactcctgaccgcaggtgatccgcccacctcagcctcccaaagtgctggcattacaggcgtgagcgagagcacctggccctcatttgtttttcaaagaactcagtggatgtggaagggacagggaaagagattgaatttagggctggctaacaggggcccagagcgatcagataatattgttattgctattactgttagtactaccactgttcgaacctttattgagtgcttcaccaggcactatgctaacaatcccatttaatcctcacaacctccataggagatggttaccattattacctctattgtgtagatgaaaaacatgcggtattaaaggttaagtgctgcctaagatcacttggagctgggatttcaacacccagctatatctgattctctaagcccattcttccgctggaggtaggggcacagttaagaaggaggaaattaatcctttgttgaatttttgaaaggatgatacgttcgcatagtccaaaactcagaaagtccagaagggaaatatctccccccaacactgtgcctctatcctgagttttttaatgaatccttacaaacgtgttttatgtatgttaccataatacgtacacacacacacatatacacctgccccctctctccacacaaataataacatactcaagatactcttctgtacctttatggtacaagtaccctaaccgccacttaggacttggccaaggccacagccaagtatgggcagggcgggcacttggcctctgagctctatgtccagtgctcgctcctcacagtgctccccaactcacccacaacagccgactcagccccagtctgcctctaacaaccacacacaaaagcagcaagaaatggccatgctgccttctgggcaggacactccatcctacagaagggacctttaggctcactcctccatctgcgaagctgggctcccaagggacggggccgtgtttggactcaccctatccgccttcttcttctgtgtagcgacagcagagagagcctgctctaactctcctgcaaacttccatgaatcatgcaggcggctgatcagatccctggcctctcctggaatgagagacattcagatgtggcccaaaggactccccctaaaggcctgtcaaagtgccaggttgaaggatgatggggtgccagattcccaccttccaactgcttgacagcatgctggctgtagtagagtgccatctgaagctcagttttctgacatgtaaggattcgtatggtatgaacctgggcctttgggagaaaagacaagcaaatgctgaaagagaagcaaagaaacattctccagagggcaggagggaacttcacaccctccactcacctctagctccctccttagggcttcctgatgttggtggcttgccttctgttcctatagaaagaggaaaacagagctcttactagggggaggcagagatccacagcaagagacatgcccccagaatggcaccactgccccagaacaggcccacccatgggaccagtttatcagggaccctgtggggatggggtggaatcttgggggtgagccttcttccccaggctgggagtgggtgagatgagcctggggcctctacatctgagtgcccccaaacccagcggtcatgtcgtgagcaaagaaatcacactacttcttccagctgagctcggttctattgtttctgtggggagagtcaaaggaaggtgactgagggtggcccccttgactctattccccaggccaggaagcgataggcaggggccaggaatggatttaaaaggcacagttctcagacccaatgggaacatgaactggtcacctctcctcaactcccaaagaagaaggatttgggtctttttggtttttgcccacagccacagaactcaaagtctgaaactagattctcttgaaaagacagtaacagaaaccttcagaggtggagtgcgagaaaagcccacccttccgccagcttgtgatttagaaaggtgcattcactcagcaaacgttgagcacatacgggccagggacggttcttcacagcgggaatagaggtcagaaaaggcagacaggagcccttggccccgaggtttccattctagtgggcctttaactctcgggctctcagagctaacagaaacctctgatactctctaactctacctcaggaaacgcaagcccaagaaggagagtttacagcaggtcctggacgagggattaacataaaaacacaatgacaaatctcatttaaacttcacaaacgtaaggaaaacaataccactcgtattttacggatgtgaaaagagaggcccaaagagctcaagcaatttgcgctaaatcatgtccctagcagatggaggggtaggattcaaacccagaattcttagccagtacctggcagttcttccacaatcttaacaattaccctccaccaccccttgggccctctgtccccaggagcccggccagccaagactcacatcctcaggcgagtggcaaccaccagaagtggttgtctcagggttagtgccattatttattttcttctttttggtgtcgcttgctgctgtaccaacactagggttggtctggggatgatggtctgtcaactgtggaaaggaagagcagtgatactcatgagaactacaagctcctacagtcacatcctgctttacagtttatactaaatacccttatagaccatctgatttaatgccaccaactgtaggaaatgttgtcacaatcacttagtgactgagagagattgataccatggctgaaaaaaaaggcagtaatggaacttaaactcagtcttctgactctgagctctgggattttgccctaaatcagcagctgccagggaccaaaaccagaggcagaggtagaaaagcaaatattaagtaggcaggaactgtgcactatgtggtttagggttattcaccctcacacgtctgttagtgttaaaaagtacaccagtacctctcaaacctttacatcaatgtctcctcatggcagaaggcagcctttctgctaaatctgggaatttaacagaaagaggacaacccaagcctcatttcagagagaagtcttgtatacgcttataaatctacgtgactttcatccctaagtacattaatgttttgcctctcaatagaatcaagggaaactgatgcttcagaaagatgccccatatttatcctgtggcactcaaagtaccccaggttgagatgagatgaggaagactcaagctaagttcagtttcccaagatctgttccacagaagataagcagatctcactccagaaccagtgactgaggggcactctggtcccagaacaatggagaattcaaatctgaggtgcagaactgagaaaaaatgttaaaatctctctggagagtagaagcctgggagaaaaccaaaccaaacccgttctcccattgccacccagagacactgtcaacgtgtcgagctcatgggggaggtgtaggcttttcacactgtcaaggtctgtggtaaggaagtcaggcagcctgaaacctctctcttctaggtcccacagtccccattccccttccagctggaaacctgtgctgcaaccagaggaaacagaagtgggcaagaacacttaggggactgggtcctaagaccaaaggccggtcttgtggtagtaatgacagtttgtagcgggactgtgacatcactacattctactcctcggtggagtggttgggggggacacatgagtgcaatgcccaagttgccgctttgagactggggagggggtcacaaaattgggagccaggtccttggagacgtgaccccaaagagccccgggaggtcaggcttggggcggcaggaggtgagggccaattaaggagcaaggagctccaggagtcacatccccaaagtcaccctgtggcaactggtgagggcaggttctggggcacccaggtccttggagatgtgagctcaaggagcccagggaggtcgggtttggggtagcaggaggtaagggcggagtatggagttggaagccccaggagtcacctgctcaaagtcaccctggtgtgccgggcagagcaggggcaggacttatgagggggttgggctggctgacaagattttggtgtggggagcccagaggcactggggtggggggcccagcctggtgtccctcaggagtggcacagactctggcagcagttcggctgtcagagggggcctcgggttgggttggggtgttggtgcgtttacctgttccttggcctcggccaatttgctctgtctggtttctttggacatcataggatgggtagggaggtggggatgggtagggaggtggggatgggtagggaggtggggttggggccacatcagcatgatccaggtgaggacaagtatatacctccagtcacctctacgtcgctgtgtgactgagccagaggaggcgtaaccagggctgcactagaatgcagaataggggtgtggccttcatgcttgaagcccattggtcaatgagaaagatgaaaggaaaaggaggtgtggccagacagcagcgtgtcatcaaggacctgtgttgtcacaaggaaagctgcctatgcaaccgctgtccccgcccactccaggagaggggcggggctggctttcactttaaaaactttaaaactttattacctcaattgaggtacaagtcctattaaaatggaaattttatagtgtgcttgatgattgataaagcagactttattatccaacattccaataagataatcacaatgttttctcttttttggaaaaactttctcttattctcctacattagcgtttagttttttttaaaaaaacaaacaaacaagaaacatgtctaatatctttaaaaatacaaagctttgagccaggcgtgatggctcatgcctgtaatcccagcactttgggaggctggggcgggtggatcacccgaattcaggagttcaagaccagcctggccaacatgatgaaatcctgtctctactaaaaatacaaaagtagctgggcatggtggcaggtgcctgtaatcctagctacttgggaggctgaggcaggagaatcccttgaacctgtgaggcagaggttgcagtgagccaaaatcatgccactgcacttcagcctgggctgctacagaatgtgactctgtctctaaatacacacacacacacacacacacgcacagacacacacacacacacacacacacacacacacacacacaaggctttccatttaataagcactcaaagttctttacaaggttaaagcaaatacaggacccttctaaagtaaggctaaatgctaagtgatgggggagagaaaaaggacataaataactcctactctcatgagttaatcactaaatccgatttttctagaatcacctggcctctaagccctgaaaatgaaactgaatttctcactcgatacttggctatgacttgcaatcatgaaaaccaagaattgtgttatgtcactgtgtattgcttgttacctgggatcaagggttgactttttcatgatttgctccattacctgtgtgcttcttctcccagtccaaactacgcttttttctagagttctacaatttacagttagtatgtaagggtggctctcaaacatgtagtctccggaccaggagcacctgggaacttcttataaatgtaaattctcaggccccaccctagacacgaatgaatcagaaactctgcagtagggcccagcaatccgtgctgcaataatccctccaggtgctcaggaacctctgccatacagcaggtagaaaaatgtgtttccttctgtaggtccaaagccagggatactatatgttctgtctcaatatgaaacaatgacatgcaattaaaagacataaatctccttcctacttccaccctccagccagtgtgttttatttttatgagttcaataagaaaacgtgtggcaatcagagatttcatctaaaaaatatatctacaggtatcagttctcatccagcctgatctcatccaatatcatttctatcctcttacatctaaagttttagaaaaggattttcacaacgtaagactcaggcgcactaggagttctatgataaaagaccaagtagatctgaatgtccaaacttactagagaagaaaagtggactcattggctatattttcaaattgcattcaacaggaaattaaagttttgaattttttccaccttcatccttccaagttaatagaattaaaccagaatactccattcttccaaagcctgtagccaggcaaacttttactgtattacttcttgcttttcaatggatataaagcagagtcctggtaggcacattttgtatacctgcaaagatgcaaaactaaacagttccctcggttcaatattaaaacaaaagtcctgtaaacctcagatggtgagtgtaatacttcagcactagcacgaaagcctcaaatataaaaagataccaagaaccttgctagcaaaccaaagtaagctcttggccgggagcagtagttcacgcccgtactcccagcatattggcaagctaaggtggggtaagtcaggagttaaagaccagcctgggcagcatagcgaattcatatctctacaaagaaaatttaaaaattagctgggcttggcggcacacacctgtagtcctagagctacttgggaggctgaggtgggaaaatcacttgagcccagaagtttgaggctgcagtagctatgatcatgccactgcactccagttggggtgacagagcgagatctaattattacattctgtcctgctcctgtttccactaaaatcactaacttaaaatgtgttcattcagcaggataaaaattaagtgaaatttgactttggtgctttgctagcaaaaaataaataaataaagtgaagtgacaaattacttactgggagaagatctttgtaacctcaatgacagattaaaggtttgtagccttagcctataaagaaatctttaaaattactcagaaaaaaaaatgaatgatttgcagcagaaaatgggcaatggagaaaccagcacttcccacaagaataaaaatggccaatgagcaaatgaaaaagattcaaaagcactagaaatcaaagaaaggtaatgaaaacaatgagattttctgcttaaagaccagcgaagatgacaaatggaagggggaacctggagctctgtccctgttggtgggagcataaactcaaccaattttcctgtaggatgatttgaacatttcttttaaaaatcctaaaactgttttatattactttcctctagaaattctacttctatgaattcagtgcaaaaatcctgactcgagtccattaaaatatatatagaaggaaatccacctctggggtggcaatgactcacttaacatacatccagtgatgatgccagggtatatttctccatagaaacatgcttaaaatatagtaagtgacaaaagaccatgtattgtgattctactttttaaaatgtttacagcataaaaagtgtgaaaagcaacaaaccggaatgttttgagtggcaaaattaaagatttttctttacattttgtcatccaaattattacaaaaacaatgtgatttcctttataatcatggaaaagtgttattttcatttatttatatttacatttcttttctttttcttcttttttctcctgtatgtatcccacataggctacagagcttaaatccctgcctcttgagagaaatcagcccattttcaggacatgcaatacacaaagctgccccatcttccctttatttttatttttatcttatttatttatttatttatttatttatttatttatttatttatttatttatgttgagatggagtctcactctgttgcccaggctggagtgcggtggcgcatctcagctcactgcaacctccatatcccgagatcaagcgattcccctgcctcagcctcccgagtacctgggactataggcatgcaccaccatgcccagctaatttttgtatttttagtagagaggaagttttaccatcttggacaggctggtctcgaactcctgacctcaagtgatccgtctgccttggcctcccaaagtgctgggattacaggcatgagccactgtgcctggcctgtcatattatttctaaacatttgagtgacatttcaattaagtgaaatttaattcttactgacctgatctcttatcctctgtttaatgataccttccagttgaaaggtgtttcctctgtaatcacgggtgccaaaggaaatacaacatgtattcattaggtggatccactaaaccacggattcacgcattgtagtccttacaccctcagcatcagaaacacgtgggaacttgttagacatgcaaattcctgggccagccccacacctcctgaatcagaaagtggggaaggacagctatctgtgctttaataagccttgagatgctccctgaagtttgaaaactacagaactagaatacatatggtagtaagtgctcatactttatccaaggtactagggactcttcccctcttttccattctcttttctgttgaaataaaatgagagctccttttgacttaatgggtataagcaagaaggcaatgagatgaccagggtttcaagttagagttcaaaatttaatcagtggacagtgacaggatgcaagccttctaaacagattgctgcaaggaagctgattataatctatacagtaggtatcattagtgtattgatgttaaattttgggggtggattaatggtattgtgattatataggagaagtcctggttcctagaagatatctgcgaaagtacttaacagtgaaatgctctgatactgccaacttactttgaaatgattcagggggaaaaagggcacatatacaatcttccatacgcagaagacagaaaacaagtgtgacaaaacattaactagtgaatccagttgaatagcatacagatgttcactgtatgattttatcaacttttctgtgtttgcaagttttcaaaataaaagttgagggaaagaaacatcaccccaaatctttctatgaaatgggaccacagaaaaagcagagaagtgaacactttgcagaaaagagcactgcacccatccggacagcatggtcaaagtgcaggctctcctccaggaggctcttctctggtctcttctgtgctgtcacttcccccacatgcagccaaggcttttttctaacaactctttttctaaagatgtaatttttgtcattcatctaagaaagagaagaaaagaattagtatacatttagaaaataaaattacacttacatttgtgaaaaagcaaaaaatactttgaaaagtggggaagcaagaaatgtactgttctacaattctgttctgttcttaccatctttttattctgccaatgacttcctattcctgctgtgtatggtggggtgagctgcaaatgatttcttttcctcattgatttaaaatgtcatgtttataatgtaccaaactcccccagaagcatttgggtttatttctgggctctattctattcaagtaatctatctgttcacaagccactatcaattttgattattggagcatcctaaagttaagtaattgttgtttttgtttttgagatgcagtctctcactctgccgcccagctggactgcagtggcgtgatctaggctcactgcaagctccacctcccgggttcatggcattctcctgcctcagcctcccgagtagctgggactacaggcacctgccac[187 bp omitted]ttgtcaccacccatatctgacacgtcctcctcctcctctaaatcttctaggtcctcctggccatcagcctctgtttctgaaccagcctcttcatgctcctgttcttcactctctgggagaagactgatatcttcatctttctttcactaaccgcattctggaagcactgtaaaattgcttcattttgcaattccagttgttgcaaagtctgctcatcatcaaaactttctatcacaagtttttgtaaagagctgccatggattctaccattctctactgttttattaaagtcataaagcactttcgttaaagaagtgaactttggttccaatccagcttgaaacctattgggaggaattaaatgagatttagaattatagataataatttcacagccctcttaattaaaagaaaaataaaaacctcaactcttctgtaaaatcaaatttgaataaagtgtaagtatagattctggccccaacaatatataagctgatgagccacagtgatatataaaacctgtcaaccaagtatttgtgaatcagctgtatagattgttggcaggaaaagcattacaaatctatttgcttggagatgtatagagaattagccttaaattttctactctgctacattatataccactccattcattcattcccttattcactcaatgatcaacatttgctttggcttacagtggtcaaggaaaacctctcctagatgtgacatctgaggtgaaacttacagacaagtatagtcttataaagattgggaaacatgtattccaggcagaagaaacagcaagaacaaattctctaagatgcaattgagcttggtaagcctgaggaataaaaaagtgagcatggctatagcgtgaaggaggcagaaggtgaagtcggagagactgatgggagccaaattctgcagggctcaagggtaagagtttgccgttttaagtgtaataagaaaatgtgagaagattttaagcagaaggatgaaatgatgatttatacgaaggaagaagaaagggaggaaggaggaggaggaaagtagagtgattagaaggttgatgcagcattccaggcaaaggatgatggtgatttaagctggagttagagcagtgaatatgctgagtacagtttggaggtagaactgacaggattgctaaggaattagatacagaatagagaaaagtgaagacatcaaaatagcagcctagttttatgtgcgagcaactggagagacagaactgccatttactgcgataggcaaggcttgagtggtggagcaaggggaaaggacttcagcggatggcagagtgtaggtgggtagaaacaacattctactgtattttggacacggtgaatttgtgatgctgagaggaccaaaatttaaaaaattgttaaaagccgtacggtgcggatatcccagttgtgcgctactgaattccaactaagctcagtctggagttgcttgtgagcaaggaactcaagggagaggttggagtttgaaacataaatgagtcataattttataggtcatatttgaagttcttcaacaaaatacacataaaacgtttgtgttgggaagagacatgaaagttctaattctcaagaagcttagtggggtagacagacaagtgacaagtttgtgctttcaataaagtatgatggcaggtaaacactgagtgctttaggagcacaggcggaaggagaaaccaacacagttgtgtgtagggggatgggggccgtaataagcctcaaggggagcttataggcgtgaataactgaggttaggttgatttcaataacattcaactgagagatccatactgtaaaagttttaacaatttttaaaattttgatagcctaggtcctctgaaatgtggggaaaagtgatttacatttccccttaccttcccccagctccacaatttgccaggggtctgcaacccgtgtccacgtgcgaccgcagtcgcacccgagcccgggatctgtgcacttacgtgaggatgcactcgggccagccagtggctttgcccacctccctcagacaccgctccagggtccgtcagcgccaggcccatgggccatggctgtctgcaactcccgacacaagctgcaaggcaagagagccgctgggaaaccgcaccgcaaggatgctgggattggaacaggaattaaaagaaatgaaaaaatgtgtaagcaaaaactcagctgtatgtaaaaaaaacccaattccccctgagaatgagaaagagccttagtcctttaaaaaaactacctgttttcctatggctagtgagccttatcgctcccttcccaggcattatcaaaaccctaattccctaactgtgcaactgcaaggtcactaaacaaacaaatgcaagtcacaaaacatatttttcctaaaaacgtaaaaaaaaaaaaaacataatgcgtgcttcaattaaataactctctgtttctcgcttctgtaatatgcttccccctgcacagatctacccgggctccacaaaatgctaaaagataactctttattcagctcaacgctttgatctgcctggcgtggtggctcactcttgtgatcccaggactttggacggccaagtagggtggatcgcttgtgccttggagttccagacaggcctgggcaacatggtgaaacctggtctttttgttttgtgttgttttgagacggagtttcgctcttgttgcccaggctggaatgcagtggctgggtctctgcttgccgcgacttccgcctcccgggtttcggtcgttgtcctgcatcagcctccagagtggctgggattgcaggcataagccaccaagcccggctaattttgtattttttttttatttttattttggtacagatggggtttctccctgttggtcaggctggtctcaaactcccgacctcaggtgatccacctgcctaggcctcccgaggtgctaggattgcaggcttgagccaccgctcccggcccaacttattaatcagaaaggaatagatcgtcctggtgtggtggctcacgcttgtgatcccagtacttcggatggcccagcgcggggtatcccttgagcctaggagttccagacctgcctgggcaacatggtgaaacccggtctctctctctctctctctctctttttttttttgaggcggagtttcgctcttgttgcccagggtggagtgcagtggctgggtctccgctcgcagcgacttctgcctccagggttttagtagttctcctgcctcagtctccggagtggctgggattgcaggcctgaccaacattgctctgctaatttttttttatttgtttttggtagagacggggtttctccatgctgggcaagctgatctcaaactccagacctcaggttatccgcccacctcggcctccggggatgctggaattgcaggcgtgagccagcgcacacacccaatttatttttatttcattttttatttttatatatatatacttttgagacggagtctcactttgtcacccaggctggagtgcagtggtgcgctgtctcggctcactgcaacctctgcctcccaggttcaagcgattctcctgcctcagccgcctgagtagctgagattacaggcacccgctagcacacccatctaatttttttttttttttttttgtatttttagtagagatgggttttcatcatgttggccaggctggtctcgaactccggacctcaggtaaacccacctcggcctcccaaagtgctgggatgacaggaaggatcggcctggcgtggtggctcacgcttttgatcccaggagtttggaccggccgagcgtggcggatcccttgatcctaggagttctagaccagcctgggcaacatggtgaaaaccggtctctctctctctttttttttttttgaggcgtagtttccctcttgttgcagggctggagtgcagtggtgcggtgtcggctccccgcggcctctgcctctgggtttgggtggttctcctgcctcagcctccgagtgactgggattgcaggcgggagccaccatgcccggctcttttttttttttttttttttttctggtagagacaggtctctccatgttggtcaggctggtctcaaactcccgacctcaggtgatccgcccgccacggcctcccggggtgctgggactgcaggcgtgagccaccgctcccggcccaatttattaatcagaaagaaatagatcagcctggcgtggtggctcacgctttcgatcccaggactttggacaaccgagcgtggggaattgcttgagcctaagagttccagacctgcctgggcaacatggtgaaaatctgtctcttattattattattttttttttttttgaggcggagtttccttcttgttgcccaggctggagtgcagtggctgggtctccgctcgcggcaaattctgcatcccgggttttggtggttctcctgcctcagcctcctgagtagctgggattacaggcgcctgccgccacacccggctaatttttttttttgtatttttagtagagacgggttttcatcatgttggccaggctggtctcaaattcctgacctccggtgatccacccacctccgcctccccaagtgctgggatgacaggcgtgatcggcctggcgtggtggttcacgcttttgattccaggactttggactggccaagcgtgggggattgcttgagcctaggagttccagaccggcctgggcaacatggttaaacccagtcttttt[131 bp omitted]cctcagcctcctgagtagctgggattacaggcgcccaccaccactcccggctaatttttttttattttttagtagatcgtggtaactgccttaaaatgatgattgttcagaaagtcagtttaatttagatactaaggatattgaggttatgtaacatttgagcaagttctaaaaaaaaagagaaatagtatatttaattgctaataaagtattgtcaactcacaaatatattcacatagcatacatttcaagagcagaataaccatgaatataaaaggaattagcaaaaacgaaacaaaaaagacatgaagaaataaaaacagatggaacaaatagcacaaaatacgatgaaagttataaaagaaactatgccaacaatcacaataaatgtaaatagactgaataattaagagaaaatgactataaaacagaattagggcacgcgtggtggctcatgcctgtaatcccagcactttgggaggatgaggcaggcggagggatcacaaggtcaggagttcgagagcagcctgaccaacatggtgaaaccccatctctgctaatacaaaaattagccggcgtggtggtgaacatctgtaatcccagttactcaggaggctgaggcaggagaatcgcttgaatccaggaggcagaggttgcagtgccgagatcacaccattacactccagcctgggcaacagagcaagactccgtatcaaaaaaaaaaaacacacaaaaaaacacaaaaaacagaaaataaacagtatgaaaagacatctaaaacataaagtcacagaaagactgagagagattgaaaaaagatacacctgtcatatgtacctaacccaaagaagggttggaagctatattattatcagataaaataggctttgggcaaaaagcaatatgggagattttttaaggccacaatataatgataaaaattctaataaaccaagggagaaggtaatctaaaatgttaatgtatctaataactagcactcaaaatacatgaaagcaaaatatgacaaaattgcaaccctcagagggcaatttaaatacatatctcagtgtctgataaaagagacaaaaaacaatcagcatagacatagaagatttacatctctctagaaaattaacaagcttgacttaatgtacagaaaaaacatatctctccaaagtgacagcattcacccccccaagtacatatgtactgagccataaggaaaatctcaacaaattccaaagaagcggaatcatgcacccatctttctctctaaccataatctcattaaactaaaaacaataataaaaagataaagtaaaaagccagaaaggcagatgctaaatgagaaagtgacagaaaagttacagattttgttaagcatacaaagcttctatggggtaaagcagtcaaagggatatgcaaatttacacagaaatccaactgatataaatccttgaaagatactacatacagatatttcatcagttctcacatgccaaacccagcaaagccaaactttggagcctcccctgcgagcagacctgccacaggaggagaggcagcacaaacctccctttgcagtgaaaatgccacattgtgtgtgcttcttaccccatcacctctttggaagtggccccactcagcgctagctgagaatcgcttccctcataccactctcagtagttcaccccaagacacacgggacaactctgtacctggtaagtcattgtgaatccaattaataatggcattcagaaagttaggaatctttgaattattagattcatagtgatattcaaaagaaagaaaacgacatcatttctgttccacgcatgttgcccacattcactgcgtaaaaggcaaagggaactgtgagtacccacaaagaacctgatattgacggcacatacatttcttcattaggaagaataaatttagactgtaacaatttaaaaaaccagaaaatacaactgtacattttagttcttattaaaatccaagaggtttaacttatttgctccttgtttaggtaattagtgtctaaaacatttcaaagataacatatatagtggctatgatttctagtactttttaaaaattcaagcccagtctcttctaattaaatgtataaatgatttatctctgtctttcttaaaaagaaccaagagccccaattaaaaagtaaaacttaaatttcctcttaaaaaattgttacgtcaaaattatctaataaaccatagttcagaaaataatttctgaattaagaaaatatgaataataaaaccaacagtttatgtgctgaatttcacatttttattttttattatttttaaaattttgttttaagttctagggtacatgtgcaggagtgttacgtagggaaacgtgtgccatggtggtttggtccacctatcaactcatcacctcagtgttaagcccagcacgcattagctatttttcctgatgctcctcccccacccgccctgacaggccccagtatgtgttgtttcccttcctgtgtccatgtgttctcactgaacctcacatttttaaatacagcatatgccaggtgtcatttcagtacccataattatacatagtatatgtatatgtgtaaatatatgtatatgtgtacatatatgtatgtaatatgtgtatgtaaatattatgtaaatatgtatgtatgtaaatatatatgtaaatatgtatgtgaatgtatgtaaatatatacacatgtaaatatgtatgtaaaaatatgtacgtaaatatatgtatgtaaatatatgtatatataaatgtaaaatatgtaaatatttgtaaatgtaaaatatgtaaatgtaaaataaatgtagaatgtcaaatgtaaatgtaaaatgtaaaataaatgtaaaatgtaaatgtaaaatatgtaaatatatgtatatgtgtaaatatatatgtatatgtgtaaatatatatgtgtaaatatatatgtatatgtgtaatatatatgtatatgtgtaaatatatatgtatatataacacagcatacagcatatgccaggtgtcatttcagtacccataattatacatagtataattatacatagtataattagactactatgttagctaaaaaatgttgattagatacaaatgtataaatttatcttctctaaacgtggaaattctctagaggctatttccagcttctgtgtggattgtagagcaggctgctacctgtaccccaaaaatgaacaccttaaaaaaaagacaagtttctcagcctccctattgcacacacatatgaaaaatatgttaaattcaacgccaaatattcctgagatcaacacagcagtgatcccaaagagaaaatttctctttgctaatgggcacaaacttgaagggcaaagcagtggaagggtaagtctgcagactcgggtggggctcaagtcagaatcacgtggaagatcattgccacatgtttttgtttttttaaatagcaaacaccaccaagtggagcccgccgggtttagtagatattaaacctctaaggagtggcacatccgagactgaaattcccatcttttgattcccagctcaaggtctctgaaatgccagcaccagctgtgaaattgttcttctgcattttcatggagaccttttcttctatactgccatactcttttttttggaacagttatacctgatcttcctatttttgtgtgtgttccaccgaaagtttttcactctaaatacttccctctttccaactgagcatttacatctgtaacaaggacaaaaacatctaacatctctctcacccttggtttgtgttttgttttgtttgtttttgagacagggtcttgctctgtcacccaggctggagtgcagtggcgtgatcaccgttcactgcagcctcgagctcctgagctgaagcaattttcccacctcaacctctgagtagctgagactataggtgtgtgccaccacgcctggctaatatgtgtattttttgtagagatgagtttttgccatgttgcccaggctggtattgaactcctggcttaagtgatcctcctgcctaggcttcccaaagtgctggaaggaattacaggtatgagccaccgtgcctggcctcaccattgttaaaattatggaaatcgtgtttgcaaagcaggttggcctgtttggaaaagggtgtcataatttctcaggtaactccaaaaagagaaagctacgaaaattaccttaatacattcattacagtctcagtataagattatagcttcctctcccaaagcgtaaccacaacctgacgcaggatgagttggtttgaaaataccgcatacaatatcctcttgagtagaatcataatttagaactctaaaaatgaccggaaacaaaactgtccaagtttgtttaacgtaatgtgtttcaacttatttgactagaaaacccttcattcgtgcaacacttataaatatcccatggcaaatctagttttctatgaataatgaacgaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatagcccatgtctggccaggctccatggctcaatcacacctgtaatcccagcaatttcagaagctgaggcgggaggatcactggcctttagtgatccttgaatgaaactccatctctaaaaaattaaaaatattagcttagagaatcatttgggcccaggagtttgaggctgtattgaactatgactatgctactgcattccagcctgggcaacaggctgcttaaacctggaggggcagagcttgcagtgagccgagatcacgccactgcactccagcctgggcaaaggagccagactccgtggcaaaaaaaaaaaaaaaaaagagattctattgacaatagcaacaaaaccctgagaatatatctagcaaagtatacacaggcctttcatgaagagtattgccatagcctgaatgtgtctcccaaaattcatgtattaaaacttaattcccaagatgatagtactaagaagtggggcctttaagaagtgattaagacataagggtgagccctcatgcatgagattagtgccttccttataaaagggcttgtgggtggtggtaaatctgtcccttctgcctcatgagaacatagcatttgcctgctccagaggaagcagcattcaacgtaccatcttggaagcagagaccaggccctcactagacactgtgtctgctggagtcttgatcttgttcttcccaacctccagaactgagaaaataaacttctgctctgtgtaaattacccagtctcaggtgttttgttatggcactatgaagggactaagacaaatataaaaattacccagggacttaaagggagaactgactaaactgaaatatatgccatatatattatgaatcgtaggactcaatgctataaacatactacttctcaacaaattaatctataaattcaagaaattcctacacaaatcccaatagaatttttttgtggaactcgagaggctgatcctaaaattcatacagtcacttgaggggccaagaatagtgtaacagggctggcggggctggtggctcacacctgtagtcccagtactttgggaagtcaagactggaggatggtttgaacccaggagttcaagaccagcctaggcaacatagcaagatgttgtctcaaaatattaaaaataaataaataaataaataaaaagaaggttaagtatgcacattttgttgtgaatttcaattttatagtgatttttttttttttgagacagggtcttgctctgtcacccaggctggagtgcagtggtgccatcttggttcactgcaacctctgcgtgggctcaagcaatcctcccgcctcactctctggagtagctgggaccacagttatgtgccaccacacctgactaatttttatatattttttttgtagagacggggtttttccatgttgcccaggttgttctcaaactcatccacctgccttggcctccgcaagtgagatcacagacatgggccactgtgcccggtctagtgcgcttttttttttttttttttaaccaaacaaacgatgaagtctcaggagtaaaagttgatacacaagtaaattttattggtaatgtttttgtgtggtctttaagcagagggaaaattagtctgcattatggtgtatccagactaaataactgatattaaaatgaaattatccttaggatttgcaatcttagagaaaactttttcattttttttgagttacaaattatcttcacttacatttgagaacagtgagtcacagagggattaagtatcttactcaagatcttgcaagtgtttggtttgaacccaatcttttcactctgcagaactcagagtcactcttatttggaaactttttaactgatgtggatcctctaatatgggcttcctattattcattccgtattagtcagaagttttgcaagcaggcagaattcattttgccaattacgggattttccctcagttgcagtcaaggttcataaaactataactataaattttgtttttgagacaaagtcttgctctgttgctcagactgggatccagtggcacagtaacagcccattgcagctttgaactcctgggctcaagggatcctccgcctcagcctcccaagtatctgggactacaagtgcatgccatcatccctggctaattttgtttaaaaaaaaaaattgtagagatagggtcttgcttcgttgcccaggctggtctcaaactcctggcctcaagcaagccttcagccttggtctcccaaagtgctgagattacaggtgtcagccattgcacctggccaaaactgtaactatatatacacacacacataactacatatagatgtgtgtgtgtatgtatgtgtgtgtgtatatatatttttatatataaatagatatatctgaaaggcatcaaaagaaaaaagctgtaacttttagtcttgatcttgatagtgacttgattaggctatctgtttaacatcaaagatgcaaattaatgctttctttgggtgagcatattaaaaatgcagaaaatattggagtagttttttatgttaaataaattgtattctgtgtatttaaggtatacaacatgattttgtgggatgcatatagatggttaaaaaaattactacagtgaagcaaattaacgtatccttcaactcagatagttacccgttttctttttgtttggtggcaagaggagcttaaaatctcatttagcgtgaatcccaatacagcacaattttattacctatatttctcgcgttgtacattatatttctaggcttgttcatcctacatatctgctactgtgtaacctctgagctatgtccacccattttctctcttgccccccaagtaatttcctaaagtgtctcatataaaaaggcagtagctttcagcttaaactttttctctgtatatatttaagtcaatttctttgaggtatgtttttctctccagaatagttagatgtaggcataccactttaatgttgacactagttcacctagaacttatcttctgcaaatctgtctctatgtccatctctgtctccatctttgtctctatctttatctctgtctatctatctatccatccatccatccatccatccatctatctatctatccatctatctgtctatctaactaaagcaaattcatgcccttctcctatttatggaatcgagaccataaacagaagtgagggaaagaatttggcaggaattgcgatgtgtattacctgtggcataaggaaactttacagaactagggtcaaaagtatactttctagttctttcccatggcttttcactttgatgtagtccttatcaggcaactgaggttttatataagtcccctgattcttagaacatgaaggtgtagtattcaagtttggtcccttgaaagcacaatttttgttaaaaaaatttaagaaaattgtatgatttcctcagcaaatacatattgatcatctgttatacagccatgagaagtggttctgttgaacacgtttattttatcagatcccaattctaaaccaggcatagaatggaaaccatgaaggtaggatgaaataacttctgaatgtttgaaaatagtgtacttaaaaataaatatcaggtgtttttgttttgttttttgttttttgtttttgagacagggtctcactctgtcacccaggctggagtgtgatggtgccatctcacctcattgcagccttgacctcccaggctcgggtgatctcccacctcagcctcccaagtagctgggactacaggcacatgccaccatgcccagctaattttttgtattttttgtagagacagggtttcaccatgttgcccaggctggtctagaactcctgggcttaagcgatcttcccacctcagcctcccaaagtgccaggattacaggcatgagccaccatgcctggctgaaaataccaggtttttaagtatcagcactgcctcttcaatcttttctattactatgttgtgctcagtggtattttttattgaattagagcagtgctgttcaatggaaccttctttgaggatggaaatcttttatgtctctgctgtgtgggtatggtattagctgggtatggggcacctgcctatagtcccagctactcaagaggctgaggtgggaggatcacttgagcccaggaggccgagtctgcaggttcgtaccactgcaattcagcctgtgtgacagaatgagactcagtcgcagaataaaatgaaataaggaaataaaaatgtaattgttgaaataagaaactagtggatggattagacacgagaagaaagaattaattgtttaggcgattctctccaaaaagtaagtcagcatgtcacacagagagacatgaggatagatgatagggcagaagttggtgggcttggaggggagaggaagatcagaatgaggtccaaaatgtgtcttagtgaaatcccaggaggagatattaaaattatattagaaagtgaaagaaatagaagttttatttatttatttatttatttattttgagaaggagtctcgctctgtagcccaggctcgagtgcagtggcacgatctgagctcactgcaagctccacctcctgggttcacgccattctcctgcctcagcttcccaagtagctgggactacaggcacccaccaccacgcctggctagttttttgtatttttagtagagatgtggtttcacctttttagtcaggatggtctcaatctcctgacctcatgatccaccagcctcaggctcctaaagtgctggaattatacgcataagccactgcacccggcccaaaagctttgtgtttttacaaatattacacatgtttcttgtttaagaaaaaaagtcttcacaataacgtaggagaataagagaaacatttttccaaaaaagagaagtcattgtgattattttatcttattggaatgttggataatacagtctgcttcagtaatcatcaagcatgctatggattttccattttcataggatctgtatctcggttaaggtaatactggtaatttttgtactctatgaaaaatataggccaaaatcatagaccttgcatagaagctggatcatgaagacagctctggaggaacacacaggtacacacacacagacacacatatatataaagtatacacatatatattttttaaaagcttttaaagcaaaagccggccctgcccctctcccagagttggcggcctctcccctctcttagagtgggtggggacagtggttgcatgggcagctttccttgtgagccaaaggtccctctggacacatgatgcctggccacgccccctttccctttcatctttctcattaaccaatgggcttggagcattaaggccacgcccctattctgccttctactgcatccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccactcccgaggttcaccggactggggcccccacaccagtgcctctgggctacccccaccaaagttttgccagtcagccccaccccttcagcaagcagcccagtctctgccctcaccaatcaccccagggtgactttgggcaggtgaatcctggggctccccgctcctttactgggccctcatctcctgccaccccaagcttgacctcccagggctttttgggctcacatctccaaggacctgggtcccacagccccagaccccaccctcaccagtcatccctgggtgactttaggctggtgaatcctggggctccctgctgctgactcttcccttccctcctgctgcctcaaggtggacctccctaggctgtgtgcactggcgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcgagactggcctttgatcttatgacccagtcccctaagcattgccaccccatttctggttcctcttgtcacagcacaaatttccagctggaaggggaatggagattgggacctaggagcaagaggtttcaggctgcctcactcccttaacacaaacattgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagtcagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaacagtataccagacttctctctgaaatgaggcttgggttgtcctctttctgataaattcccagatttaacagaaaggctgccttctgccatgaggacacattgatataagagtttgagaggtacaggtgcacttcttcacactaacagacgtgtgaggatgtatgactaaaccacatggcatacagttcctgcctacttaatgtttacttttctagctctgcctctggttttggtccctggcagctgatgattcttggtaaaaccccagagtttggagtcagaagactgagtttcaaagttcatctgtcgcctttttcttttcttctttttttttctagccatgatatcaatctctttgagtcactaaatgattgtgacaacaccttgtacagttgttggtatcattaaatcagatggtgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagattgtggatggactgttgggtacctgtgaagaattctgggtttgaatcctgcctctttgtctgctagggatatgaattagggcaagttgctagacctcatcgggcctctcttttcacatctgtataatagaggtggtattgtttcacttccatttgtgaagtttaaatgagatttgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccgcagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcaggccagccctccaacctcctcctccaggtgggacggggtgcccctctgccagctgagacagtccacacacaccccagccctaatgattgttctctctacctctccccccactcctcctccacctcctcctctctgcatgcgcctcagagcccgtgccaagaactagcagtagtcccagactcgaggtccgtaaaagtcagtcaactgaagaacaccatcaaatctttggtaagagtccactggggtcccctgattccacgctgccaatcctgggctctagtttccccttggggccctgaagaaaggggacggcggcccctggtgccaagggcgaatagggagctggggcgcccaggcctcacctggagggaccccggagcatgcagcatggctctttttttgctgccctgtttgctgactctcccctctccagatgcccctgctcgagtccttgctacacacgccctgggattgttgcctcttggggaagtgctagcctgactggttgtcagggtccctgtatttctgccatgactcagtccctaatttgctctttgattctggacaagccacctctcctttttgggctcatgtttccatgaagtagtgagtatcaaaggtctctgttagctctcgagtctgagatttaaaggcctcctagaatggaaacctcagggccaaaggctcctgtctgtccttttccaccctaaatcttctgtgaagaaccgtacttggcccatacgtgctcagtaaatgtttattgaatgaatgcacttttctaaatcacaagctggcagaagggggggcctttctcaaactccatctctagaggtttatattgctgtcctctcaagagattccagattcagaccttcagttctgtggctgtgggcaaaagccaacaaagacccaaatcctctgtccttgggagcttgaggagagtttaccagttcgagttcccactgggtctgagaactttgcctttaaaatccattcctggtccctgcctaccacttcctgctctggggaatagagttgagggggccaccctccatcaccttaatgtgactctccccacagaaacaacagaagaaacaagtggtacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacggtgtgcagttttctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctggcactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccccgtcccctgggagcctggctttgcagacagaggagtgagcctaaaggtcccttctgcaggatggagtgtcctgcccagaaggcagcatggccatttctcactgcttttttgtatggttgttagcggcagcttgggactgagtcagctgctgtgggtgagttggggggcactctggggacaaagcacaggacgtagagcttggaggccaagtgcctgccatgcctttacctggctgtggtcttggccaagtcctcagtgggtattgggtacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtctgggactatttgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtggttgtgaggattaaatgggattgctagcatggtatctggtgaagcactccataaaagttcaaacagtggtaataataacagtaataacaacagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctccccagattgaaacttctcactcttcagcagttctccagccgcagtaaagcacgtacggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtagagccagaggtggtcatgggactgggctttgtggaggtgggggcagagagggagagggcagcctgtccagcctccagcccctctctccagggccctttccccctgtgctttgggcaggtttgctcgttgaagaaggagaagaagcatgataaatatcgggtagagacgctggagaggagcttgtccaaactcaaaaaccagatgggtaagatggggctggcgtgacctggcagcaggactggcatcagagggctgtgagggtggcttggagtgccccagcgaggtgggtggatggaagggctttgaggcagagggaaagaggtctgtgccaggagacggcaagtcttgtcatctcaatgagcctcagtgtccccatcagcaaagagggcccgttgtcagccacccgcagtgctctttctctgaaagtgctttggaagactggctaccatctgggtgcgaggaatcattagcagtgaggccaagtttgaggagccggagaggagctgtgcgccaagaggagggttttttcttttcttttcttttcttttcttttcttttctttttttttttttggaatccagaggctcttattgtctgcttcctttctcagctgaacctctgcccccggagcccccagcagtgccctctgaggcggagctgcagcacctgaggaaggaactagagagagtggcaggagcgctccaggcccaggtggagtacaatcagcgcataagtctcctgaatgaggggcaaaaggagaggcttcgggagcagcaggagaggcttccagagcaggaggagaggcttcagcagctggccgagccacagaacagcttcaaggagctggtgcgttgccccagctggggagcctgccctcctccctagccctccaggcctttgtttccccacctataaaatggggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggtgggcaccagcctctggggaggggaggtgccaggccagcggtagctccagcccaggggcaggtgaccccagcaccctccagggcagtcctgtggctgtttcttgcttcctgccctctgattttagaggtgggtagccctgggctcctcccaggtctggacatcatcattccagctagagacatggagcccccccaatcacaggggaagagacagagtggtataacagtcttcttatgccagatgcggtggcttacgcctatagtgccaacactttgggaggctgaggcaggagaatcacttgaggtttggagtttgagatcagcctggccgacatggtaaaacctcatctctactaaaattacaaaaacaaaaaacaaaaaaagaaagaaaaattagtggggcatggtggtggcgcatgcctgtaatcccacctactcaggaggctgaggcacgagaattgcttgagcccaggaggtggaggttgcagtgagctgagattgcaccactgcactccggcctgggccacagagtgacactctgtctcaaaacaaaacaaaaagactccttagattaaaactggattccagcctcagttccactggtcaccattcaagtacttcgcatctctaagtctctgtttctttaacttcaaaaggaagttagcattttccttacagaggtgctgaggattaaatgagataatacatgggaagcattaggcctgtagcacatttagcagatggtggttggctcccactacttttctaccattctgtggcctacagttgaaatggtgggaagaggacatgagatttgaggctggggaaggaggcatggggttctaggaaagcaaggcagtcacttaggcctgaagtaaggggccaggggcctgggcaggcgacagagccccacagtgccctcgctaccctattaatgggcccagaatctgcaaaccagccaccatgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtggctgcagcagacccagctaatgaaccagttgcagcagcaggaagcttggggcaaagcggtggccgagatggcctgccaaaagttgcaggaggcccaggggagggagctgccgaggatggggccgtgagggggacgacctggcaaactctgtgccttctcactctttcctggccccttaggagcgtctggaagctgccagccagcagaaacagcagctaacggcccagttgagcctcatggctctccctggggaaggtacgggagaccgctcagaggaagaggagagagccccaggaggaaggggggactgctagcagcataggattgaggagttggaagagacctttagaacagctggtcattatactaaccgggtgcctgcactaagttcagcatcaatatggtgacctcctgggagcggggggccaccaagttgcctaaggatggctgaactggccgaggtcagaaagggagcaggtcagaactcccgcaccgaccagtagtgggaatgtgcctgggcagtatagcaagatcttggttcttcaaagtaaaaataaataacagcagctcattcctctctggggaggggctggctcagggttacacaatgagggtggaggtagaggtgggcccacaatacttcccttgttgagttgtctgaggacccctctggccaccacccccacccccaggagatggaggaggacatctggacagtgagggggaggaggcacctcggcccattcctagcatcccacaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtgaccaacatgtgcagtctctggggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtggctgccagcgcctggctcacctggtggcctcggcccagaaggagccagaggcagccagaggccctggagccccagggcctgggggcgagtctgtgagtggggagacccactgggccctgcaggaagtcacggagaagctggcccatgccaggactcacctccaccttctccatgacttgaaaatgccacctgagggcaggtcgctgccgagatgtgactacaatattttggctccagagcagctttatggaccacctggaggagaaggcagacctgagtgagctggtgaagaaacaagaacttcgcttcattcaatactggcaagagagatgccatcagtgagtgggaggccagggcacagcagggggagctacagggccgtcggaggggccccagcgtctgagccctgtcctcccgcaggaaaatccatcaccttttatcagaaccagggggccgtgccaaagatgcggcactgggaggaggacaccatcaggctggagctcagggaggagatgaaggtagggtgtgcaacatctctgtgggggtgggggtgggggtgggtgtgagggtgggcgcaggcagcggcatggcagctgagcacccctccctccagatgaagctgctggagctgcagcagatggtattgcggcttacagcaactacaacaatgggcacagaaaattcctggccgctgcccacaaccctgctgatgagcccggtccaggagccccagccccccaggagcttggggctgcagacaagcatggtggtgagtagagccctcaggtggggtgggcaggcaggaagagggggctcccactgtgctcagatccctgcctccctctctccaaagatctttgtgaggtgagcctcacctcctctgcccaaggagaggccagggaggatcctctccttgacaagcctactgcacagccgatcgtgcaggaccaccaggagcacccaggcttgggcaacaactgctgtgtgccattcttttgctgggcttggctgccaagaagaaggagataaacatcaccatcatcaaagagctgctcaagaaatttttaaataagaaaccaagttatggggttaatctcctacacaattcatttacttcctttgaatgttagagtcactcatgattatttgtgtttctaatttatagttttaagtttatttgtaaaaagttaaaagagagtgggtgtctgtggctctcactgatgttcactctggcatcctttagcatttttcttttttaatttcataattgtaggtcattagcatgcatatcgagtttgcccttacgtggtgggggttcaaacacacaaagacccactctttgcccaaaactgttctcgctggtttggaataggctgccatgcttttttaatgttattgcagcatgtatattcactacagaattcagacaaaatttgcctatgttctgctgttgtttgatctaatcttaatcacagtgagctcttcgttagctcaatatgtagtttgcccccaagcgtgcactgtttattactttgtaatatgccactatgagtactgacatttagagttgtttaaaggccaagaactggaaacagcctttcctccattttctgtgtattggtgatgggagtgaaaccttttgagggagctttttaaatctcacagaagaggaaagtggcctcctctggcaggtatgtccaggatagagtgtgtttcatctgttccggtgccaggaattagcagtgtattatggtggttcccttaggatttgtatgtgctctgggctcatgaagatactgcatcatgagctgcagcagttgtactctttttcaatgacctaaaaagggcttatttctgaggaatgaaaggttcccatcgttgactgtggatgtggaaaacctttcctagcttagagcatttgtatctacaatacattttaaactcagagttcatgttacctgttttaatcacatgactacatgtcccagtacacaaaagggcactggttggcattcttcttaatgtatttagtaaagatcataagaaatcctttacgagttcaaatgtccctggaacaggcatacaggctctagtcaagaatgaattagagtgaaggaaagctgtgtgacacctggcattcctctctgttcacggagattctttgaggcttgaagattgattttaccatctagacctctttggctaatacctattcttcaaccaccttggttactctgacataggaatttacttctttttccttgaatggaaaacactttaaaaaataatagaaacattattataaactaatatatgtgagatacttagttgaaacaaaagggagttttagtagacggtattatactatctttgaaaatcaaggagaagtttatgaaacttaaaatgtgtacaaactgcagtgcaatctactgttcgtgaatgtcaatgtattatcaggaaacgtgcctatacaatcacagagttatattttctcacagacttctttacaaagtgaaatatgtttttgtatctctgggtttctgttcgggacatattttgtgcaatatttatgtgattgtgcctatgcatgatgaatgaatgcatttcagttatgtattgcctaaatcgtaacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttcaactgactcttccaaattttatgaatgtatcaatgtattagataaacccagtttcagaatgataaagaaaaaatgttagaccaaataatgcggctaattaacagtggtacgatttctagcccgtgggtttaaaatgcacttaaagtcctgttctcgccttttattttctgaacttgccgcttttgcattctttgagttcagtttaaagacggttactttaagagcattttaaaccctcgggctagaaatcggaccactgttaatcagccacattatttggtctaacgttttttcttttatcattctgaaactgggtttatctaatacattgataaattatttcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtcatatatttaagaaaaagctaaaaggaatggaaattgtatgacaataacttaagtctttctccaaagtgcatgcagtcttttgcgatacctcattcagccgagtatttgtgctcttcctcattcggtataaggcagctttcagtttgcttagaaggcaacattggaatgttagagttcatcagaaacatagaattttaaaatgtgagttccactgaatacattttaatttctgtaggaagaatcaaaacacctatttaaagatggcaatatataataatcattttaaaagtatttgattaaacctgataattttccagaaatgaaaaaaaaatcagctctaaaacgaaagctgattttagaaaatttgaaaatgtaaatcagccctatccataatatagtttctctaaaactttatcttagagtcattttaaaataatataactattaaaaatgtaactgctatcttaatgttctgaaataagttaaaacattttaaaatatgaatactatagtataaaagaaagaaacagtgggaaggaaaagcagagaaagaaatgccaattccagtccaaagctttatttgccaagttttgttagaatgaattttaccagtttgtgaattcttgtaaacagaatgtgtaatggaaatactgaaagatttttccctagagtggccttattgactgctggtgtgatgccactgtaatgtaataaatcattaaattgtttctaagtgttgtttttgccttaaaattttattttgtgtttcttgaaaactatagtattaaaggtattgatactgtgcaaatgctgggcatgcttgacatgagataatgtgtttcatttttacaaaattgtaatacaactatgcaagtgtttattaaaaacacaaaataaaaaagttatgggtttttttattaaaaaacttttattaaagttttataaaaagttattttattaaataactttttattaaaaatggttatggggtgaaaaagttatgggataaaaaatgtaaaaaagttgtggcaaaaaaacttctgggaaaaaagtagaaaaaagttttatgaaaagttacaaaaaaagttatgaaaaagaagttatgggatttttttaaaaagtcatggaataaaaataaaaattaaaagcaggcccctgtcagcaaagcctggagaagtggggccggagtctccaccgccaccatgtccctaccacctcttcccaggcacccctttacaattagggtagcaggacaagacctctgtctaatggggaaagacaaacagaccatttgccaccttgaccagggctgagtccctaaatttctggatgatgatgattgttacttaaaagccagaggctggtggagttggtttgtttggaggaggcctgatggtccccttactctcaccatggcaacgtttccctcaggggggctcccatcttcttattcagagaggtagctgaggccagaaagcggggctaactgtggaccagcgagggcatgggctgctggggtggcccaccttccccggtgtacatactgtgtctgtgtaacattttgtatattccagagggtagggctgcccctgtatcatacctagcagaggttggagctggcacatggggaggaggttctaataattatttgtggctgggaaacttatttattgctagcgcaggacagaggaaagaggcggggatggggtcgtggctctctggtggtatgatcacagcttactgcaacctccaactctcaggctcaagtgatcctcccacctcagcctcccaggtaactgggagtataagcatgcactactatgcctggctaatttttaaatttttttgtagagaaaaggtcttactatgttgccaatgctggtcttgaactcctggcctcaagcaattctcccatcttggcctcccaaagcactgggattacaggcatgagacattgcccctgtccattaggttttctctttattactgttttgttgttgtggttgttgttttgttttattttgttttgtttttttgacagagtcttggtctgttgcccaggctggagtgccgtggtgtgatctcggctcactgcaacttctgcctcctggttcaagcaattctcatgcctcagtctctcgagtgcctggggttacaggcatgagccactgcgcccctggctaatttttgaatttttagttgagacagagttttgccgtgttggccagattggtcttgaactcctgcctcaaacaatccgccctcctcagcctcccaaagtgctgggattacaggggtgagccactgctcctggctaagatcccatctctatttaaataaaaaaagaaaattcagagcatgtggaatacagaacaccaaagtccaaagttatttacctctctgaggtaatctgtgtaaacaatttgaaatatatcttttcaagttcatacttgctatgcatatacatacatatacacacatacgttgacatagttccccttccctgctgtcatgctattagagtcttctttttttggtagaaattggaccaactctatgttctttgctggcccatatttctcctattcagtgatgtgttacgaatgtgtgtttaagtcaatgtatgcaactcttcaatatcattttaaaaggttaaatatacaatcatatgaaggcattacaatttattccaacagttccattttgcacatttaataatttccgttggtttgccagggagaacattctcatgccatggctaaatccttttgtacggccatccttaattattccctgaagataaacttttaaataaagttgctagatgagtctcatttcttaaaaagttcttttttggtagtttatatgtaacactgtagttttatatgtacttgcaaatagctatagtgccagtaaaaaatgtgataaaattaaactctttcacgtatgccaaaaatattttgatttagtgcttcattaagtgcatgattacagtccctgtatcttttgatttacctttctacatttacaattttcagcccagatacttagaggtcacatagtaaattaaggttttcttttttttaataatctccgtctttctaaatttggtgagtcacagtaagttatttttgggttgttgaaagctgtggctctgttctaaatatgagcccagaaatcatgccacttacaaaatatgctttgtcttccaacaacagagagtctggtagaaggtgactgttcttggaacttaaaaagtctcaacaggacaagaacagaatctggaaaatatttctgtttctgataatacggctgagtaggtagacatgctggatactccttgcaaaggcatacttgaaattgccacaccaaaaaaaatccagaatctctaagactgaagatgaagtgaaaatcagaagggctactacaagaataatggggaagcagccccagttatcaagtgacgtgtgcatgtgttcaataaaaagttccaaacctaaaataagttgagaaaaataatgtaattgccctacatatacacatcatcaacaatttttcattcatggtatggacagttttttggtttttgtttttttgtttttttttttttaaaaggtgggattttgctgtggttgcccaggctggagtgcagtggcatgatcttgcctcactgcaacttccgcctcccaggttcaagcgactctcctgcctcagcctcccaagtagctcagattacaggcacccagcaccacatccggctaactgttgtatttttagtagagatggtgtttcaccacgttggtcaggctggtcttgaactcctgacctcaggtgatccacctgccttggtctcccatagtgctgggattacaggtgtaagccaccacacctggccacagccagttttgtttgatttatattcccacttcatttgtatacattccttcttcctcttattttgaagtaaaacctatacatcatatcattttttaattaccttatatgtatctgtagaagacaaggaatttttaaaaacaaatatattcacaatgccattaaataccaaaaaaattaatattctgaaaatagccacaaatccagagttcacattttcttgactttctcataagtgattttttctaggttatctaattcaatcaggtaactgtttgctcatatttacattcccacttgaaaaatgtctaaacttaaactgacataaaacgcagatgatcttccgaccaaatgcttagtgtaaaaaaaaaaacttccaactccaagaggagtccctccaaatacagaaaggaccagtattttaagaggtatgttaactaaaatgtggcaatttaaggagcagagcaggaagaacctttaagtccgaaacttacaacaagtcaatttcatagtccgtttccctggtccttccacagcaacctctggcatctgttttctctacaacggaggtaaaaatagtagctgtttcattagagcagtgctagaagagggtggtggctatataaagtttagctatttgtatattgtaacaaaccaactttttttttgttttggtcaataatagacttcttttggaaaagtagcagcctcctgtctggggacacctgcagttccactaagagaacattggtgtctgctaacctttgcctctatttctctcaataatatactgtcaagctgttccttgatttagcaattttatgtacttccttttcctttcttttttcttttcccttttcctgagacagagtcccactttgtcacccagtctggactgcagcagcgccatgatggctcactgccacctccccccgggctcaagcaatcctcctgcatcagttttcagagcagctgggattacccgcggggcccaccaggcccagctaatctttgtgggttttgttgtgtttttccgttaagagactgggtttccggccaggcgcagtgactcacgcctgcaatcccaaaacaccgggaggccgaggcccgcggatcaccggaggtgaggagctggagaccagcccgaccaacatggagaaaccccgtctctaccaaaataaataaataaaaaagtagctgggcatggtggctcacgcctgcaatcccagccactcaggagggtgaagcaggagaatcacccaaacctgggaggcggaggcccggggagccgagaccacgccactgtactccagcctggacaacaagagggaaactctgcctcaaaaaacaaaaaacaaaaaacaggtttcaccatgttgcccaggctggtctggatctcctaggatcaagcgattcgcagcactcagccgtccaaagtcctgggatcacaagcgtgagccatgacgccaggccgatctattcctgtctgattaaaaattgggccgggcgcggtggctcacgcctgcgatcccagcaccccgggaggccgaggcgggcggaaagcctgaggtcagattgaggccagcctgagcaacatggagaaaaccccatctctaccaaaaaaaaacaaaatacaaaagtagccgggcctggtggctcacgcctgcaatcccagccactcaggaggctgaggcagaagaaccacccaaacccgtgtggtcgaggctgcggggggccgagatcctgccactgcactccagcctgggcaacaagagtgaaactccctctcagaaaaaaaaaaaaaaagaggtagagagactgagtttcaccatgttgcccaggccggcgtgtaactcctaggctcaagcgatccgccgcgctcggccatccgaagtcctgggatcacaagcgtgagccgccacgccaggccaatctcttcttttctgattaataaattgggcctggcgcggtgactcactcctgcaatcccagcaccccgggaggccgaggcgagcggatcacctgaggtcgggagtttgagaccagcctgaccaacatggagaaaactgtctctaccgaaaaagaaaaaaaataaaaagctgggcatggtggctcatgcctgcaatgccagcaccccgggaggccgaggcgggcgggtaacctgaggtcaggagtttgagactaccctgacgaagggagaaaccccccgtctgtagcaaaaaaaaaaaaaaaaagtacaaaattagccaggtatggtggctcatgcctgcaatctcagccactcgggaggctgaggcaggggagtcacccaaacccgggaggcggaggccgcagggagctgagaccgcgccactgcactccagcctgggcaacaagagtgaaacttcacctcaaacaaacaaacaaaaacaaaacaaaaaagcgagaccgggtttcatcatgtggcccaggcctgtctggaactcctaggctcaagcgatcccccgcgctattcctttgtgattaataaattaggccttgcgcgctggctcaagcctgcaatcccagcacctccagacgccgaggcgggcagataatctgagctcgggagtttgacaccagccttatgaacatggagaaaccccatctccaacaacaaaaacaaacaaaaaacaaaatgagctgggcatggtggctcacgcgtgcaatcccagccactcgggaggctgtgacaggagaaccacccaaacccgggaggcggaggcccgttgagccaagacctcaccactgcactccagcctgggcaacaagagtgaaactccgcctcaaaaaaaaaaaaaaaaaaaagagagaccgagtttcaccatgttgcccaggcctgtctggatctcctaggctcaaatgatccccagtgctctgccatccaaagtccctgaatcacaagcatgagccatcatgccaggccgatctgttcctctctgattaataaattaggcggggcgcgctggctcacacctgcaatcctgtagcggaatttttaaggaattagatagactcacggggtttaggaggacatttattaattatttaggtgcaccggcccagtcggattaacatttaaaggattgagtactgaaccaagagttacctttcaagcattatgtagggcgaagggggagatctgtgcagggagaagcatattatagaagcgagaaacaaagatagttatttaattgaaacatgcatttttttttttactatttaaggaaaaatatgttttgtgacttgagtttatttgtttaggcacctagatttattttgtttatggagataatagtaggtacctcataggggattattagatcacgcttaaaattggaccatacttaatactttaactggggctttaaccatcatcatttacatcatccatatcccattatctttccttttggcagaaaggcatatagtgaaatctatgcaaattaaatgaacatatgggaaactcttttttgcagaaggtgttgtggggctccctctacatgacctgaaaagtacctatatggctgtaagacactttacatatcacctagtttataccctggcatgcccatatgacctactaaatcatacaaacacaccaggttctaatatacagtaatattcattttttaacttttcaattaacatataatcctaaattgcatgctttatgttgaagaaaaaaacagcaactaatataccatcatagtgacatattaaatgctagtttagcctgattctcccagtgtaacaatgtatttaaaattttgtagatatattcagtatatgtttcaacatgtctttgggccatatgtattttgtgctaaagtttctctttataaaaaagcaaagcaggagatgagagttttatggtgggaaatgaattcaattattatattctaagggagattaaagagaaaaataaattttcctgttaattctgtgaccaacaaaagtaagcaatatagctgagaaattcatctgagctcacagttgattatatatatataataatttttttttctctaacagagccacaaccaatgagacaattatagtttcaccaagtcaaatgtcagctagaggacttacagtttttacacttggcaaggcaaagcaaagaaatgtgaagaatcctcatttacttgttagccaaacttagtgtcaaaaaaaaaaatattcatcattggttgtcaaacacagggtagttctctgtcactggaaacttctgcagacaggataattactatgattaaatggcagtggatttaaaatatttcggtagtggttaaagtaacttgaatactgatggtataatatcaaatcaaagctgcaaaactgtccgctaattatccagagtataaagtatctgatgctgtgtaagtataacgccaaagcacattcacaggtacagaaattgatgagggcttaatcatgctttttggaaatatagtaaagaagataatgttttttctaccttaaaaaataaattttagaccatgtccttcaagctatacagtttgtattattgacaattggctctgattatataatttactctagccattgctttcaatttatttatctatatttctgattattcctctaacacaaagatactgagggctttctctgtgttaggcaacagctgcaaagctaactcttggaatacagagatgtgaaacaatgctagcatggctcagaaatagtttattgcctcatgaaatttttagcttagtcctattcccataaacatttctatgtgagtggtggggactgggggggcacctcactctcctccagggacaggccatgtcctaagcagtagtttgaaggtatcactttggagaatttaggtctggagactctgtagaaatcagtgaggtttcaaagcatcattattacattgcaaagtcacatgggcaggagtagataagaagtaatatgttgtatttcctcttttgtagtgtgagttagttgatctaaatgttcactgtgttttctctatctttgaattatgtgtaacaacgtagatagcaaagagctgtcaagaggccatgagatttcaaataaacagttaagagcatactccaggaaactgtaaaagaactaattagagtccacgtgttcagtgtcagttcaaagacacagagagataggtgctcaacagatggaatatgttagaacccgtaaaaatgaccaagatgggatggcacaaaatcagcagagctataatcaataaccaatgaattgggactctcttctgtcttttccactgtatttgggtcttcgtaggttattcaatcatgtttgaagtgatgaaaaaccattattcattctcaaggcaaaagaactagatatgcttttgggaaaaagaggataacggaaggtttttaaacttttacaatgggccattctacatgcagtgtacaaatcatctaaaattcatttttcccctagaaagacagatcttaaaccagctagaagttataaataatgtggttcatcagagctgtatactcttaaattcagattttctgagtccatcccacattatcctagttccacaagataactgcaaaaatgtctcattgccaaatacattcaacagtgaactatatagttgcctccaagaaattcattgcacattggtctgttcattgcattaagaaaccttgcagttaaaaacaaacaaaaaatgtacttagtatgttttaaaatatagcatctccaatattatttaaaacttactttccttgttgtttctctgaatatttctcaaaagaactattggaaaatattgcttaacatgattgatcttccatttgattgacctgcgtttacgcccatgcctattttgtgcaggtgatcaattcatttgtgaagagtgctttcataattatgcattgaaatgcacaaggttgtcatccctcaaaaatgctactattatcacccataattaagtctaccaaatttacactagaaaacaaacacaaagagaacagtgggtagttgttagatcatttagcaatcagaggtaaaaattagtagcagaaacaaaattattgtcatttctcaaattattttcaaagacaatgttgccttattactaatatttgattgggaacatttacaaccattaatctagaaaagaaattcttctactgcaatgcacctcctctatttacgtgtgtgaatgagtgtccattttcttaaagttccaagttacttattcattcattaggtaatcttttttcacatggaacgaaatttttgtggtaatttatgatagttgaaaaaaagatttggggtgattataaccctatttagatatttctgcctgcatctacatcatatcaaaaaaagtagggcctcctctcccttccctgaattaactattggagggggccaggcatggtagctcacaattatagtaccaccactctgggaagctgaagcaggaggatggcttgagcccaggagtttaagaccagcctgggcaatatagtgaaaccttttctctaccaaaaaaaaaaaaatttttttttaaatattagctgcacgggcctgtagtcccaggtacttaggaggctgaatcgggaggatcgcttgaaccctggagttttgactgcagtgagctatgatcccatcactgcactccaacgtgggggacacagcaagaccttgtcttaagaaaaaaaagaaagaaaaagtattggagaagtttttaatctgtagcatccttagtcttcaaatttcatacctttattaccactgtcatgtttcatgtgctcaacaaatgttaaaataatgaatctcagcatgatttctagagatcgtactgagcaggatttagaggggcaggggggtttccccacttgtattcctgtccttcatatctgtctcttctggattttttagtttattacttttcagggacaagcttttcgtttttctcctctagatcagcataatctgaaaaatattaaaattaaaataactaataatagactgcattaatagattagttccttgtacagctttcatcgttttaagtgaaaactttctataagttatttagggttttgaatttataatactgtaattaaaataagggttttttcctcccactgacagtaaagctgtcactgccacaagatttgagctaaaagaaaatcgtagattttgtacttctttgtcagcgctgccaaaaaaaaaaaaaagagagagagagagaaagagacatcttgacaacttttaattcaatcagagaacttgagtgaatcgagctttcttctgaagcaccattcatcgagcaagacccctgacggtgccaggtggaaacttaatggatcctttccacctggtttgttttcagtgtttaatcctattagtatcagcaggatgtaagtcagggtatcaggtgcagaacctgtggaatcagccaatttggcttgctcgtttactttaataaggtcccataatgagtgagagtacaaagttcaagccctgttgagggtctgcattaaactctcagaagtatttagagtgtgccaggagccgcgagggtctggttcgggtggtggcgggaactgtgttagagcgctaggtacggcgcgacaaagtctgtccaacccaaaacggtgctgaggcatggggtctgagctccggtactcagaaaagcacctcagccggtactcaacagatcctcgggggcttgggggctcagcattggcagtgagggcatgaaagatataaaagacagggcactacctgtgggtattttctgttctccaaggaggaagtagcaaaaattaggatgctggaatatcctgtgttgtagcaatcccagaacaactggtgctcagcaaataccacacaaaacaaatttttaaaaatttaatctcgccggctacagtggctcacgcctataatcccagcacttctggagggcgaggcgggcagattacctgaggtcaagagtccaagaccagcctggccaacatggcaaaaccccgtctctactaaaaatgcaaaaattagcctggcatggtggtgcacacctgtaatcccagctactcgggaggctgaggcaggagaatcacttgaaccagggaggcggaggttgcagtaagctgagatcatgccattgcactacagcctgggttacaagagcgaaactccgtctgaaaaaataaaaatgtgatctctttgtatctgttctttttcttttaatttttttcttgacccaagcatgtgaactcatagtatacattttgatatcgaagatacactaagaattaagtactagacccaatcccagataacaaaaagtgacataaatagtggaagaaaggactatttattgggtttatactattagacagcgtgctaggaacatcctttattgtcttgtctagaccttttaaacatgcagtaagatgcagatactctttcccagttgtacagaggaaactgaggcttagagttgcagacttaaaagtatctaactgacatgtgggaggatgggaaactcatccagactttagaggaaatgaaggattcattacacaggtgagtgtttcttgcagctgttctagatcagaaacaattaccaatctagactttcatgtgataaagtcattcgatagaaatccaagcgggctgggcatggtggctcacgcctgttattccaccaccttgggtcaggagttcgagaccagcctggccaacatggcgaaaccctgtctctactaaaaatacaaaaattagctgggaatggtggtgctcccagctacttgggaggctgaggcaggagactcgcttgagcccgggaggctggggttgcagtaagcccagatggcgccactgcactccagcctgggtgacagagcaagactccaagactccgtctcaagaaataaacaaagaaagagagaggagggagggagggagggaaagccaagtaaccactctccttcagggcttctagtttatgtatacactatgtactcagcaaatatttttctcttaagtgtggttgtttcgatcctattttcaggaggtgaatgtacagcgtaagtcccctccttttctgttgatatgactgtgttgattggtagtgccagccactttccatctgagcagttctaggtacatactcggttggtacgcaaaggaaaactattctgcatgccattaatgctggaataaaatgtgtttaggaagtgtggctgttttcccaggtcatgtttaattgaaggatttctgtcacatacttgttcttgttgatgtgttcctggggcctggagaaatgctgcccaccccgtcacttctctggagaatctcagggctgcatggatggtatgatgctgcccgggctgaccattctgaaaatactgctggctggtccctagcagcaggtcagcaccttggttacacggtgtttacagaggcatgcccaaaggagatacattgactattcctggttattttttgtcctgtaaatagagacattgttcaaagtcttttttcccctaacatttaaaacaacacgttaggccttttaagtgtttgccaaagaacctggagttttactggagtcttgactaacctgctgaacttttcaagctgaaaccctgagggttacagtataaaaatttagaacctacttagagcagcagtctcctcatgctgttactggtctccttaaagtcagaaacaagatctacagctgctgctgtcggtcacctgagagaccaggctgaggcagcccagcgacctcccaaggagccttttaattactaggttcaagtgtggtttgcagtgaacgtggcgaaggaggtgtgggctgctgtgcagtgaggcagaggcagagcactcagtgcgcatttgtgccctgcctgttcctcctggcaactccaggatgtcatcagccttgcagggagggggctcaccttcttagtgtgggaaactggccccagggcatacccccttgagcgtttcgtagttagaaacttgtgtgcagcttcccaagggaccttcctgtgtacagatgtccactctgtggaaaaggatacaatgggaagcttccagtgtcctgtgcagcttcttagattccatttgggattcacctggaaaaagcaatgccttaccccttgaagtttctccatttaaactccagttaggtaaaggggagaaaagtagaaatattcaccttttgtgttccccatcttttaattttttgttgtttcggttaataaaaataacatattcagcatgagaatttggaaaatgcagaaaagtagaagacaattaagcccccagccccccactcgatgctgtggtaacaagcattcttgctctgcggccaacctcataccctgtatgcagcttgtatcctgccttttccccttttagaaactcttggccaaataatcttaaccataagcatagtatttcatattaaaattttgttggttttcttttaaaacattgtttttaatatcttttgccaggtcagcttcaataagatataattgtacccaatgaaggtcatcactttcaggtatgcaatttgataagttttgacatctgtgtacagtcatataaccaccactatgatcaagatatagaactccatcactccagaaatttccctcatgcccctttggagttgatccttcccccaacccccacacagatcccagcagccattggtcttctttctgtccctgcgattttgtcttttccagaatgtcatatacctggaatcatgtgatagttagccttttgagccttccatttaacttctttcatttagcatgatgcatttgcgatttgtggtggtgcgtgtatcctcagttcactccgttttactgctaagtggtattccactgtatgcaggtatcactatttatccatcacccaggggaaggacatttaggttgttgccagtttttggcaatcaagaatcaagctgctataaatatttgtttacaggtttttgtatgaattaagttttcattttctttgggtaaatatccaggagtgggattgctgggttatatggtaactgtatatttaacttcataagaaattgatacactcttttccaaagtggcatcaccattttggattccccccagcagtatacaaggcttcagctcactctgcaccttcaccaatacttgatattgatacacaccccttttgcttgtttgttcagcagttctaatgggtatgtagtggtatctcattgtggctttggtttttatttccctaatgactaataagcatcttttcctgtgattttttgccatccggatttcttatttggcgaaatatcttttcattttttcccttttgtccagggttgtttattttctgactgcattttgagagttctttatagattctggatacaagtccttttaagcattttacaaatatattcttctagattggtttttcttttcattttgttgttggtggtggtggtggtttgttgttgttgttgttgtttttgagacagagtcttgctctgtcgcccaggctggagtgtagtggcacgatctcggctcactgcaacctccgcctcccgggttcaagcgattctcctgcctcagcctcctgagtagctgggattacaggcgcctgccaccatgcccagcttatttttgtacttttttagtagagatggggtttcacca[136 bp omitted]gttttaaattttgatgaagtccagtttatcagatttttccccttggattttacctttggtgtcatatctaaaaaatctttgcgtaactctaagttgcaaatattttcttctatgttttcttccagaagttttacagttttaggttttacaattaaaatgtacagttcaagttaatctttgtatataatgcaagctatggattaaggtccactgtagcaagcggcagatgttcttaagtatctccctccctccctccctctcttctttccttccctccctccttccttccctccctccctcttttttttttttgagacagtttcactctgtcacccacccaggctggaatgcagtagcactatcacagctcactgcagccttgatatcctgggctcaagtgatcctcccgcctcagcctcctaggtagctgggaccacaggtgtgtgccaccacacctgacaaatttttaaattttttgtagaggcagggtctccctgtgttgcccaggctggtctcaaactcctgggctcaagccttcccttatcagcctcctaaagtactggattacaggcatgagccaccacacacagccaagtgtctgtttaaaaagaaaagttgttcctaaatgattccttacactccagtaaaacagggctgtgaaaatgagttatgtggaaagctgaccgtagctgctgctttttaaaaaccataccttcttatccgcccgttttgagactggccctttgttgatctacagctctccttttctggaagatgctggaaagaacactgttagtggccttcatttcccctctggtctgggtctcctgtagatggcttctacgattctggcccctctgtacacatcattctcgctcagcagctgcacaggtagacagtgaaaactagcatctttttgattatagactgttggcttcctggggaacagccatgttccatgttgggtcagcttattgataaggggaagagacctagcattcattaaaaacttacccagcaactttgctgtgtcacagaagtcctatatagcataaaatagtactaggtccatcttagatgaagcagtgagatctgttcaaggtcatccagctagtaaaatggttcaacttgacttgccttactccagaactttttgcttatgccattatttcctgttagctcttcatggaaccacttcctgtgtgtctgatggctcactgtgcactcacacacacacaccaactaatggcaggtgcagattggcaggtgcagatgacaagtattgcagtgcagttgcttttagcaatttatcttcctttttcttctgagctggatttaatttactttagtttcccacatttggcattgtagcttttacctttagaatggctaattggctactgcaatatttctttcatatgtgaattataaaagtggccttaatggatgtttcttttcatccagttaggtgtttattgtatcagtgtgtgactgggaaggccaggctagctgcaggttatcacaggcctcttgcagtacttcactggaccccttgagtccttttcagtggatcatctcctgcccatcttcactactccggagtggtctcaccatctttactgggagtcccagaacgtgtctgttcagagcgatgagacccagggcagaaagattccggttaccctttcccggtctcctcatcctaactccttggatcttatcacagtaaatgatcagaagtggaaattctcatgttagctgaaattctcttcatgtttttttcttgtgtttagacctcgttatctttaggcatccctgttactgatgataaccactctgattccctagtttgtaagacactgcaccccctccatatttaaaagttatttgccattggaggtatcatcaaagactactctccctttctaaaatcttggtgttagcagctagaagagagactgccagtcttccccgccagccctactttatgacttaatgcatggcaccacttgtgcagctgatgcctggtcgggccacactttccattatgaacatgctctttcctgacttccctcacattcattgaagtccagtcccggctcagttgctggccgcggctgcttctattgtagaaagtggaatgaataaaaatgaagggcttctgacactggggtgaaactttgtcactgaagagatcttttcaatccaagaagaggaacccagccagcttcgccaaagctggaaaaagctgcaaccttcttttgcccctgttgagatattggaacccccactggttggcttccctctgccctacagctgcccacctgagatttctcacctgggcagagccacagcacagcacagagaaactcagtttccggggactttggcagggatcttggtgctgtgggaggattcaaaccccatctcagccacttgctagctctgtgcatctggtcatattaccccacttctcgcaatctgttcttgcatctgtaaaatggggtagtgttaccacctcggtgggcttttaatgaagattatatgagttaaatgcccactgtattgccagcaaagaatccagcatggtgctcagtgaggaataccgtgcatggctacagtttaactcctgtgaaataaatagatgctggaggcagggaggtgcttcctccgcccccccgtgatgtttctgtggtttcaccttcccatgctgggcactgccctccctagacaagacctgtctgtggactgtttccagtacagctgtttagccagacgctggccccgtctgcagccatcacaggccctctgtctctctgctggtcatgtcatgctctcctcaaggtgccgtcctgctgttcatattgtttcattctttcccaccaggaagcatctggacgaacagtcctgccacgctctttgaagttcccgacacatggtaaccaagacctgagggcagcaaaccgctggtgctgtctctgtgagcaagagccgggtggcacatttggaagccatactgtatttaacttaatcaaatgtggtatgggaggggttggaaaccaagttgtctcctggggggaagaaaagacaggttttatttttgtggctgtgtttttttccctttttaatctaactgcctgttgatgttgacactcatcagggttgtaggctgtcatgaatgtgtacgtgcttaaccagtgaattccatgttgctcgtgtgaggcctttcctgtcatgacccactgtgcttaagaacctgcctgatggggagtgtcggctgtgaaatctgcaaaaagagctgacgttccggctgccgtgatcatgaattgggggtgtactctcctgcctgtgcatcttctcgcgctgagattttgaggcggttgcagccctcggttagtctcccagtggagagaaatcagttgtgcctccctgcttcccaccatagctgcctgaaaacatgacgctcttacgcttgtccttccatcaggaaggtgtccactcacgcccacccatgagggggcttgccgtatgccctggcctttgggcatatttatgtagagttcctttctcctaagacgtgagtttctgatgggggatgtacgagtaaaaaggttaacttctgttcttatgcgtggcgctgtgttcactttccagagtctgtttggatggcggtctcggggtacggcagcgtgtgtgtgtatgtgtgtttgtgtgtgtgtgtgtgtgtgtgaaatcgtgcaaatctacatgtcccagcccattctctgttgaaacagatcacagcaacgacaaacactcatggcgccgcttcactccacccgcttcagatagatcattgttagatatttcacatttttgtatggtggaaataaaaatgaaaaatgtatttccaaaagatgaaaattaaagacattttcataggactctggttttctcctctctttttttaaataagtgaatgatgttttcactctctagtaatacacagataaatttcacactcttaaaaaatctgctaagccactaaggctgatgttcatggatttttttctttttctttttacccctaactgctgtacctgccacgatgggtcagctcctcagtgcagagctgagccctggtgttaagtggccttgtaggagggtgggaggaatgaggacccttagcactcacgctggaatcccaggacgttatgcagattccgatttgtaagacaatttccccaatcaagagcctctgtcacacctgtaagctgagatgggaggatcacttgagcccagaagttcaagaccagcatggacaacacagtgagaccctgtctctttaaaaaaaaaagaaaaagaaaaagaaagaaaaaaaatttcttttttttttttgttaagcatgttaacttctctttaagcatgtttaaaaaaaaaacaacttctctttttttaagcatgttaacttctggagttttgtagccacaaagttagaaacccaggcttggctggaaggactgcccacccctcctgtagtcagcacccacggctcagtggaaagtgtgaaggtgggatggagacagacagtaaaggagggtgtatgcaggagtgtgtagagagggctgccagactgccgagtcagcagcactcacagggagaaatgaggagagtctgacccttctttttgaaagaaaaagagggggcccagcacagtgtctcaggtctataatcccaacacatcgggaggccaagacaggaggatcacatgaacccaggagttcgagaccagcctgggcaacatagggaggtcccatctctacaaaaaatacaaaaattagccgggcatggtggcgcatgcctgtggtcccagctactcaggaccacaggagaatcgcttgaacctgggaggtggaggttgcagtgagctgagattgtgctgctgcactccagcctgggcaacagagcaagaatctgtctcaaaaataaaaggaaaataaacaacttcacagggtagttgtgaggattaaatgaaattacatacaatgcccaggacgcgcaagtacatagtaaattgtagttatatttaaaagtcatggttttgatctgaaacccttactgcatttgcttctatcagtgggagcagacatagtcactggaatgtggcttagaatgaaacacccagaggagctttcatacatgcccagaactttattttctctgctgcatcaaatgacttaaaacaagtgagctgtggctcacgcctgcaatcctgccactttgggaggtggaggcaggtggatcccttgagccaggagttcaagaccagcctgggcaacatgacaaaaccctgtctctacagaaaatttaaaaattggccgggtgtggtggtgttcgtctgttgtcccagctactcaggaggctgaagcaggaggattgcttgagcctaggaggttgaagctgcagtgaactgtgattgcaccactgtgcttccagcctgggtgtcagagcaagaccctgtcaaaaacaaaacaggtgagctgggctaacccacttcctcctccacacacacacaccgggctttcttgacatatcttttgggcataaaatcctaggatggtacttctggccttttgataccgaggcccaggggcatattatgacaacaaggctatggtctgggggcttcttgaatatggtagccagatctggaggcaggcgtcagagtgggaacttccgtgtttccctgcagatagttctgtagtcctttgattttggagctgggctggagaccaagcgctgtggctctgtccattttcataactgtgtatttctccagttttccccttgagattttattatgaagattttcaagcatacaccacctaggtcatcattaccattttgttatacagtcatgccttgccgtcaacaatggaggtcccactagatgatcttagagctgggaaattcctatcagctccagtgtatctgtgttttaagctaagtgtttttacaaaggggtcaaatagttgaaaaaaatttagaagtttattaagtaaagaagttacagtaagctaaggtcattttcttcttgaaaggaaaatttttttaaaattcagggtaaccgtgagtcccaggccttcacattcactctctatcactcaccagaacgccttccagccctgcaagctccattcacggtaagtgctctacacaaatgtatcatttttattttttatactgtatttttattatagtttttctatgtttagatacacaaataccattgggttacagttgcctacagtattccatacagtaacatgttgtaaaggtttgtagcccaggagcaataggctatactatctaggtttgggtaaggacactatgatgttcatacaatggtaacattgcaggctgggcatggtggcttacacctgtgatcccagtgttttgggaggccaatgcaggaggactgagttcaagtctgcagtgagctatgatcacaccactgcactccagcctggggacagagtgagatcctctctctaaaaataataaaataaaaatccttctatccacgtttgggaatattaaatttttttaaatcacctaatgacacatttctcagaaagtatccccatcattaagtgacatgtgactgtatttgctttattacatatccttccattcctcaatttatcttttctttctttctttctttctttttttttttttttgtttacagacagtctcactctgttgcccaggctggagtgcagtggcatgatcatagctcactgcagcctcgaactcctggccttgagcagtcctcccacatcagcctcccaaagtgctgggatgacaggcgtgagccacagtgcccagcctacataacgtttttgagattcatcaatgttttgtaggtatcagtacttccttcctctctatttctgagtatggctctactgctgcttatttattcaactgatgaacacctaggctatttccagtttggggccattatgaataaagctgctgtgaacagtcttgtacaagtctttgagaacaaaatcttcaatttgggggagtaaatgccaaggagtggaactgttgggtcatgggataggtggtctatttagaaactgccagatctttttccaaagtgatcatgtaatttatactgtcaccaacaatgtatgagagttctattatctcccttccttagcaacatttggtggtgtcagactttaattgagccattttgatgggcgtatagtatatctctttgcagttttcgttgtcatttatctgatgactcctaatgatgtacttactggccacaggtatatcttcctttgtgagttagctgttcaattatcttgcccatatttcatc[131 bp omitted]cacgatgaaaccccgtttctactaaaaatacaaaaattagctgggcatggtggcaggcacctgagcctgtaatcccagctacttgggaggctgaggcaggaaaatcacttgaacctgggaggcggaggttgcagtgagctgagatcacgccactgcactccagccagagcaagactctctcaaaatcaaaccaaaaaaaaagttgtagcagtaagttgattacatattttggacatcagtcctttgtcagatagttgttttgcaaatatttagtcccaatgtatggcttgcttattttctttttttttttttttgagacggagtcttacactgtcaccccaaggtggagtgcagtgacgcgatctcggctcactgcaagctctccctcctgggttcacgccattcttctgcctcagtctcatgagtagctgggactacaggcgtctgccat[142 bp omitted]gctggcttgcttattttcttaacagtatcttttactgggcagaagtttttaattaggatgaagtctgttttatagactttttctatgtcctgcctaagaaacccccaagttatattcatccatgtttccttcgagctttctagttttagcatttatgtttaaatctatgatctatcttgaattaactttttatggatggtacgacactagagttgagattccctcattccatatggttgtctagttattccagaaccatctgtggagaagacctttttgtttaattgttgtgctgctttggtcaaaattctgtttacttaattataagcatggatcttgagggggtgtgtgtgtttcattttatttattttcattgacaaataataattgtacatgctcatggagtacatagtaatgtttctttttttttttttttttttttttggacagagtttcgctctgtcacccaggctggcgtgcagcgccccaatcttagctcactgcaacctctagctcccgggttcaagcaattctcctgcctcagcctcctgaatagctgggattacgggcatgcatgaccatgcccagctagttttttgaatttttagtagagacggggtttcgccatgttggccaggctggtctcgatctcctgggctcaagtgatcctcccacctcagcctcccaaaatgctgggattgcaggagtgacccactgcccttagccaatagtaatagtaattttttgtttgtttgttttttgagacagggtctcgctttgttgcccaggctggagtgcagtggcgtgatctaagttcactgcagccttgacctccaaggctaaagcaaccttccaacctcagcttccagagtagctgggaccacaggcatatgccaccacacctggctagtttcttgtgttttgttgttgtagaggtggggtttcaccatgttgctcaggctggtctcgaactcctgggctcaagtgatctgcccgcctcagcctccctccagaagtgcgggattataggcgtgagccaccacgcctggcctggatcatatgatgtgctatttgtagtgttttgaggagcctccatgctgttctccatagcggctatactagtttacattcgtgaatgtgagttttttatttatttatttattttgagacagagtcatattgtaattacatatataacgtaatgaggtgatggatatgctaattacccttatgtaatcattatacattatatgtgtggaaacattacatccgtggttcacccaggctggagtgtagtggcacaatctcagctcactgcagcctctgcctccgggctcaagtgatcctcccacttcatcctcccaagtagctggagttatagtcacatgccactacacccagctaatttttgttttgttttgttttgttttgttttttgagatgcagtctcgctctgttccctaggctggagtgcagtggcatgatctcagctcactgcaacctccacttcccgagttcaagcaattctcctgcctcaacctcccaaggagctgggattacaggtgtccgccaccatgcccagctaatttttgtactttttagtaaagacggggttttgctgtgttggccaggctggtctcgaactcctgacctcaagtgatccacccaccttggcctcccaaagtgctcggattacaggcgtgagccaccgcgcccagcccctgagtgtgtgtgtgtgtggttttgttttgttgttttttgtttgtttgtttgtttgtttttgagatggagtctcgctctgtcacccaggctggagtgcagtggcacaatctcagctcactgcaacctccacctcccaggttcaagtgatgcctgccttagactcctgagtagctgggattacaggcatgcgccaccacgcccggctaatttttgtattttcagtagagacagggtttcacc[138 bp omitted]cagcagcaccaagagagtctcacagttcctgtgtgttcccacttggactattttgcaacactcctcttgacgttgaaaagaaaatgctatgacacttggttactgctgaggcgaggccaagccaccctctccagacctgggaaaccagtgagtattaaaaatagttcaatctttttcgctacttttttaaaaatctcatgagttcagctgaaatctttttccccaaaatgattcatggagtaaatcaatgcatctgatttttgctgaggaggggaaataggacacctgaaggccagttcatgtttcccctggttgtgagccatcctctcctccaagttgcctgatccctgcaaacagcagttctgtttgtcttcagctgcctgctttttctagtcgtgctgtgaacttgaacttgagaaagcttgatgctgactgggcctggtgaaaacgctacacgttcaagttgagggtctttttaaatggaaatcttttagactggctcatgtctgtaatctcagcactttgggaggccgaggcgggcagatctcttaaggtcaggagttcgagaccatcctggccaacatagcaaatccccgtctgtactaaaaacacaaaaattagccaggcgtggtggcgcatgcctgtaatcccagctacttgggaggctgaggcaggagaatcacttgaacccaggaggcggaggttgcagtgagccaagatcgcaccactgcattccagcctgggtgaccaaaaaaaaaaagaaaaaaaaaagttttccaaaaataaaggtttagacagatgattcttgtcaaaaaaggacaacaaagaagcacctttttttttctgttttagggggtgaggtggggaacttaagtatgtttcataaggaaagagtgaaccctcacggtgatattttttaagcttgaaaacataggaaaatgctaaatcagaaacttgaagccagggagccttgcctgtgtgtgcaagcgtggacttgagcaaagcgaagccttaggcacctgtgccaggcccgtgcaacttttccgtggacacgtcttcccatatttccaataacaaccagagaaccagttacccgccttttgctgccgtcctcttcctgcaggaggaagggtggggggacaggattcttccacccaagtgcccttgcaggtgtctaagcctgggcggtggattcttggttcctggcaggccttggtgggcaggcaacagccagaatgccaaaaaacacccagttagattgaatgtggttccctagttgcggctgtcggtagggaggaaacttaagtctccttacacatctcctctctgcgcgctgcggtctagtttgcgcagcctcttcttattcctaataacccaaaatctgagaatttagagtccttcttgttacttaggaaggactaatcttccccggcaggttgtcctgcatttgttgaatggggtaaaaattgcatagcatctcgagtgctgtgcctacaaattaccttgataaacgattgtgactcagcaaagcttaggcttttgccctagttttggaggctggggctaactaggaaaaaatggagggtctgttgggtgtttctgctgtttttacaaggcttcagaattccccactgtctgcgtgtgtgtgaatcagcaagtgcttcgcatcctgattgggtggtgtgatgggagcacccacctcgcagagcctcagagccctcattgtctcccttttccatttgctcattcctactttggctagtggcaccctgaaagagttttcatcagtaacagtgttgaggaaaccacgcattagaggcagcggggccacactaatcagcatctgggctgggtgattgctcagatctgagctcggagcttgctgtgctgctcaccagctgtgtgagcccgaggatgctgtcccggctcccagcctcggtttcctcagctgtgggactagacgggactaaaccagggggagaacggaaagcacccacgggtagtaagtgctcaccgaggcattttcccagattcctgccattgtttactgacactgggaagcacccacagcctcctcctggaaaacacacaccccctgctctcaagaactttccattttaaaacagacttgccctctggtgtgtcatccttgctttctgaaagtgagttttcttctctacgccactgtatgtttttttctgatagcagtagggaactgtgtattggagctcactctatgggaagcgttttgtactcttgacgtttaggcatgattatccccatttgaaggtaaacggaggctcaggcgggttcagtaacctgcactggaggtcagggtcagtggcagagctggaattcaagccccaggatgtctgactgcaacgcccatgtgcctaaccacgatttgataccgtcatccagatgaaggacatcacagggtagggagataaagatagaaggaggtggaggtgcccagcaactgagggtggctgggatcccttcataaacctggctcatctatgtagagcatggatccttctggagtcagtgcacctggatggggccagaatcccccctcttcccactctctctgtctgtagctctagaaatagagttatacacatacctgcaacttcccctttctgcatgccacaggcagacatcacactttgtccatctcttagattattcttaagagatagcttccaggaagggggattacagcaccaggaagcagaaacatttcaaaggctcttgatacatgtggccaaactgttttccaatttactcatcagccagaggactacagatcctgcagtgcagcatttaaaacacccacctcccaaaccagccaatcatttcttttttctttttttttttttgagatggattctcgctcttgtcacccaggctggagtgcaatggcgtaatcttggctcactgcaacctccgcctcccaggctcaagcgattctcctgcctcagcctccctagtagctgggattacagttgcatgccaccacacccagttaatttttgtatctttagtagagacaggatgttggccaggctaatctcaaacttgtgacctcaggtgatccacccacctcagcctcctgaagtactgggattacaggcgtgagccactgtgcccggcctttttttttttttttttttttttttttttttttttttaagagatgagatctcgctctgttacccaggctgcagtgcagtggcacaatcatagctcactgcagcctcgaactcccaggctccagcaatcctcccttctcaacctcccaaatatctgggaccacaggtgcatgccaccacgcccagctaattttttattttttatttttatttttattttttatttttgttttttttgagacagagtctccctctgtcccccaggctggagtgcagtggcacgatcttggctcattgcaagttccgcctcccagattcaagccattctcctgcctgagcctcccgagtggctaggattacaggtgcccaccaccccgcctgctaattttttgttatttttagta[143 bp omitted]tcacgccatattgcccaggctggtcttaaactcctggccctgagtgatcctcccaccttggcctcccaaagtgttgagattacaggtgtgagccactgtgcatggtgaaatatgtttttatatattgggacaactgagaatattagaatgtggacaggctattagatgatactgaaatgtgttaattgtgcttaggagtgacatgtctaatgtctaacttatctttaacctcacagagtgagatgaaacaaatacagaaaataataattaccaaatctaggtagtgggtagataggtgggtttatggtacacctgggatgacaggtgtgagtcaccgcgcccggccttaaacatttcaattacaagggggatatgggggcccacagcgacaaggggtttcacctccaggaagaaacagacatggaacctgctggctgggctttgaaactccttgttctcagcatgtggccccagtggagcagcatcagcctcacctgagaccttgctagaaatgcgcattcttgagccccacttcagtcctactgagtcaggaactccagggccagggcccggctgtctgcaaacaagccctccaggtgattctagtgcctgtgcaagtttgggagctgctggtctgcagaaagctaggtcaactgaaagaggaaatgtaccacacttatttataaccaaatgtgtgccagctgggagcaagtccaagggaaacgtcacttccatctctcgttcacatgatgagttggcgcctcttaactcaatagtgtctttagtttggatgatttgaccacatggaaaatgtccctctgtccctcatgctaaggagcctagccctcacaaaccgttgttcttcataccgaggcctatgatggcctaggcacgttattattaatatccctgttgttccctcgggaggggatatgaaggcttagagcagtttattttttttaattttttttccaagacggagtcttgctctgttgcccaggctggagtgcagtggtgcgatcttggctcactgccatctctgcctcctgggttcaaacaattctgctgcttcagcctcccaagtagctgggattacaggtgcccaccaccacccctggctaaattttgtatttttagtagagacagggtttcacaatgttagccaggctggtctcaaactcctgaccttgtgatctgcccacctcagcctccaaaagtgctgggattacaggcgtgagccgccacacccagccctcagagaagtttagaaacaacccaatgtcccacagctattaagtggcagaactgaaactcaaacccagtccatctgccagagacggagctttaacggccacacaagctgagagagagaaagagagttgagacacttatataaggtgggagccctgcaaatgattgggtgtggtggtgttctggaatcttctgaagctctgtattgagtgctgtgaggcatggctttcccctgccccttctaaacttggaccctgacacatcaaagccagtcttgggcacatgtggctcttgcctggttgacagtccccatcaagctggtgaggtggtcttgtcttttttccccaacctgttgtaatttgactcttaggaattgtgccgtgagcactgagacttgtagacatcccattgtaggggtcttggttgtgtatcactgtgcccatggctcttagggtgacacacacccaactcccaaatcctgtcccgaatgacaggtgggatccagaggcacttgaaagcccagggagtctgagggacagggatgctgacagtgggcactggtggtttgtctgttttactgtttcaggggaatgagcccaccatgtggaattcagatgggccttctggctaccccaggggcctccggctcagcttcctgggcatgtcagagagccgtgccaggggccagagctgaggaatgaggctcggcttactgcccacccaggaggagtccctctggagagcctcagaaagtacctgcaatggcaatacaacagaagagcctctaaatatttccttttggggatacggcaggaaagccaaaggaaatgcgaagaggtgtctgaacgcccagaggaaatcagtgggcccttccagaagttctatttgtggtaagaaaccttggcacggggcccccagctctcctgcaaaaatagaccaatgtgctgagaagcagctcaattctgggagcaattcccctccatggggaagagagcttgcactgggacttagaaggatctgccccctctcttctgcttgcccctggactccagaaccaaaaacagggagaaaaaaaggtaaacattttttaaaaaagaaactcttggccaggtggagtggctcacacctgtagtcccaacactttgggaggctgaggcaggaggatcacttgaggccaggagtttgggagcagcctggacaacatggcgagaacctgtctgtatcaaaaaaatacaaaaattatctgggtgtggtggcacatgcctgtagtctcagctacttgggaggctgaggcaggaggattgcttgagcctgggaggtcgaggctgcagtgagctatgattgtgccagtgtactccagcctgagtgacagagtgagaaccccatctcttaagaaaacaaaaaaccagaacttatgaatgtatccatgacttaactcaaaaatgggccagtggaaacacagggcaaaggaaggtttcaaataagcacctggacacaaacagacccaggaggtgacacacggcattgaggacccactccccatcactaggtcctttggccccaaatgagtgagatgactaagaaaatagggtaccatgtgcagcagaagggagggtggctagacagaaaatgatggccttgactgtgatggtcatcacagacaggacccctaagaaaggtggccaagggggtctggggacccacttttagaataccaggctgacagcataacaggggtttgggacaccaccatgaaagaagacaatgaagccaggtgcagtggctcacgcctataatcccagcactttgggaagccaagacggaaagattgcttgagcccaggagtttgagaccagcctgagtgacatagcaagacccccatctctactaaaaatttaaaaattagccaagcatggctgggcacggtggctcacacctgtaatcccgacactttgggaagcc[133 bp omitted]gaggcaggaaaatcacttgaacccaggaggttcagtaagccaagatcatgccattgcactccagcctgggtgacagagtgagactccgtctcaaaaaaaaaaaaaaaaaaaaagccaagcacagtggcatgtgcctgtagtaccagctacttgggaggctgagtgaggagggaggattgcttgagggcaggagttggagaccagcctgggcaacatagcgagaccttggcttggaagtaaggaaggaaagaagggagggaaggaaggatgaaggtagaaagaaatgggacaagatggactcctgaggccatcctaattctggaacacaatacaatggcctctgtatgttaggagggctcatttggcttctctctaagccagcggtccacatctttttggcaccaaggaccagttttgtagaagacaattttccatggatgggatggtgggggtgggtgtgggaggggatggtttcaggatgaaactgttccacctcagatcatcaggtgttagattctcataagaggtgcccaacctacatccgtcgcacctgcagtccacaatagggtttgtgctcctatgggaatgtaatgccacactgatctgacaggaggcggggctcaggtagtaatgctcactcacctgccgctcacctcctgctgtggggccggttcccaacaggccatggaatgcttactggtccacagccctggacttgggcacccctcttctaaggcacaaacttctactgtcttaggagcagcaccctggcctccacagcagggagagagcaggaatacccagccacagatattgatgaagatattgatcaacttcctaccgtcatggtggagccatgcctggaggcctctggatggtcatcaggtaaccccagcacattttcctgtcccagactcctggccacgctgaggttgctgtgaacagacacgatgtgcagggtcatggatgtgaagctagaactccttgacaagcaggagctttattttatggcccaagcagtttggaaacaaaatcataaagtgcttacccatccagtgtctccccagcctgcactgggaggtatcaaactgaccagatccgacagccccttccgcccgcagaagatgggtctgcgtttctctgtctttccctcttggtggccaagaactgtcaacatccagctgtggctctgcactcagccgccactcagcctgctcaggttgaaaggtcaaatgttgtctggaattggcagcccagcttactagcagctcttctgtcttcagagtgcagcgaggggagctgtcagagggctgaggcaaggaccagagaggcaactcctgcgacagagaaagctcatccctgggtatgttctggagggagaatagcagggtctgtcccaggaactttattagctagcggttaagatcctcatccccagaaaagccaataggaattagctgggtgatgtgtgcctatggtcccagccactcaggagggtgaggagggagaattgcttgagcccaggaggttgaggctgcagctagctatgattgtgtcactgcgctccagcctgggtgacaaagcaagatcctgactcaaaacaaaaaaaaaaggaagaaagaagaaagagagaacgaagaaagaaaggaaagaaagagaaacagagaaggaaggaaggaaggagaaaggaaagaaggaaggaagaaaaggaagaaagaatgacaaaaggaaggaaggaaagaaagatgaaaagaaaaggaaaggaaaagaaaagaaaaaagaaaggaaaaaagaaaagcagataggaaagtgaggggagagggccaggaagacagaagacaggatgggcaagaaggatgggaaggattcccacaccagattcaggagtggctctgcattgggaaatccttctacaactgctggggacttggttttgcaaacatgcacagagaaaccttcatccacctctgtgcaatgttggactgaagtagaaatgagctgctgttttctggaagcaccccatttctttgagctgatcttctctaataatgaattctggtgaagcctgccattcacagcaccccgccctcccgtctgtaggaggtgggcacaggacccaggccagctgatcagagagctcccttgccctgggatgagcacgtgacccagatggctcaatcacggggaagatcctcttgcctgttgtagccactatgctggaagaacaggatttgggcttgttggccgccatcttccagtccacactgggaacccatttgcaggaggagggaaggaggacaacccagtttgagggagcatatggacagcagctgtggaaggctccatatgtgcccaatactagatctaccccatcccttcctgttccataaatccatacatcttctcccacttttgcttaccctagtttgagttacatttctgacacctgccaccataaaagcccaaatgattacaaggaatatttggctgcagaaaagaccctgcagtctgtgaaaaaagaggctgctggtgcatagtcatcacagaccagtgcaaagagtgaaacagaaacatccagcttaatctgcaaaagcctttttggatctttgagaggcgttcattaacttacagcaaattgatgagctgatattcttctttcatccaggtgagtgcattaactaggttaattttcctgtctcaagggactgctgtaggttagggtgaatgaatgaaagaagcaagtttttaaacaggaaaaaagcttcagagaagttgaggtgacaagcatcgcttcacccccaatggaaggtgagcttgtctgttaggtcccagggactgaactggagttccgtggttaggggatgacccatctcaacaagaaacttccatcatcctcccgtggggatctgattaagatcttctccagaaggagatggcctcatgagttggggcttttcaatctccctgtccctcctctagaagggcattgctactggccttgccctgccaagtcttcagtctacaacagcactgacccgcttcagacacagcccagatccttcccagacacgctgttattccgactttttgccctttcagtccagccttccctatcacttatgctgaaattgggaacatttcccaaaccaacagtttcccagtccacaatgttcccttgctgagtgtccccacaggacaggcaggcagcctgataaataaaaccagtcataaaacctccctgccttagcaaagggactgctttgccaggctgctgtcacatagcactcctgtctcccgtttgacttcacatagtgaaaattgtctaaaagataaggcaggagctctggttgacaccaccacccccatagatctctctctagaagcattggaagaggccgtctcaaaaaagaaaaaaaaatagaagcattgcaggaaagacgtggtttgtagtgaaacaaattggaagtcaagctcagcctcaaccacttacttgcttctgaccttgggtaagtcctatgtacctaggaacctcggttttcttttctttcttttcctttttttttttttttttttgagatggagtcttgctctgtcacccagtctggagtgcaatggtgcaatctcagctcattgcaacctctgcctcctggattcaagcgattctcgtgcctcagcctctagagtagctgggactacaggcgtgtaccaccatgcccagctaatttttgtatttttagtagaaacagggttttgccatgttggtcaggctggtctcgaactcctgatctcaaatgatccacccgcctcagcctctcaaagtgctaggattacaggcacaagccaccgcgcctggctggaacttcgactttcttctgtacaatggaggggggacagtaatactgcaatatttacaattaggttcaactgagagtaacagaggtctgaatacagtagctgaaatggggtgggcagatcacttgaggccacaagttcaagaccagcctgggtaacatagtggcatactatctacaaaaaaataaaaattatccgggcgtggtggcacaggcctgtaattccagctacttgggaggctgtggtggaaggaacacttgagcccagaaggttgaggctgcagtgagctgtgattgcaccactacactccagcctcggtgacagagtgagaccccgtctctaaaaaaataataataaaaaaaaaatttggccatgcctatctgcaagaacatctgggaaaggtagctgcggtaggtagcctcaaaaatgcctccaatatcactgggtgcagtggctcacactttgggaggccaaggcaggaggattacttgagcctaggagttccagacaagcctgggcaacatagtgagaccctgtcactacaaaaaatttcaaaattagctgagcatggtggtgcatacctgtagtcccagatacttgggaggctgaggtgggaggatcacttgagtccaggagttcaaggctacagtaagctatgatcacgccactgcatgctagcctgggtgacagagtgagattctgtctcaagggaaaaaaaagccccttctccactccccaaaagtccccattaatccctttattccagcattttcccccttgtgaggaagaggggaaatttgtatttgtatttgtattcccacttgctttgagtgtggctggacccagtaactttcttctaaccaatagactatggctagaagaatagaatttagtcacataaccatgtctagctgcaataacatctgcattagtctattttcatgcggctgataaagacatacccgagactgggaataaaaagggattttattggacttacagttccatatggctggagaggcctcagaatcacggcgggaggcaaaaggcgcttctttcatggtggccccaagagaaaaatgaggaagaagcaaaagcggaaacccctgataaacccatcagatctcatgagacttattcactatcacaagaataacacgggaaagaccggcccccatgattcagttacctccccccaggtccctcccacaacatgggggaattctgagagatatcattcaagttgagatttgggtggggacacagccaaaccatatcaacatctgtggtaaaagtgatgggatgttccttctgagattaggtttcaaagagatgacagttctgtcttgggcatcctgtcttgctctgaggaaaaccagccaccaggtagtgaggtgctcc[218 bp omitted]aaaaaagaaaaaaaaagagaaactgatgcctctggtcaacagctagcaaggacctgaggcccttagtgcaacagtcttatcatgagtgagcttgggaagaagatccttccccagattaaccttcagatgatggcagcccttgcagaaatctcagtgcgatctcacaagagacctgagccagaggactcactgaaaacatgagatgccaaacttttttgttttgatttcaggagctaagtgttgtgcttatttgttacacagcaatagctaactaatacaatagttttccagctagacacatttctaggattctgttactaagaaggaagggaaggctggagacagggaagcaatgaatagtcactgtcaccaaaactgaggggttaatttgatcaggtctggctgccccgcttgctttggtcacttgcttgttttattaatttttcttttttctccttttttctttatcttctttctcttgctttctctctttctccttccttcctcccttccttctccttccttctttccttccttccttccttcccccttccctccctcccttcccttcctccttccttccttgcctgctgtgtcaattttttttattataatagagacaaggtctcactatgttacccaggctggtcttaaactgggcttaagcgatcctcccaccttggcctcccaaaaaactgggattacaggcatgagccaccatgcctgtcctttttcttcttttcctatgaagctgaagacagtcatagctgaaggctgtggtagctgaataccgtggcgttaaatgctgaaatgtacccttcactagcttctttagagatcacattcacaggtcactatggtaatgtttgcttccgttgtttttcaggaacttaggccagctcccatccagttcaatcaggttgggaccaccaattcttcaatgggcctgcccaaatgcccaagaagtggacttttgatgtcagagggccaaagatcccaccctcagatcatgctaatgccaccactttctgtacacatgtcctgtgaaatgccacaaaccctgactactacgcttgtgcagaacaaacctatcaattaatttttccctactgccaatcacctttccccatgccttacaccaccgtgtttccctaacgcataaatatccctaagccttatcttcaggaagcaggatgtgagagctgttctaccaccttgtttggtggccttgcaaataaatcctttctcttttgcaaaacccatgtcatagtcacagtgactgatttactgcacgcgggcaggacagacctgcacccggccaataacaccactcatacctactccaaagggccgttgtgaggatggaatgaggtaaatctgtaatgtacccatatccagtttgccagcacccaggaagtgactaacgagacatggttttttaattattattttattattattattattattgtatttttagtagagacggggtttc[132 bp omitted]atctagtgtctgcttcccaagcttttcgccaagctcctctaggagacaaggtgggctgtgtctaacattcaattttcctgacttctcccctttgacagttcagattccccatgccctccagccaattagtacaattactacttctttttcttctttttttctttttcttttttttttcttttgagacggagtcttgctctgttgcccaggcaagaatgcagtggcacgatctcggctcactacaaccgggttcaagtgattcttctgcctcagcctcccgagtagctggggttacaggtgcctgccaccatgcctggctaattttcgtgtttgtaggagagacggggtttcaccatg[142 bp omitted]ggagggttcacagaatggtaagatttcagagggaaaagggctagagcccttctaattcagttcccccactcaccattgtgaacccagacacttgcacaaagtcacaaagcaacaagcaggggtgggacttggcccctctggagagataacgtagctctgtgttcctccctctctccaaactgctaatgctcaggcagaggctggtgtatgcagcattttacaaagtttcctatacaagcactttgggaggctgaggcgggtggatcgcttgaggttaggagttcaagaccagcctggccaacatggcgaaaccctgtctactgaaaatacaaaaaaattagccgggcatggtggcacacacctgtaatcccagctactcccagctgaggtgggagaatggcttgaacctgggaggcagaggctgcagtgagctgagattgggccactgcactccagcctggactgcagagtgagaccccgtctcaaaaaaaaaaaaaaaaaaatgccataaagtttcctatagaaaaaaataaatgtgcactagttcaacccagttttttctccctgagaggagttgaggtcaggtttatgggacatgcggtgctttttgagtgaatgagcgtcataaagggaaaccttctggtttccctttaggctttagggggcccctgctcttgtgtctttggcttggcagggagctgaagtccttgcagtcacgagcctgtccctcgtggatataactgggagaaaagtctagaaagtgctccctggggtcccaggataatgtgtccacctaccgaaggcaagaatgcaatctatattattgcccttccccaagggtgcaggatttatgtcaccctggaagaatgcgaactcctgaatcagttcacatacaaagaaaccccagtttttcagaatagattgagaccaaagcctttcagtgaaaatgaatgttttgggcagaaaaaaaaattaatgaaagtcctaagatttttttaaagtattaatctaataatgggagatataatgtgccagtctccctgctgcttatttccgctagtgaactgggctatatgggaacttaataaaatattcacagaaggcggctgggcacagtggctcacttctgtcatcccaacactttgagaggccaaggtgggtggattgcctgaggttgggagttcgagaccagcctggccagcatggtgaaacccccatctctactaaaactacaaaaattagccgggcatggtggcaggcacctgtaatcccagctactcaggaagctgaggcatgagaatcacttgaacctgggaggcggaggttgcagtgagctgagatcatgccattgcacttcagcctgggcaacagagagagactctgtctcaaaaaaaaaaaaaaagaaaaaagaaaagaaaaagaaaacaaaacaaaacaaaaacattcacagaaggctcaactgcaatatttaaaatctttaccagtggccgggtacagtggctcacacctgtaatcccagcactttgggaggccaaggcgggtggatcacctgaggtcagaagttcgagaccagcctggccaacgtggagaaaccccgtctctaccaaacattagccgggtgtggtgctgcatgcctgtaatctcagctactcaggaggctgagaggggaggatgacttgaacccgggagatggaggttacagtaaactgagatggtgccactgcactccagcctgggcaacagagcaagacgctgtctcaaaaaaaaaaaatatttaccagtcatgtgtatttcataaacagcagcaatttcattaaaatcagtgcatatggggaaaagggatgcgtaggtactgtcctatcttcttgattaatgctgttaacatatttttgcacatttaaaaaattgacattgataaatttttagcatgaagttgcagaagttgacctgggtcctaactgtaaaatgcagaggaactctacccatgaggaagctttgtgaagttgattcattactaatgtccctgtgagtacctaacttaaaaagtccagtgtagccaggcatggtggcgcacacctgtaatcccagttgctcgggaggctgaggcaggaggatcacttgaggccagtagttcgaggctgtagagcatggtgattgtgcttgtgaatggccactgtactccaacctgggcaacatagggagatcctgtctctatctaaaaaaaaaagttcagcaagaactggagggctgtggaggactgagcattgagtttagaaaattgtcactacagggcgggcatggtcgctcatgcctgtaatcccagcactttgggaggctgaggtggggtgatcgtttgagcctaggagtttgagaccagcctggacaacatggcaagacctcatctctactaaaaattttaaaaattagccaggcacgtgggcatgtgcctgtagttccagctacttgggaggcccaggtgggaagattagttgagcccaggggttcgaggttgcagtgatctgagatcactccactgaattccagcctggaccacagaatgagaccctgcatccaaataaaaaaataaaaagtaaaagaaagttgtcacagcaaaatgaggcacacggagtttgaacacctctctttttgggagaacacactgagtagacaacaccgtgtgtgtgcgtgtgtatgtgagttcatctgtgagtgtgtggggggtgctttggatgtggaagagtgtgaaggaggccatgaatctttttattctgataaagagcaggaccaggcacagtggctaacacctgtaatcccagcactttgggaggccaaggcaggtggatcatttgaggtcaggagtttgagaccagcctggccaatgtggcaaaaccctgtctctattaaaattacaaacaaaaaaaaattagccaggtgtggtggcgcacacctgtaatcccagctattcgggaggttgaggcaggagaattgcttgaacccaggaggcagaggttgcggtgagccgagatcgtgccactgcactccagtctgggcgacagagcatgactccgtctcaaaaaaaaaaaaaaaaaaaaaaaaaaaaaaaaaaaaaaaacccgggagtatttttgaagcagccaggagctggatatgtgtccagcttgcatctttgtgataagcatttaataaccattgagcttagcaatagagttacggaactggtacttagatgtttttctttttctttttttttttgagattgtgtcctgctctgtcacccaggatagagtgccatggcgcgatcatggcttactgcagcttcaaccttctggactcaagctatcctcctgcctcagcctcccaagtagctgggaacacaggtgcacaccatcacacctagctaatttttaaatttttgtagagatgggggtcttgctatgttgcccaggctggtctcaaacttctggcctcaagcgcttctcccatctcggcctcccaaagggtggggattacaggtgtgagccaccgcacctggactgtgattgcttttcttaacatggtactctgccattatattctctattaggaatttgatatgctcagaagatatagtgagttgcctgtttactaacatcagggtcctttcaggtagtgtccaccacaggaaacattactatttgggtattgtgacccatggcaacgacccagcactcacctttccagacctcatctggtggccttgtaaccctggagctgaagctgcatgcgcacaagcaatcagtcgcagtgtatccacacagggtcccaacccactccaggattcatttcgggatggcttcccctccctcagccgggtctccagccccattgctctccaggcatgcccatctccatctccacggcgatcatgtgtttgcagggagacatcaatatcctcttctcttgcgctttctgaatgggagagtcaatgtcaaccggaagctagcagggacttgggtggacaggtgtctcacgctggatgggggaatccaggtgggaggggagggtgggcttgctctcatttgtgggtgggtaatgggatttgctatgaagctggagggaaaatctggacccctaaagaggggtcccttcccttcctaagggaaggcctcagcttcgagactgcaggaggagctgggtagccattggatatggctaaagcacatgaatcatgaccgtggtgcactgtttggacagcaagtcagtggcccaaggagagagaggttagtgatgggaagcgtcctgggactcaccgatgcatctttatatttttctctttaaacattaggaggaggccaggtgccgtggctcacacctgtagtgccagcgctttggaaggctaagatgggcagactgcttgaactcaggagtttgagaccagcctgggcaatatgtcgagacctcatctctacaagacattttaaaattagccaggcattgtggtaggtgtctgtggttccagctactcaggaggctgaagcaggaggactgcttgagcctgaaaagttgaggctatagggagctgtgatcttaccactgcactccagcctgggcaacagagtgagaccctgtctcaatcaatcaatcaagcaagcaatattaggagaagaatttgttgatgtctcttttctgtcataagctcggctctccaagagccttttcttcccaggaggacatgctggtgtttcatgaatctaggacttcttgcctgaagcttgtaaagtgctagatggaatgaaaacggcaatagtaagagcaggctcttatgccaccttgctacacacaaggcattgctctaagtgctttgcaggggttaagagatgcagttgagtagctgaggacagtctaggggtggggtttccagaggctgtcaggggagtggcccccagccttcctggtggaatccctgagcattaatcacacacataagtttcactccacaaacatgggttgtgaaaacattacaatctagccaggcgcagtggctcatgcctataataccagtattttggaaggccaaggcaggagggttgcttgaggagcccctgaccagcctgggcaacacagcaagaccccatctctaccaaaaaaaaaaaatggccgggtgtgttggtgtgcacatatagttccagctacttgggaggctgaggcaggaagattgattgagcctagaagttcaaggctgtggtgagctatgattacactactgcactccagcctgagcaacagaacaagactctgtttttttttttaaagccataatacattatttttttctaaattaaatggaatgtgttgtgaaccacaatcatttattttatttacttatttgtttatttttgagacggagtcttgttctggcgtccaggctggagtgcagtggcgtgatctcggctcactgcaacctctgcctcctgggttcaagcaattctcctgtctcagcctcctgagtagctgggattacagctgtgcaccaccacacctaatttttgtatttttagtagagatggagtttcatcacgttgtccaggctggtcttgaactcctggcctcaagcgatccacctgcctcagcctcccaaagtgctaggattacaggcatgagccaccatgcttggacctagccacaattatttaataccagggctccctgccgtcgctccccagagctgggagaaggtctcaggagcatattgggtcaggtatgtgtggaaaggccctccaggctcaaattcacactgggcctactctgtgccctgactccaagctccaggagccctcaaaggtggcagctccattgctcatgagccaagcttagggaccggggcccttcctagcagccagaaagagccttattcttagcattttttttttttatagagacagagtctggctgtgttgctcaggccagagtgcagtggttcaatctcatagctcactgcaacctcaaactcgtgggcacaagcaatcctcccacctcagcctcctgagtagctgggactacaagcgtgcaccatcacacctggctaatttttaaatttttaaatttttaattttctgtaaagacagggtcttgctatgttgcccaggctggtctcaaactcctggcctcaagcgattcttctgcctcagcctcccaaagtgctgggattacaggcatgagccaccttgcctggctctgttcttagtaccaagggccctcacaccccctgtcttttcttgggactctgccaagccccaggctccttctcaggcttggggacggtacccaaatcagcacatccacttccatctccccacctcaccccaaacccttctctccggcatctagagccacgccgaagtttctcttcttgagtctagccctcctgggtatgcttggggactgaaatgctcaaattggcctcacctcttgacactgtaattgttccttatcgcctattaaacaggaaccctgctttgtgtagttcagtgcctgctgccaagtcagagctgtgacctcaatgaaagtggcccagccacaccaaacctcagtttccgtaacagtcctgggatccaatgtggctttcacattacatatcacttcactctgttatctccgatggaaaaccaactcaaactggcttaagcaaaaagggtactcactgggccatgtaaccaaaaagtgtaagcataggtgtggcttcaggaacggctggatcaaggcacccacatgtggcatcgggagtccctctcctggctgttggtttcagttttctctgcaggggttacattcgagcattggttccctcctcatagtggcaaggtggctgcgcaggacaagaggcatatagccaagggctcagctacttaaggataagttccatcagaagcccaagttgaggctggccttggtggctcacacttgtaatcctagcagtttgggtggctgaggtgggtggatcacttgaggtcaggagttcgagaccagcctggccaacacagtgaaaccctgtctctacttaaaaaaaaaaaaacaaaaaaccatgaaaattagctgggcgtggtggcacatgcctgtaatcccagctacttgcaaggctgaggcagaagaatcacttgaacctggcaggcagaagttgcagtgagccgagatcaaaccactgcactcctgcctgggcaacagaacgagactccgttggcaatgactgggtcatctgtccagtcctgaactggtcactgtgtgaggtagaagcattgtttgattggccaggcctgggacacacggccatctccagacctaggaatggcatcatctctacccaaaccccgtgaaccaggaggtggggaggagcaaagcttcagaagaaactccgggccctgccatcaagcagaggaggaaaggaagccacacagactgagacatcaagtacccactgtgccctcaccaccagctcctgccctggtcagtgcactcctggaccatttctcctccccgtcttgttcacagtcaccctctcaccccagcagagatcaggccaggggactggtggcaagtgagtgaagggtttcagcctaccttccaggcacagtgtaagcggaccccccacacacaggggctctcctgggttacacagtgtcctcccaaaattcacatccacctggaacctgcaaatatgaccttatttggaaatggagtctttgcagatgttgtcaagataagatgaagtcatactgttttaggatcggccccatatgtggtacgactggggttcttatacgaagagggaccctggcacacggatgcatacagggagagcgctgtgtgatgagaaaggcagagattgcagtgatgctgccaccagccaaggagccaccatcaaccaggagacgggcatggatccgattctccctgcgaacctccagaaggagccaaccctgccaacaccttggttttggacttctgttccccacaactgtgagacaatacattctgtggttttaagctttatgataatttgttactgtagccctgggaaaggaatacaagggtagacagacactgatcaagtaagcaaacaaatgtgaaattgccctgtgacaagggaggtgcagggtgcctgtgttggggaagaattctctgagacttgaagtcagagaaagagttagctaatggggctgacaggggtctgcacatgcagctcacggcccagatctcgttggccgagtgtttttgcagggattaggaactaagaatggttttgcaagaagaacatcccaggccgaagggacggcatgagcaaaggccatgaagtgggaggcgccctctgtgaaaccaacaagctttcagccacgtgggtctctctgatgcgttgtctccgccacagagggctttaaaaagccccgaaactggacaggtgtcactgcctgtggcagtagcggccatttggcgcctgtggtttcaactccacccgtttcacatgtctatgttaccagactggcccctgaaggggatctgcgtgccaggccctgacctgccgggctttggaaacatccttgccagtgtcccctgacctgcgccccgccctgtggagtgaggcctggttgcccaagctggctgggccgggctgtttgctgcttccaacaaacataggagagaatgtattgctgcttttgattgccagtgagagctccgcgaggcctggcccgagatgtggctggcgtgaggggtcccggacctgctgtggtggggacgcacccagttctgtggcgcttggtccagcgaggactcgagcccactggggacggggcctcgggctgcaggggcggggccccagccgcctgggggtggggcctcaggttgtttgggggcggggcctcaagctgtctggggacggggcctcgggccggctgggggcggggcctcatgcttcaggggcggggcctcggactgcctgggtgtggggtctccagcttcagggtcggggagcctcgagccgcctggggaccgggggatctgttggggaggaggttctcgaactgctgaggaggatcacagtgcttttgcttcctctaggagaccagctgcacaggctgcaacatgccatctctgtgcctgttttcccgtcgataaatgcagagacattactctcatcatttcttcctctgtaacacaatattcatctatgtaaccccttggtaaagcagttgtaagaattaaacaagaggaattgcgctttcattcagcaaatattttttgagcagctactagatgccaggcactgttttagacgcaagtgatacttcaggaaacataatcagacagacaggcagacatgccctcctggaactggcattgtagaacaagggtctgcatcctgtggctcacaggccagatctggttgaccgtctatttttgcatggacgttaaactaacaatg[140 bp omitted]catggggaaaccctgtctctactaaaaatacaaaaattagctgtcatggttgtgggcacctgtaatcccagctacttgggaggctgaggcaggagaatcgcttgaacccgggaggtggaggttgcagtaagccgagatcgcgccactgcactccagcctgggcaacaagagtgaaactctgtctcaaaaataataaaattaaaataaaataaaaaagagtggtctctggaccaatagctcagtatcacctggacatttgttagaaatccagacctactgaaccagaatctgtattttagcaagacccccaggtgatctgtgtgtacattaaagtgtgagatgtttttgtagcaacatgcatggaactggaggtcattatcttaagtgaaataagccagatacagaaagacaaatattgcatgttctcactcccaagtgggtgctaaaaaatgcatacacatggctccacagagagtggaataataaacaatggagattcaggagagtgaatgtaaattctggcagttcatccaccactgtgaaccatgagaaatagtttaatggctgccaggtgaggtggctcacacctgtaatcttagcactttgggaggccaaagcaggaggatcacttgagcccaggagttcaagaccagcctgggcaacatggcaagaccccatctctacaaaaaatgcaaaatattagctgggcatggtggcacgcacctgtagtccctgctactcaggaagctgagatgggaggatcgtttgagcctgggagatagagactgcagtgagccatgattgcaccactgtacttcatcctaggtgacaaaatgagaacctgtttaaaaaaacaaaaataggctgggcacggtggcccacgcctgtaatcccagcacttcgggaggctgaggcaggtggatcacctgaggtcaggagttcgagaccagcctggccaacatggcaaaaccccgtctctactaaaagtacaaaaattagccgggcgtggtggcgggcacctgtaatcccaactacgcaggaggctgaggcaggagaatagcttgaacccgggaggtggaggttgcagtcagccgagattgagcctgcactccagcctggtgacagagcgagactctgtctcaaaaaaacacagcagcaagcaacaacaactaaaagaaatcactgaatgggtacaatgtatgttatcgggatgatggagatcctaaaagccctgacctgactattacacaatctatgcatgtaatgaaattgtatttgtaccccataaatttatgtaaataaaacattttaaaaagtgtgagatgtgcaggtcgaaaatgatgcagaatgctcagcacagggcctgacacttagcaagagctccatgaatgttagctaatgcggtggatggactcatggtcccccaaagaggtccacatcctaatccccagaacctgtgaaagtggtaatttacattgtaaaaggggctttgcaggtgtgatcaaattaagtctcctgagacgaaggaattcacctggattatccccgaggggcccaatgatgcaatcacaagggtctttttttttttttttgagatagcgtctcactctgttgcccagactggagtgcaggctcgatctcggctcactgcaacctctgccttctgggttcaagcgattctcctgcctcagcctcctgagtagctggaattacaggtgtgcaccaccatgcccagctactttttgtatttttagtggagatgggggtttccccatgttgcccaggctggtctcgaactcctgacctcaggtggccttggcctctcaaagtgctgggattacaggcatgagtcaccacacctggccacaatggtccctataagagatggtgggcagggcaagaagaaatgtgagatgtgaggctggaagcagagggtggaatgcatgctttgaaggtggaggcacctgctctgcggcaggcctgtagaatcgggaaaagacaaggactcagattctccctcagaacgccctggaggaaacaagctctgctgacaccttgattttagacgtcggacctccagaacggtaagagaataaatgtatcttattttaagtcactaagtttgtggaagcttgttggagcagcaatacagaatgaatatagctgccattcttattgttatcctgtttgtcgtaggctggctctgccatcttcccattcagttgtttcaggcaagttattgagtctctctgaacttgagttttctgctctgtaaaatggagacaagaagttttcctacttctggtcaaatgagataatgcatgtaaagtgactccagctgtcatgattgttgttgctcttgtttaagtagaggcagtggccatggctggctctgtgtgacctggggcaagttatgagacttctctgaactttagtttccccgcctacaaagtgggggtcatgacagcatctacctcctgaggctgtcgtgaagctggaaggagaccctaagcataatttctgggcccatgcctcgcttgaggaggacgtaggtataattctggccgaattggagaacgtgatctctaaactgggtgggcccctctaagctgtcctgactccggtcctctgtgctggatcacagcctcagcctggctggcaggggagtagatcattcctattccctttgcctccccagctcttcccaagtggacaccacaaccccattgctttttttagagacggagtctccctctctcacccaggctggagtgcagtggtgtgatctcggttcactgcaacctccgcctcccgggtccaggtgattctcctgcctctgagtagctgggattacaggtgcatgccaccactgccggctaatttttgtacttttagtagagatggggtttcaccatgttggctaggctggtctcaaactcctgacctcaagtgatatgcccacctcaacctctaagtgctgggattacaggcgtgaaccactgcgcctggcccccattaccttttgttgtgactgcagcagactcactggggggcttctgtccccagagggcggggagctcaagttagttcattgaggaggggcaggggccatagggctggggcggggcctggacatcccaacacgagggtccttcctgtgctgaggttccagactgaggcgggagtcagtctgaggcctggccgtgcggcttggcgtctatccaggctggaatttgcaggatttgtgctgtggtgctggaatcggctccctcggagtgtgtgtctcactggattggatctgtctgtgtcttgggggtgttctttaaagggaagaacctgacagacttcacactgcagtgccccgtgcagggcctggcacacagaaaatatctattggaccagtgaatggatcatccaagggactgaacgtccccagtgcaaacaggaagggagtttgtgtcagtggggagtctcccaggccccagtaagactggttgaccaggtcctccctaagttctgggtgttgctgaagtggccttgctgctctgaaaacagctgtgtgcatctcagcctcgcctctcccggaggagggcctctcacttcctacgaaaccaggactgcagcctcagagaggtttgagggtgtgcccagggctacacacttagagtgagtttggggcgtgaggcaaggatttgtggggtggctgcccagctaagcacctggacactgttctgtaggaaaggagagccgttaaagaatttgtatctacctcttttttttcttggttttgttactttcccccaacattttattatgaaaattttgaaacagcaacatcaactcactaacattttactaaatttgagtgatcgcacatccatccgtcaaaatt[138 bp omitted]cctccacctcccgggttcaagcgatcctcccaccttggcctccccggtagctgagactacaggtgcccaccaccatgcctggctaatttttgtatcttttagtagagatggggttttg[132 bp omitted]tgttcttatccttcataggatgattacaattagatacacactatttgtttccttttgggtggggctaggtctgtcttgttccctcctgtgttccccagtctgtcgtaggttgcatgttctgtaagtatctgctgaacgaacagatgaatgagggagatgttactggtctttgctcctccaatgctgccccccaccctccatgtcatgtctcgacatgtctgatttcctgagagtggcttacgtgcctggcatggtactgagccttctttgaagcagccctctgagcaagggatccctagatcgtacattcacagatgcggcagctgaggctcagagaagtgaagtgacaggccccgggtcacacagcatcgagggggcaagtcaggatgtgattgcagttgctccgaccccaggcccatgccctgagtctctgcacagccagactcagagatcccaaagtgggtccccatcatgtcctggctctccccacttcagaagcaggacctcgaaaatttcaaggagccccagataccccacctggacggcatcctggctcggggcagacctgcctcccaggctccaccttatgttctgctccttctcattgcctcccaaattagttccatgttcagcctggggcctgtggattccacttttttctgtaaccggagttcccccagtgcttggcaccaagctcggtgacttggcttcggctcaggttcctgatttccttggacaatttcagatgatttcactggcagagaaaagcccagccaggggtcagtgagcggatcactcccgtttcctgtaatcaggtagaaaaggatcacagatgacgagcagtgcctcccaagacacacaggctgtaggaacaggcctccttttctactttcaccctggaaaccaccttgcaggatgggccttgtgatccccacttcacagatggggaagctagggctcagagaggttgggtgctttgctgagggttgcacagcaaatgagtggcagggcagaatctgtcccctagtctgctggccccaacacacaacctcttcctcccagattcctttctggctccaggctgcagcaggaacctggccctggggactcagagtggcgaaaactcagaccttgcccacgaagacctcaaagtcaagcagaaaaagactagattgagtgcaaacagtgatcaaagcagcacccgccaacatgagacaatatgtatttttagacagtgagtcagtcctgatgattcacaggcctggctaggcttgcagggcagccccaggacaccaagggcagggtaggagatgagctacccgcgggccaggagaccagaagggggtccagggctgcacctccttattctccattgtgttgtcaagggctggaggtggggctggacgccttcctacttgattggaagatgcattttccaataagtacttaactagctcatggtcacagaattagaatgtgacacaagcagcctcccatcactttataagcatctgctctggactgggcactgtgacgggtgctcgggagatggcagaccatgaaactgatgaagttctaacctcatgcaactgaccttccagaacaggtgtgggcacactttctccataaagggccacatagtaaatattttaagcctcgtgggccatgacaactcttaaggctgcagttgtagctggaaggcagccatatgcaatacgtaaatgag[144 bp omitted]aaaccccatctctactaaaaatacaaaaaattagccaggcatggtggtgggtgcctgtagtcccagctacttgggaggctgaggcagaagaatggcgtgaacccaggaggcggagcttgcagtgagtggagattgcgccactgcattccagcctgggtgacagaggaagactgtctcaaaaaaaaaaaaaaaaaatcgaagagcagctagatttggcctgtgggctataatttgctgacccctcttctagaagatgccttcctccacacccgggttcccctcatttgccctctactgtgtgactttgggacccctgatggcccttcggactgtggcctccaaggcaatgtgctggttctgcaggtgaaacggcgacagtgctctgtgttccttgaagatgtgttcgcattaggcctcacaagcccccacatgtggctctttctgagtcatgttgtactgtgaccttttgggcaccagcatccgtgtgtcacttggttcaacctagtgcttggtccatagcgggtgatggatgaatgtttgtagaatctgcagaatgaacagacccaaggctgtgcctagtcctgtgtatcttcactttagtgagaaactggcaatagaggggggttgtgacagagaccagggccccctctggtcttcctccttgtcctccaggggtctgggtactgcactgtctcacccccaccctgtgctcacatgacagtccaggaggaaggtgcagggcagtggtgagggcctggctcattgtgggcaccagtgctgagccccagcttcctgatctgtgaaatggacgggggcgatgaggctcacgtctctcacagaggttgctcatgggctcaggtaaatccctgtgcctgctcaaccaccaaaattcaagatgaac[140 bp omitted]ggtgaaaccctgtcactactaaaaatacaaaaattagctgggcatggtggtgggcacctgtaatcccagctactcgggaggctgaggcaggagaatcacttgaatcccggaggcagaggttgcagtgagccaagattgcgccactgcactccaccctgggcgacagagtgagactccatctcaaaaaaaaaaaaaagagttggagttagcaccagtctcacagataagttaacagagactggggcatccagggacttgcttgaggtcacagcttgcaggtgcagggtagggttcagacccagcctctctgtgcctcccttgacgatgggtcaccctctgtaatcagcaacagggtggccggaaacctgctgggctcttttctgcccctgtatctctagcagatggtcttggataaggtggtcttatctcatgcctgcctgcccctctacccatgtccctgccttctgcctgcacctgttcagtggccaggtcaggggacggacgaggctccttacagccgcgtgggtgtttggagagtggggcaggcagcccggcagagctgttaagcagcaaccccaccaccagtgcttccggatgcctggactctggggcaggagctgtggaactatcattctcagattcgggctcaagtcctgtatcagaggacagctagccttgtgaccttggaaagtcatggaagtcttccaagcctgtttctcacctgagtaatgggaatggtagatgacatgcattacacatagtggatgcttattagtggtaaactccctgcaaacactgaattagcagatctggagccattgcttctagggagaaatacaggttaagttcttacaagcctctggtcacattttcatcaaccaatcaatacctaacctggttttatgtgtttctctgtagacactttatttaatatataagtgattcattaacatcgaacatgttggctgggtgcggtggctcatgcctgtaatcctagtattttgggaggctgaggtgggcagatggcttgagctcaggagtttgagaccagcctggccaacacagtgaaacctcatctctactaaaaatacaaaaattagctgggagtggtggcgcatgcctgtaatcccagctacttgggaagcagaggcatgataatcgcttgaacccgggaggcggaggttgcagtgagccgagattgtgctgctgcattc[223 bp omitted]tgaggcaggagaatggtgtgaacccgggaa[137 bp omitted]ctaacgcatgcctgaacaaaccctctctaacacatgtgttttctctgtaacgtagtcactcctgccttgctctcactgcacatgggggtcattctaaacattgacacgactgcagaaagcacaaaaatgggaaaaatttggcactaagccaaccatgaaaaggatacttgtttgcgatgtgagagctgagatcggaaggcagtgtgagatcttctgaaacctcagctgggaacatgcccctcagatcctggaaattttttgccacttgcacttgtctgtgaatgaccttgaaagcacctcgagtgttgatttttgaggttacaaatacattctaataagtaggtgaacttgcaaatacagaatccacaaataatggggattgagtctgtgtctgtaaaaatttgtgctcagtcattagctgaaagcaggctgtggaaaggtgatttggatttttttctacatataagaaaaatctttttttttttttgagatggagttttgttcttgtcgtccaggctagagtgcaatggcgcagtcctggctcactgcaacctctgcatcccagattcaagcgattctcctgcctcagcctcccaagtagctgggacgacaggtgcctaccaccacgctcagctaatttttgtatttttaacagagatggggtttcaccatgtcagccgggctggtcttgaatggctgacctcagatgatctgcttgccacggcctcctgaagtgctgggattataggtgtgagccaccgcacctggctcccagctagtttttaaattgttttgtagaaatggggtcttgctatgttgcccaggctggtcttaaactcctggcctcaagccatcatcccgagactacaggcatgagccactgcacccagcacatacatttattagtgtgcatggtagacactccataaagagtggttttagcctggccaaccagctgtaggatgttggagctcaaagagacttcagatttcatctgtcagcccaaaagagaaggggacttctttatttttctgagacacagttttactctgttgcccaggctggagtgcagtggcacaatctcagctcgctgcaacccccacctcccgggttcaagtgattcttgtgcctcagccccttgagtagctgggattacaggtgcccgccaccatgcccagctaatttttgtatttttagtagaggtggggtttcaccatgttggccaggctggtttccaactcctgacctcaagtgatctgcccaccttggcctcccaaagttctgggattacaggtgtgagccactgcacctggccaagaaggagacttctttagatcattcacttgttcatttattcagttaatctgtgatctgagtaccttctgtgtgccagatccaggactagggacatggaggagaatgtacaagcaggtcctgccctcaaggggctcctagtccatgggagacaaacaccgaacaaccacaggtccacattaagaccagattgcagctgtgatgagtgctaccaagaaggaaggaagcacatgtgcccagctccaggggccacgtcatgagggttctggtcccatcgcagcaatccctttccctttcctggacattagtatctcagcttcccttgtagttagaagtggttggcctggtgcggtggctcgtgcctataatcccagcacgttgggaggccgaggcaggtggatcacctgaggtcaggagtttgagaccagcctggctaacatggtgaaaccccgtttctactaaaaatacaaaaaattagtcgagcttggtggtgtgcgcctgtaatcccagctactcaggaggctaaggcaggagaatcacttgaacctgggaggcagagattgcagagagctgagattgcaccaatgcactccagcctgggtgacagagtgagactccggctcaaaaaaaaaaaaaaattttttacaaattcaatttatttaacagatacagaactattcaggtaacctgtttgtttctaggaggattttcctggtttgtggcactcggacattgctttatttcatctaagttgtctgatttttaagtgtcaagttttccttagtgttctcttgctaaccgtctgaagtctgtggggcctgcagtgatgtcccttcattcattcctgatactgataatttgtatcttttctgtttttttctttgtcagttttcctagagtttttcaattttgttgatcttttcaaagaatgatctttaagtttcattaatttttcccttctttttttgctttcaatctcattagtttctgcttttatcttggcatttgttcctttggcttgttttgcgttcactttgctctttttctggtttcttaaggtggaaacttagattgctgatttagacctatcttttttgtaatatataatgatttgatgcaataaattttcctctaagcagtgctttaattaaccccacaaattttggtgcattttcatttatgttcaaaatattttctaatttcttttgagaattgttctttgacccatggatgatgatgatgattattattattattattatttttcttcaatacggagtttcactgttgttgcccaggctggagtgcaatgacatgatctcggctcactgcaacctctgtctcctgggttcaagcgattctcctgcctcagcctcctgattagctgggactacgggcacccgccaccatgcccggctaattgttttgtattttcagtagagatggggtttctccatgttggccaggctgatcttcaactcctggcctcaggtgatccccccaacttggcctcccacagtgttgggattacacgcgtgagccagtgcgcccggcctgacccatggattattaagtatgtggttttattttgaagtgtttgcagattgttttgttaatgatttctagtttaataccattgtgattggagaacaaactgcatatgatttcatttcttttaaatttgttaagatttatgtgtcaggttatgttctcagtgaacattctgtatgtgcttaaaaagtatatgtatggtctgtatatgtgtggtctgtatatacatatatgtatacatatatgtgtaaaaagtatatgtatggtctgtatgtgcttaaaaagtatatgtatggtccagcactttgggaggccgaggcaggcagatcacaaggtcaggagatcgagaccatcctggctaacagggtgaaactccgtctctactaaaaatacaaaaaaaattacccgggcatgatggcgggcgcctgtagtcccagctacttgggaggctgaggcaggagactggcttgagcctgggaagcagagcttgcagtgaactgagatcatgcgactgcactccagcctgggcgacagagctagactccatctcaa[139 bp omitted]ggtgaaaccccatctctactaaaaataaaaattaaaaaaataataataattagccaggcgtggtggtgagcacctgtagtcccagctactcaggaggctgaggtaggagaatggcgtg[142 bp omitted]gtttattgaaggtgttctacagttctcctagatttttgccgattacttgttctctcactatgaaagatattgtgtgtgttatatgtgtctaacaattcattgtctagttagagttgctattataccacttcaagtggatggagagcctccctgccatccattaatgtgcattaatcattttgagagtgaaaagattttttaaaatgtttttactcttttaggtatggccaagtgagatggggctagtgaaatgggtgggagaattggaagctgatagtgtgtgagctagacacccatgaatgcttttccactgggcagttagagggatgataggtaataatataaggcagctccatcacacaagctggtgactcctgtgcgacagaccaagagctgcatttggagattcatttccgattgttgcgtttcctcttagagcattgcttggtcatcgtgttctgagtggtccattggcctccatgtcccttttggggtggatatttgctcagtgacttttgagcagctggatctcctgcttcggcaggtgagtgaggggatggatggctccgcggactggcccccgccccaggagaaagagtgcgtggccgtggcaacgctgaatcttccccgacttcaggtattcgtgatttcccttcctcttgctccttttataagtgtcttagcgatttgtaagaaggtttatgtattttgaaggacataggttttagcctgttgggggaagtattttaaagtaagattgtaatgcactaataatggacgcaaggcttaaaaaacttgatctgtttattttatgtttgtcctggaagtcagcctcggcatgcaggaagagtgtatatggattgtgttatttttgctataatcattagtttgttggtattcttactgttttactgttgttgcgtgtggagaaatgactgggtgagatcacaggtgatggagagagacagcgctcagctgagagaccagtgctggcctgtctctcctctgtcctgtgaaaaccctgctccaggagggtccagtcttttggtttccctgggccacactggaagaagaattgtcttgggctacacataaaatacacttatgatagctgatgagcttaaaaaaagaatcccaaaaatatctcatgatgttttaagaaattttactttgggccacattcaaagctgccctgggccacatgctgccctcgggccgtgggttgaacaagcttgatctactcagtaagctcggctcccaaagcaataccttcctttcctcaccatgaaggctgtggttagggtcaaaataaaagctacaaaagccttcctccctagcaaaactaaagctgaagtgtttgatcatcatcttttgtctttgtaataaaaccctctaacttaatgacaagaaccacggttttctcgacatagtaatttttcccttttattacagtggtttcttgtaacaacccgtcatgtccctcttccagcccctcccctttttgccctgcttctagaatgtacagaactgagtgtagtgtttagatgcagtaatgaactgagcagaggtctggagcatgcttctcctctagtcctctgtagcactcatttatcaccatatctgtggcatcctggcgtttgcgtggttgcgccccaggtgtttgctgcccctcctggtttgcggtgatgtgtctgttctggtcagtgctgtggggcgtggccttgtgtatgtcttaggctgtcgaggtgtcccagcgtatggttttgcatttgcctctccggggtcctgagggttctgtaggtttcacagactccaggtgagtttcggtggtcatttcctgacctgtgatatctatacctagatgagcggtgtgcttttgatttcacttctactcacagggcaaggccgggtctctgatttctcatggggcctcttgctacccaaagcctgggacgggcagtgtgttgccccctggctgcggttggctggcaggcaggtgatcctgagtggctcccagccttctgcaggaagctcgagttcagtgggtccttgtgtgcattcccgtgtgggaggttgtgctgaagcctggcggcttggctctgctttcagagcccggaacctcttgactcctgctgtgtgtgcccacgtgaattttggttttgcacttgaggagtttccctgtgtactctcagctccgcagtctaatttttagcagctcttttttttttttagacagggtgtcactttgtcacccaggctggaatgcagtggtacagtcttggcctgccaggttcaagtgattctcctgcctcagcctcccaagtagctgggactacaggtgtgtaccatcacacccggctgatttttttatagagatggggtttcatcatgttggccaggctgatcttgaactcctgatctcaagtgagctttcccgtcggcctcccaaagtgctgggatgacaggcatgagccaccgcctgtggcagcttttgtggttacattgtagccattatttctgtgtttggtgcagattgttggggcggggtggaggttgctgttgctagttgtttagctcttctgctcatcttgagcttttccatatatgtgttcatagtggggttaaaaaaaattcctctagaaaatacttcaactattgtgggtaagagtttttttagtccagtttttaaaaatacgtaaactgagaagttattttgtctatttagataatacttcaaattgacttttattcagtgtttaataagactttgaaattcactcatttttaggggttctaagtgaaaattgtttttctcctttcagttgcatgctgccattagtcaccaggttgacctggaattccttggtttaggtctgggcagcgtcttcctgaacagcctgaagcagaaggtggtgaccctggcaagcagcgcagacgtgctgagcaccgtgcagtcggcctcccaggccatgctgcagagcggctggtccatgctgttgcccaccgctgagaagcaggcccgggcactctgctctcctgtcctgcggaggtgggctcggggaaggaacaggagagggcatgggtcagggtgctgggaggggatggcgtttcactcaaattggcacacactttctatttcagtttcaggcaatgaagtgagcataagtccaggtcatcgattggtgattgatcttctggtgggcagcttgatggctgatggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttatgtgctaattttaaaaattattgagatgatttgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcacagcaatataactgtatagtatgcactctttcctgctttgccttggagaatgattttcagattcgctcactgttgtgtgcattgcgacttcgtttttattattgggaagttttccattttataggtgtagtactgtttgttagttcattctcctattgaaggacatgtaattgtttttggtttttgttttcttttttttttttttttttctgagacagggtcttgctgtgtcacccgggctggatgcagtgacctgatgttggctcactgcagccttgtcctcctaggctcaaatgatcttcccacctcagcctcctgtgttgcagggaccacaggcatgtcaccatgcccagctagtttttttatttttttgtagagacaaggtgttactatgttgcacaggctggtcttgaactcctgggctcaagtgatccccccaccttggcctcccaaagttttgggattacaagtgtgagccactgcgcccaggctttctggtttttggccgtgtagagctgccacgattgtgctgtgaacaagtactttagtgaacatacgttctccctttgggtaaacacttggagtggaatttgttaggtcctggggtaagtgtgtgttcatagtttcccaaagtggctttgccatttacatttgaaccagtgtgtgtgagaattctagctccttcttgtccttacaaagcagctggatgctgcgtgtgtggggcagatcacattgggttttgtgagagccagtagcagggttaaggattttagggacttcacagaaggaggctggagagcatcagcagaggcagcctggaccttggatctgtaaacagaagacactgtttgaaactgcacaactgagttagggtttccaacaaggcaggtgggggcctgtgggtaggtgtgtgcggcagccacagaggctgggatagcttggcactggggtcagggctcagccagcctatgtgtcttcacacctggtaatgagatcacttgtaaacaatttctgtttatgaattacaggatattgaagccaaaaaagaaggacagaaggaaaaagaaattgatgaacaggaagcaaatgcctcaacatttcatagaaggaggactccattggataaagaccttattaatacggggatctgtgagtcttctggcaaacagtgtttgcctctggttcagctcatacaacagcttcttaggtaaatcatattagctgtattgtattgtgttttatttatttacttttttttgttttttttgagacagagtttcactcttgttgcccaggccggagtgcagtggcgcaatcttgactcaccacaacctccgcctccctggttcaagtaattctcctgcctcagcctctcgagcagctgggattacaggcatgcgccaccacgccccactaattttgtagttttagcagagatggggtttcttcttgttggtcaggctggtcttgaactcccgacctcaggtgatccacccaccttggcctcccaaaatgttgggattacaggcactggccaccacgcctggcctatttatttacttactaatgttttttgtttttttttttttgagacggagtctcgctctgttgtccaggctggagtgcagtgtcacgatcttggctgactgcaacctctgcctcctggcttcaagctattttcctgcctcagcctcctgagtagctgggactacaggcgtctgcaaccacacctgactgatttttgtatttttagtagagatggggttttaccatattggtcaggctggtctcaaattcctgacgtcaggtgacccacctgccttggcctctcaaaatgttgggattacaggtgttagccactgtgcctggcctgtattgtattttaataggtgattattggttttcatattaagatagtgaaatctagcgcaaggatctcaaaaatttgtttgatgattgaaggaatattctgaaaattacctagtatagattttagggtaaagagcagacccttttcgatataggtgagaggagaagttggagagcgtgatgatgttcaaaagtttttcacagaagagaaattggggcgtgcagtaaacctgtaaaaagattcttgctaataagcaggtggatgtaaatgaaaatcatcatggaaggttatttttaaaactggttctatcattgcctcactttatatattacagagttatacatactactttgtaagataacttttcttttcaaaactaaagtcaatgtgaaagaatggtgagcattgttttggaaggcccgactaggaggaggtgggaagaagtgagactcagcctgtgaacagacgctaaccttggcagaagccaaaacggtcagacagtgttgtctaaaaatgatcattcaagaagagtgaaaaaacaaagtgatttgtgaaagagatttattagaaaatgaaacacatttatacctctgtttaataaaaatctgctttttgtcaaatcgtgctcctggtttttgtttctacacatagagaaagcagagccctggcaggtttgatcaggcagccgagcacagagcagggagccctgggcagtggctgcagctctcagctggcctcttcatggggccacggtgcatctgcggcgtggggttgggcctgcggcgtggggtgggcctgtggcgtggggtgggtccgtggcgtggggtgggcctgctgtccacagccagaaaaacgaacttagtggacgcacagtgacattttgaaacaggaagttttagagctagtttctatcatagattttagtaaatgctattttgaaaaacatttttccgatgtttgttttgtttttctagtctgataatgcatatttcacacattctgatctttaaccagtggaaattagagaactaaacaatatagtttgtgttaatggaaagagcttgggatttgttctcagaaaatttcagttgcaacagtttgttcatataggtggacttccaacacagtaactataggagtaagaataaaagctgtgtttactttcacagagttaattaagaatacatgagaaaatggatgttaacaactttgtaattaaaatttaaagttacatgcaaagttttaaagtgagcattttccaggaagaggtgattttctaagttcttgaatgcctctcccttttgtgaggaggctgcgtcgtgggctgttggtgtctttggcagaaggtgagtctagggttcctgttgtgggtcctttgttctcatgaggacagtgcccgttttccccgtctcatgcttgcccagactgttcccgtgcgcagagagactggcctgtttgacctgcagctgtgctgtttgagctgcagctgtgtagcctgcgctggcccgtctgcctggcactcacaccgtttgctgatcagcacttgaagtgtgtctatcatagctgagacactgaatattttatgtttaatttttattaaaatgcagatttaaaaacttgattccattattaggtagcatttaagtatgtttagaatcacttggccatgtgagtctacttcgtcaactgtatcttttatgagtctaagtgcagatcagatattttcaatgcaaatttcactgtccaaattgcaatgtactacatatgtaagctaccctgatggtttttgaggccttattataaaataacctatataaaatatctcaacaatttttcttatattgatttcatgttgaaatggtaatattttcaatctgttgagagaagtatgatacactattaaaaatatttttattttttgagatagagtcttgttctgttgcccaggctggagtgcagtggcacaatcttggctggacagcaccctggacagcatcatttcccacctggcagggcagtctccttacagggaagtcaatgaggcactaaagaaggctcaggggacagggaggacttctgttgggaagaggctcctagacccggttctgcctccgacttgctgggggtccttgagaaagttacttcccctctttggtctcagtttcctcaggtgagaaatggggggttgggtcaaatggtctaaggttctgggaacctctaaatcagagcccgtagctggtggtcaagatgagggagaggccctcagggtcagctgaatgcctgagatgcaagacgggcccaaagatgagcaacctgagcacatcaggtgggctcagagctggcgcatgagccccacagcctgcagagcagccctggacttagaagcccgcttgcaccagcccggtgggacttcagagatgtggggcccagcctctcctactattgcagggctgagggctgggagccgcagattctgaccccacagctgccttagacatgccagatgggctgcggtgagacacacccctctctatgaaatgagcagtcagtccaaatagatactccaaagaagggctgtgggagggatccagcaccactgcactagagcctgggcaacagagcgagactccgtctcaaaaaaaaaaaaaaaaaaaaaaaaaaaagttttcaactttcactaaaggcagagtagcttgttatagattagcttccccacaagaacagttagagaaactggacaaaaatgtgcccccccatcaaaaacaattgtttgaaggtaatgggagacttcagccagaacttgagtgaccaggcctgggaggtgagcctgacagtctgtagtgctttcccacatttggtgattggtcaacagtagagggctaagaggctaagaaactgagtattatgaagtggtagttaacaggctggaaagcctagctgaatgtttggcactctcacagggctgaatgagaatttgggtcccaggaaggagatgggaccttggtggcaactctggaagggccacccctaggagtccaaatgaataaaaaatagaccagccgtcacaaactaaaacctgctttgaactagcttagtcccaaactagatgaaggcaatctgctcttactccaattgtgtgccataaagtcaaagtcaatactctctggaggcacataaaagtttactaggaatgccataaaacaaaacaagactaaatgagaaagaccaagaagaaaaacaatagaaacatacatagatatcagagtcctcaggtagaaactttttttttttttttgagatggaatctcgctctgtcatccaggctggaatgcggtggtgtgatcttggctcactgcagcctcctgagtagctgtgattacaggcgtgcacaaccacgcccggctaacttgtatttttagtagagacggggtttcatcatgttggccaggctggtcttgaactcctgacctcaggtgatccaccccctctaggtctcccaaagtgctgcggttgtaggtttcggccacaaggcctggctagtattttaccacaatttaaagtaaattttcttttctttttttttttttttttcaagtttgtgctcagactatattcacacagtgacatggcggcttatgcttctgtaggccttgttgacagtgccaacttttagatattgatgatcttcatctttctcttgtctcctcggtagaagaatgggatgcaggaggtactgcctaatcctgggcactgctgggcgttcttcatcccacaaaacagctgcatgatctcctgtgcagtggggttgtcctgcggagaaccctccccagcctctcctcctgcaggctccacactgccagtgtggctcatattacaaagaactttggagggagggaggcagggctctgagcaccgctcctcgtgctctggcagcctctcctgcatcttctctttctgatctcgtatcctctcctccttctctcgcatctcctcctgcccccacatcttctcctcctgcccccacatcttctcctcctggccccacatcttctcctcctggccccgcatcttctcctcctgctcccgcatcttctcctcctggccctgcatcttctcctcctgctcccgcatcttctcctcctggccctgcatcttctcctcctgctcccgcatcttctcctcctgctcccgcatcttctcctcctgctcccacatcttctcctcctgctcctgcatcttctcttcctgctcccacatcatctcctcctgctcctgcatcttctcttcctgctcctgcatcttctcctcctgcgtcttcttcttctcccgcatcttctccacctgctgccacatcttctgctcccgcattctctcctccttctcccgcagcctctcgtcctgctcccacatcctctccttctggtcccacatcttctgctcctgatctcctgctcctgcatcttctcgtgttcccacagcttcctccttctcccgcagcctctcgtcctgctcccacatcctctcctcctggtcccacatcttctgctcctgatcccgcatcttctcctcctgctcccacatctgcttctcctgctcctgcagcctctcctcctgtctccacatcttcctgctcccgcatcttctcctgccgccacatcttcttctcctgcccccacatctcctcctggtcccgtatcttctcctcctgctcccatatcttctcctcctgctcctgcatcttctcctgttcccacagcttctccttctgttccggcagcctctgctgctgccactccttctcttcctgctcccacatattctcctcctgcttctgcatcttctcctcctgctcccgcatcgtctcctcctcttcccgcatcttcttctcccgctcccgtatcctctcctcctcttgcatcttctcctcctggtcccgcgtcttcttctcctgctcctgcatcttcttctcctcccgcatcttctccacctgctcccacatcttctcctgctcccgcatcctctcctccttctcccgtagcctctcgtcctgctcccacatcctctcctcttggtcccgcatcttctgctcctgctcccgcatctgcttctcctgctcccacagcctctcctcctgtctccacatcttctcttcctgctcccgcatcttctcctcctgctcccacatcttctcctcctgctcctgcatctgctcctcctgctcccgcagcttcttctgctcccgcagctccttctcctgctcccgcagctccttctcctgctctcgcagcctcttctcctgtctccgcatcttctcctcctgctcccgcatcttcccctcctgctcccgcagtctctcctcctgtctccacatcttctcctcctgcttccgtatcttcttttcctgctcccgtagctcctcctcctgcctccacatctcctcctgcaaagtgttggtttgaacctcaaaaggaaatagacttatgaactagctatataaatgtaatctataaaataacagttttcatctatgattctttaaaaaaaatttttaagccttaacactgaggttctgatttcccaggcagggccccaaatttgtagatttttagcacactctagaggattctatggtgggaccagaacaaggacccaaattttccagctcttggctggaccctccccataccttgcatgatccctagaccatggtcctagctggatgggtctcccacaacccctggggctgcagccgctcacctgtggcagcaggaacttggccctctccagtttcctttttagctccttcacgttgagctggatctcagacttttcagattctgcaagtcgaagtttttcttgtagttcggcatttttcttcttcagctcctcattggttatgctatggcccgaggcagtagagaaaggaatgaacgaagaacagaaaggactgctttggtgatcaaccctctactctcgccccacaagcacagaaccgtggcactggaagggaccccaggaattaaaagtcccaggtggcaggccagagagaagacatgagttgcctgaggctaccccatgagtcagtggcacagccggcactagagcttccctgtgcacacatgtaaacctgtatgaccccctaccatgctcacctgtaccccccacctcccagcacaccacccacgctaagggcccccagacctcccatcccaccttcccccatcctacgtgttcctgtacagttccagactcagggcgtccctctcctttgttaactcctcgatgtactgcaaatagagaaaggttaagtcaggacagagcaggcagaagagcagctggccgaccaggaacaacagctacactgatactccacagtaacactccctcactctccatcacacccgacatgttctcaaggcaattccaagcccatggtctcatttttttttctttttttttttctccttttcttcttttagagatggagttttgctcttgttgcccaggctggagtgcaatggcgcaatctcgccccatgacaacctctgcctcccgggttcaagcaattctgcctcagcctcctaagtagctgggattacaggcatgcgctaccacacctggctctcacttgtttttcagagaactcagtaagggtagaagggacagggaaagagactgaattgatagctggctaacaggggcccagagagatcagataatattgctattgctattactgttattactgccactgttggaacctttcttgagtgcttcaccaggcactatgctaacaatcccatttaatcctcacaacctccataggagacggttaccattattacctctattgtatagatgcaaaacatggggtattaaaagttaaatggttgcctaagatcactttgacagagctgggatttcaacacccaggtgtatctgattctctaagcccattctttccctgggggtaggggcacagataagaaggaggaaattaatcctttgttgactttttgaaagaacgatacattggcatagtccaaaactcagaaggtagagaagggaaatatctaccccacacacactgttcctgtctcctgagttttttatgaatccttacaaatatgtttttatgtatgttaccataatacgtacacacacacacacacacacacacgcacatgcacacttatgtgtgttccctctctctacacaaatggtaacatactaaagatactcttctgtaccttcatggtacaaataccttaacccctgcctaggacttggtcaaggccacagccaagtatgggcagggcaggctcttggccttggagctctgtgtccagtgctcgctccccacagtgccccccaactcacccacagcagctgactcagccccaacctgcctctaataaccacacacaaaagcagcaagaaatgacccatactatcttctgggcaggacactgcatcctgcaggagggacctttaggctcattcctccatctgcgaagctgggatcccaggagactggggaggtgattggacttaccctgtctgccttcttgtgccatgtggacacagcagagagagcccgctgtaactctcctgcaaagtgccaggaatgatgcaagcggccggcgagatccttggactctcctggaatgagagaggttgagacacagcccaaaggactccccctaaaggcctgtgaaagtgccaggttgaaggatgatggggtgcccaggttcccatcttcaaatttcctggcagcatcctggctgtaatagagcgctgtctccagttcagttttctgacacgtgagaattcgtattgtatgatcctgggcctttgggagaaaagacaagcaagtgctgaaagagaagcaaaaaaaccttctccagaggacaggagggaacttcacaccctccactcacctctatctcccgccttagggcttcctgatgttggtggcttgccttcttttcctatagaaagaggaagacagagctcttactagggggaggcagagatccacagcaagagacatgcccccagaatggcaccaatgccccaggacaggcgcacccatgggaccaggttatcagggaccctgtggggatggggtggaatcttggcggtgagccttcttccccaagctgggagtaggcgagatgagacgggcctctacatctgagtgccctccaaacccagcagtcatgtcgtgagcaaacaaatcacgttacttctttcagctgcgctcggttctgttgtgtctgtggggagagtcaaaggaaggtgactgagggtggccccctggactctattccccaggccaggaagcggtacgcaggggtcaggaatggattttaaagggcaacgttctcagacccaatgggaacatgaagtggtaaactctcaactcccaaagaagagatttgggtctttgttggtttttgccctcagccacggaactgaaagtctgaaactagattatctcaaaaagacagtaacataaaccttcagagatggagtgtgagaaaagcccacccttctgctagcttgtgatttagaaaggtgcattcattcaacaagcattgagcaagcacataggggccggggacggttcttcactgctgggatataggacggaaaaggcagacaggagcccttggccccaaggtttccattctagtgaatctttaaatctcagactctcagagcaaacagaacctctgatactctaactctacctcctcaggaaacggaagcccaaagaggaggggagcttacagcaggccctggactagggattaacacaaaaacaacagcaacaaatctgatttaagcttcacacatgtaagtaaaacattaccatccccattttacagatgtgaaaagagaggcccaaagagctcaagcaattttccctaaaccgtgtccctcgcagatggagagagaagtaggactcaaacccagaattcttagccagtacccggcagttcttccttccacaatcttaacagttaccctcgacctccccttgtgccccttgtcctcaggagaccggccagccaagacccacatcctcaggtgaatggcaaccctccgaagtggttgtctcagggttagtgccattatttattttcttctttttggtgtcagttgctctggtaccaacaccagcaatgttccactgacgatagtctgtaaactgtggaaaagaggagcagtgatactcatgagaactacaagctcctacagtcactttacagtttatacaaaatactctcatagacgatctgatttaatgccaccaacgaccgtacgaggtgttgtcgcaatcacttagtgactgagagggattgataccatggctaaaaaaaaggcaataatggaacttaaactcagtcttctgattctgagctctggggttttgccacaaatcgcagctgccaggggccaaaaccagaggcagaggtagaaaagtaaaaagtagacaggaaagtgtacactgtttggtttagagtcgtacatcctcacacatctgttagtgtgaagaagtgcaccactacctctcagacttttacatcaatgtatcctcagggcagaaggcagcttttctgttaaatctgggaatttaacagaaagaggacaacccaagattcatttcagtgagaagtctggtatacttttagaaatccgtgtgactgtcatccgtaagaacattaatgttttgtctctctcaagagaatcaagggaaactgatgcttcagaaagatgccccatatgtatcctgtggcactcaaagtaccccaggttgagatgcgatgaggaagattcaagttgtcaagttcagtttcccaagatctattccacagaagatgagcaaatctcacttcagagatcactgactgatgggcaatctggtcccagaaccatggagaattcaaatatgaggtggagaacttagagaaaactgttaaagtctctctggagagtagaagcctgggagaaaaccaaaccaaacccgttctcccatttccaccaagagacaatgtcaacattttgagttcacagggggaggtgtaggcttttcaaactgtcaatgtctgtgttaagggagtaaggcagcctgaaacttctcgctgctaggtcacatggtccctactccccttccagctggaaatctgtgatgcaaccagaggaagcagaaacagggtgagaacacttaggggacgggtcctaagatcaaaggccagtcttgcagcagtaatgacagttcctagagggactgtgacaccactacatttcactcctctgtggggtggtggagggccagggacacatcagtgctatgcccaagttgcctctttgaggttggggaggggttcgcagggttgggacccaggtccttggagacgtgagcccaaagagcccagggaggtagggcttggggcgacgggaggtgagggccaagtatggagcggggagccccaggagtcacctgcccaaagtcaccctggggcgactggtgagggcaggtgctgggacacacaggtccttggagacacaatcccaaagggcccagggaggtcagttttggggtaataggaggtgagggcggagtacggagtggagagccccagggttcaccggctcagtcaccctggggtcactggcaagggccggggcaggactgctgagggggtggggctggctgagaagattttgattgggggagcccagcggcactgggggggacccagcccagtgtgcctctggaatggcatggactctggcagatgttctgccatgggagggggcctggggctgggttggggttggggtgccgcaacccagtgagttttacctttttcttggcctcagccaatttgttctgtctggttttttctgacatcatggggtggggagggaggtggggttggggccacatcagcgtgattcagacgaggacaaggatacacctccagtcacgtaccacgcagctatgtgactgagccagaggaggtgtaaccagggctgcactagaatgcagaataggggcgtggccttaatgcttcaagcccattggtcagtgagaaagatgaaagggaaaggaggcggggccaggcagccacgtgtcatgaaggacctgtgatgtcacaaggaaagccgcccatgcaactgctgtccccgcccactccaggagaggggcggggctggctttcactttaaaaactttaaacctttatcaccttaattgagatacaaatcctattaaaatggaaaatttacagcatgcttgatgattaataaagcagactatattatccaacattccagtaagataatcacagtgatttctcttttttggaaaaagtttctcttattctcctacattattgttaagtttttttgaaaaaaaaaaaacaagaaacatgtctgatatctttaaaaacacaaagcttttgagctgggtgcagtggctcatgcctgtaatcccagcattttgggaggctgaggcgggtggatcacctgaggtcaggagttcaagaccaaaattttagtatgtattttagtatttattttagtatttaatgcatcatttagggctacatgtagtcacagaaaaaataaatctgattcagtgacttaaagaaatatagatttcatggccgggcgcggtggctcatgcctataatcccagcactttgggaggccgaggcggacggatcacgaggccaggagttcaagaccagcctggccaatatggtgaaaccccatctctactaaaaatacaaaaattagctgggcatggtggcgtgcatctgtagtcccagctactctggaggctgaggcagaagaatcgcttgaacccaggagg[133 bp omitted]cagggttcttttccgtttcctgatacttccttagccatgtttttatttttgtggttacaatgtggctgttgtttttccaggccttggattgccttccagggagggaaagaggaaaggtcaaaaggctgagtctgtctctttttagctgaaaaacatagatttctcaaaagttttaagattatactgatattcaattttcatctgtttttttgttttgttttgtttttttgaaacgcagtcttgctctgttgccaggctggagtgcagtggcacgatctcggctcactgtaacaacctccttctccacggttcaagcaattctcctgcctcagcctcccgagtagctgggactacaggcatgtgccaccacgcctggctcatttattgtatttttagtagagacagggtttcaccatgttggccaggatgttctcgaactccagacctcgtgatctgcctgcctctgcctcccaaagtgctgggattagaggtatgagccactgcatctggcctgcagttttcatcttttggctgcaaataagttgtgtcattattctcagctatgggagtgtttaactgggcatgttgcttcctctctgttagataggttttaggatttatgaataggtactgaattttatcaattgcttttttctttcttgattgagcatttttttcttatctttttatgttgataaggtaacttagtgattggcttttgaatgtctaaccttgcatttctggaattaaatcaactttgttgtgatatatgattaataccattttatatgtggttgagatgggcttgctcatagttcatttggtaattttatacttaacgttcacaagaggaagtggagtctcagtttttttcctggtgatg[146 bp omitted]gactacaggcgcccgccacc[184 bp omitted]gttaagcatataactctattataatgctacttccaaaggaaaaaccaattaaacttaagaaaaccacttccatttaattaaaatgccttttccagaaattcaacctgctgtaaatatgaggttctcttataaactacaaaatctttcctttcttattttaactatcatgtatacatatatatgtaacatacatacatgtgtgtgcttctatattctatatatatgagcctgatgactcgtgactgtccctgcacatctggccttccatctgcaacagggacagtggcagattcaatgcttagctaatttttccttgaacagactccattactcactcatatatttcactgactctgaaagaaccaagcaaatgatctgatggttttggtaattaaaaaacttcctgccagcatgcattttcagcaactgtcaaaggtattccagggtgataaattgctcctgcaagggcctgatcaatttatttctcttgatcatcaggttcaagggacttcttgtctataaaacaatgtccctacgaatattttgatgcagctgctagcagtatccttggaaggctgactgggtacgcattccttcataacagtaagtctcaggctgaaaaaggactcataactttctctcaactccaaaatatgtaaagttgttcttaatcaccggttcggaaccctttgaagaagtacagcaagaagcgtcttgtttctaatctctgcaaaagaaatagatgctacttctagtactctctccgttcttagtcatttgaggtgcacaaaggagctagggaatattggt

SEQ ID NO: 416 - DNA, 457952 bp, Homo sapiens
  misc_feature (306013)..(356012): n is a, c, g, or t
tggtattttaacaatatgaatgaaaaaaaaaacctcaggtgttttgatagaaataacagacgtgcctaggaatcatcttccttgaagggagaggagggtcttattgaacttgaaaaaactaaataagcaaaattgatacataaggacacccttctctttacccttacctattcttaacaactttaattcatttctgacactgtcaccaactgaaaaacggtccaactaaaaaaaaaatcataaaggtgagaaaaattgtgacgtgttctatcctaatccaatatatctaaaccaattttactgatagagaaaatatattaagtgaatgatgtaaatacattaatataggtaacaactctttgaaagtaaagtttgcacataacatgaaatacatagagaattactgccgtctcgaaggagagaacccttgatggggagtggtagtcaaaaaggtgtacgagcaagtcatctgttgcaaggtgatgggaggagatatttttgcaggcattcaatatcagtcagaggttttaatgatttttgttttttatcttgagagttggagactagaagatctaaaataggaaaattttggcatatccatagatagaatggaagctcttcgccaaaaaataacgtgctccaagtcatgaaaaatagcacacatgcacaattaactacagagttacacaagatggtgtcttttcattcgattttatttgaactcttattcttctctatcttttacgctttgtatccttgttaattaactcttccattttttcctcatcctatgaggcactttaaacattttattcaataactcttaaggcaatttttacaattctattcacatataaaattgtcataagcatgttttgtgagtgaaaaattctaatttgtaatgcatatcaagtgaaaagcctcagttcagcactcgtcatatccaaaatctgtgttatataataatgtaaaagacatattttcacacatgtagctcaaatgagattcttacttaacatttctctctctttttttttttttttttgagatggagtctcgctctgttgcccaggctggagtgcagtggcgcaatctcagctcactgcaagctctgcctcctgggttcatgccattctcctgtttcagcctcccaagtagctgggactacaggtgcccgccaccacgcccggctaattttttgtatttttagtagagacggggtttcacagtgttagccaggatggtctcgatctcctgacctcgtgatccgcttgtctctgcctcccaaagtgctgggattacaggcgtgagccaccacgcccggcctacattttacaaaatttaactcaatcttttattttaaaaaatgtgcatatactgcctgttcaagtacttaatctttttatttattatttgaaattggaggtccatctttttagattgttagaaggtcttcacgtatttgaatgagttattaagttgatacaaccattttggaaaaataattatcattatctactacatttaaacacataatatatgaccagcagtttcaacagaaacacctggatattcatcaggatagaacggattggaaagctccatattcattcaacagggtgctacacaaaacaaaaaggaatgaatcactggtccataacataaacagatttcacaaatgtaattttgagtgaaataagccagaaaaaaataaataccgtatgcttccatttatatgaagacaaagataggcaatattaatctatggtaacatatgagactgacttctttttctcagcatcagctgagagcctgaaaaatatttttctggggtgctaaaaaagtgccagatcttaaaaatatttgtacaaaagataataatttttttatataaataggtacaaaacacaaatatgtacaaaaatgtatttataaatatgttaaacaagattactatttatacttcaatataatttttttcacttttgttgacattagtaaaccatcacacttaataaacagccatttggaattgttcttgatttaggtatttccttgattaaataccaagtaggaacataccttgattctaaaatataaagaatattattccatgaaagtttccatgaaaactatcttgcattctaaaatatttttaaaagtacttattttcaaagttcagtttcctattttaaacaaaagttgagctaaattacatataagctagtccccagaatattcagtaaatatcaaatgaaggtgtgaaagttaaagatttcaattttttactagttaatttgcagtgctctattattttgcttaataaacaattttatgctagaaataagcagatttccctattcacattatctttaccaagagcacttaaataaataccattgattacttgcaaaatacagattgtagattcagagctcaaaactaaccctctgaggatgtaattcaattaaaacaacccatagttgtgaattcacctcaccagtgtccctaagacaagaagctctttctcacatcaaagtgaattattttaattcactttggatgttaggaatatcctaactcctttgtaattaaaaaaaaaaaaacaaaacttctgatgcttctttatatcttaacaatcatgaggtctataaaaatatgaacacagaagtttgggtcagttcaatgactgaactaaaacattatttcccaacatgtccatgttgtacaagatgatggggttgttatctgtgatgccattgcaaagatcttgatggttccaaaacactaagcatcacataagccatgttatagctgtcgccccaaatttaccaaaccatttggattaaaactctcagtaaggacctctgaggcacaaagatctatgagtaactccttaacccctttgctcttactcttcaggtacaatttcaaattttcacctttccctttctgcactgaccttgggaaagtcactttatctctgtgatctaattttccacatcaataatgtatctatacttggcatagagagttatgagaataaaataataacatatatgggcaatttctgtgaataccaattgtacaggtggatttttaaataatagatttagggccgggcgcagtgactcacacctgtaataccatcactttgggaggccgaagcgggtggatcacctgaggtcaggagtttaagaccagcctgaccaacaaggtgaaataccgtctctactaaaaatacaaaaattagccaggtgtggtggcgggcacctgtagtcccagctactcaggagggtgagacaggagaattgcttgaacccacaaggcggaggttgcagtaggccgagatcacgccactgcactccagcctgggcgatgaagcgagacaccatgtaaaaaacaaacaaaccaataaatgaaatatatttaggaaaactattataagaaaaaaattgaaagcattaagaactctattatggactgaacaaaaaaaggagaattggtaccataccttggtaagtttattttaataagcccaatttctattagttcttcagtgtttcctcttgctccgtgaatgtatgttccttgcctctatcttatcccattttttctattgttaacagagagttgtcgcaagttctattctcaatgcctattgcattgggcaatagatgactctggttcccaactcagaaaaacctcatttttaagaaacgtttgagctttgactttgatctcattcagaatattttggttcaaaagttttttgtttttttgttttttttgagacggagtctcgctttgtcgcccaggctggagtgcaatggcgcgatctcggctcactgcaagctccgcctcccgggttcacgccattctcctgcatcagcctccctagtagctgggactgcaggcgtctgccaccacgcccggctaatttttttttgtatttttagtagagacagggttccaccatgttagccaggatggtctcaaatctcctgatcttgtgatccgcccgtctcggcctcccacagtgctggggttacaggtgtgagccaccacgcctggcccaagagtcttaagtttgtgtaaataagcacctttgaaaactacatctacaaatgggaatatggaataaaaaggacaagccaaaggttatggaacaaaataaaacatgaagaaagagaaatagaaacacaatattactatatacaatatagtaatatattttaaaatacaaaaaacgctagcaaaaaaagcaatatgtaaacaaaagaattggagtaaaataatagaatttgaaacagcacaatctgctgaaaatatacaaaagacaaattagggtattcctgagctcactgtttataatattagaacatgtatataaaaaggaaaagtgactttaaaatgtctgggggccaaggaatatatagtttgttacattttatttacaaacagtttctttgactagggaatcaatttaaattttctgttttggaaataatataaatatatctttattttagactttttgctgtaaagtttcttaaatatttacaactttaggataatcagtgtacatttcaatatataatgtcctaaaaatcaaacagctaccaaacattgaattgaagttctgacttatataaatcatttgcataaaaactgatcattaaaaacagtatctaatgaacattttggccccaatattaattaaaactgaaatgatagcattacaagctaaagattaatttcaatgacatgtcattcaaccattttgacataattgacttataataatctaaaattgactatttttatgacatatttgacctaaatgaagagaaaaaagctttgactcattcttaattactctttctaaccaattgatggccaataactgaaattaatttcaaaccattttttgttattttaatcttttaaacatgttttactttcagtgattcattttctaacattcatagccaaagcccaggctctacccatctttgtctaccttaatgactttgtcaattgttggcatacactgggtcttaaaaacttgtgtttcttccgaattaattaatgaagtagaattgctcttatagggtttcatataccattacctccaaaagagtacatcagaagtattagaaaatactgatatttataaacagatatttatcttatgatacaaagagctagagctgttttattttctgtaaaactaagaataacttcttgataacgtagctttacaaaaagaaaacccaacacatttccataaataattctctgaaataactatgtgagtttgtgtctttttatatacatgtagatatacatatacttacacatctatacatatatatgtaacataaaggatatgaacattaggactgtttaatgtctatttgtcttggaaagaaaaatatacttaaaaatatttcttaattgggatttgtaatcgtaccaacttaattgataaacttggcaactgcttttatgttctgtctccttccataaatttttcaaaatactaattcaacaaagaaaaagctctaattttcattggaaataatttatatacttgtttagagcagagaaaaattaagaaaaactttgaaatggtctcaaaaaattgctaaatattttcaatggaaaactaaatgttagtttagctgattgtatggggtttctgaacctttcactttttgtttgttttacctatttcacaactgtgtaaattgccaataattcctgtccatgaaaatgcaaattatccagtgtagatatatttgaccatcaccctatggatattggctagttttgcctttattaagcaaattcatttcagcctgaatgtctgcctatatattctctgctctttgtattctcctttgaacccgttaaaacatcctgtggcactcttatttattaatcagttaaataaaatcatgaacatatattcattttacatttgtatgagaaccattatttttcttttctttaaaaaaattaattatcctttgacattgggttgacattttcttaagacatgccataaacagaggatatcaagtttctcaatgtcagttctagaggaaaaaaaattccttataaaaatttaacctcatgtgtaacagtttccattcccatagcaatgacatttgatatacattgtatatattaatctgggaatgatgtaaggttccaagtataattttatcagtgaactcaactacttgattactttcacttatttaaatatctagttcaatgttgtccagtggcattgtggatttaggtaattttaccaggcagccgttcaatttctgcactttctatttgcccatgcagaacataacacattttataagtcaaggtataggcatctggtggcataattttaatttgttatcaaataaaagcctcatcaaatttgtctagaaaataactcattatttactttattttaggactgtatcactatgtaatgagatacaaatatatgtaaatgtaagtgcctaagaggcatgcagagagcctaagatgtatgcagtatgcctaacaggaatgcagagagcttcattttcattgtcagctgctcagttgtttctcaggaaagaaatgtggccaacggacaccatttaagagatatatagcaacaagttcagaaaattctcataaatgggagtggctaatgcatagacaatagcattgacctttgatccatatatatatatatataaaatatacctcaaatacatttggatcaatttaattgtgagtgctataaactacaaatgaaagtaaaaaagcaaacctgttggtattttagaagaatgaaagattattaactcatggcctgtatgtgtttggaatgagaaggacgtacatagctttctttggacggggtggaattgaaattgtgatttacagtgactaaaacctgactgctttcacatttttttttcactgttgggggtgaaattcttgattgatttgtgcattgggaactttttttttttttttggagacagagtctcgctttgtagccaaggctggagtgcagtggcgggatctcggctcactgcaaactccaccttctgggttcacaccatcctcctgcctcagcctcccaagtagctgggactacaagcgggcgccaccacgcctggcaaattttttgtatttttagtagagacggggtttcaccgtgttagccaggatggccaggatggtctcaacctcctgaccctgtgatccacctgccttggccttccaaagtgctgggattacaggtgtgcgcctgcctgagccactgtgcctggatagagaatgactccttatgtgacatgcagaaaatattttgtgtcattcgtggtacatttatcatattttctataggtttgtactatgttgctccacttcttagaattccaagtagttcaaagccagcagggactggtatattatagcatatttaacctaagcaactctaaaagctaacgaaaccaagtatctacaaactttagccatagctaccatcaacatgaagaatgtaataggcaaaatgttttacatgctgaatatgcactactgaattctgtatatattttttgcagtttcaatttaaaagtatactagttagatatttcatctataccctggtatagtaataaaaattcagatactgctcaacgaggaagcacattttcaaagcaacagacctgaaaactagtattttatttgatattttaaatgcttatttcattttctggttaaagatgtttgtgaaggtaaaatttaaaatagatactttatgttattctagtatataacattgaaattaaatttttagtaaatgtagaaaaggaaagtctgaagcattgactgagaaagatttagtaaatggagaattttgactattaaacatcccattttaacaaaaatatgcataaaatattcttaggatgatttaattaaccttttaataaatacgaaagacattatgaaaaaattaaagaatacatcacattgcagaatcaaaagtaataaaaatcactcaaattctactgctcagaaatgaaaataattgctgaacattaggtggcagtatttcagacattcctatataaatatacttgaatgaggcccagagcagtggctcacgcctgtaatcccagcacttttggaggccgaggcgggcggatcaggaggtcaggagatcgagatcatcctggctaacacagtgaaaccccgtctctactaaaaatacaaaaaaattagccgggcttggtggcaggcgcctgtagtcccagctactcgggaggctgaggcaggataatggcatgaaccccggaggcggagcctgcagtgagtggagatcccgccactgcactccatcctgggcgaaagagcaagactccgtctcaaaataaaaatataaataaataaatacacacatgcattcttcatttataaaatacatttaatatttttaaataaataaaagtcaaaataaaactgataaaatgactgtagttatttgtatgaatatatgcatgtgtgtacagatgcattaagaaatcttaatcttcaaaatgatgaacattttagaagaaatactaagaataatgagtttgggatctgtatcatgctctctttttctgtttttttgagacggagtctcgctctgtcgcccaggctggagtgcagtggcacgatgtcagctcactgcaagctccgcctgccgggttcacgccattctcctgcctcagcctcccgggtaggtgggagggactacaggcgcccgccaccacgcccggctaatttttcgtatttttagtagagacggggtttcaccgtgttagccaggatggtctcaatgtcctgaccttgtgatctgcccgcctcggcttcccagagtgctgggattacaggctgagccaccgcgccctgccctgggatctgtatctttctaagtaggtgattcagtatctaatgagaaaattatcacttaaaaattcaaaatgttttagtttgttgttattattattattatttgtattatttttaaagatggggtcttcttatggtgcccaggctaatcttgttaatatttttatattgtcatggtgtcttaggcagctcaagctgccgtaacagaataccagagactggtgtcttaagcagacatttatttctcacagttttggaggctgggaaatcctccacaaggtgccggcagattcagtccctggtgaaagcccccttcctagactacaggctcctgccttctgacaatgtcttcacatggcacaaaatagagaaagacagagagctgtggtctcagtttctcttcctataagaacactaatcccatcatggagatgcacatgatcttaaccagataaattttttttggatattttgaactgatcaaataactcacattgattcaaaatatcacagttattaaaactcaggcacaaaatcaagttagttcatcagtaattgaggcagataattttaaatcaaaatatagctacacaaaacaccatttcctaattatcttagactttaaaagtagttagaggaagagaaagctcatctctgtattacagtataacgggtttcccatcctaggtgtcttaatctatttgaacagctataacaaaataccataaattggtagattataggtaatagaaatttgttgttcacagttctggagggcgggaagtcctagatcaaagtgccgtaagatttggtgaggacctgcttcttgattcatgaattgccatctcttccctgcatcctcacttggtgaaaggggcaggagtctctcgggactcttttataagtgcactaatcccattcatgagggctctaccgtcatgatctaatcccctccctctaaggccccacctgcaaatatcatcatatgggtgttacttttcaacagctgaattgtggggggcaccatcattcagcgtacagcactgtgaaatccctaatatcgggttttctttttattttattttatttttgagatggagtctcgctctctcacccaggctggagtgcagttgtgtgatctcggctcactgcaagctccgcctcccgggttcacgccattctcctgcctcagcctctggagtagctgggactacaggcgcccgctaccacgcccggctaatattttttgtatttttagtagagatcaccgcacctggcccctagatgaatatttgaataaaagttgtatgtatgatgataaaacaacaagaaactgaatttttgcagaaagtaaaaataaaacttgtcactctttatataggcaaatcagagactatacttgaggttttagaaaagacatcagtatgttccatataaagcatgtactgggaccccgtcagtctttttcaccatataatatcagtgtttttaatagtacctgggatggctgggcgtggtggcttacgccgtaatcccagcactttggaaggccgaggagggaggatcacgaggtcaggagatcgaaaccatcctgcctaatacggtgaaactccgtctctactaaaaataacaaaaaaattagccgggcgtggtggcgggcgcctgtagtcccagctactccggaggctgaggccggagaaaggcgtgaacccgggaggcggagcttgcagtgagcggacatcgtgccactgcactccagccagggcgacagagcaagactccatctcaaaaaaaaaaaaaaaaaaaaaaaaaaaaagtacctgggacatgatatgaactcaatgactatttattgaatgaattacttgaacaagtttatgcaagaaattgacataaaattaaacattgtctccttataccatatagtgtctacaaaaactaagttgatacagaacctgtattctaacatgattaaatttgagccaagtacatttctctcttaagaatttataagtttataaagaaatcagggcctgggaactgaatcattaatgaaagatctcaaaggcaatattcttttcattgtaattaatattaagtcgttaaagtaataataaataactaacatttaggttcctgaaaaaaatggttaaattgaacatcaaatagtttgcatttatatcacactgtacaatttatattttttatgctgctttactgtaagatttcattgaacaaatgcatcttatgatttcaaggtaaggtattcaaatatgcctttttaaaatgtaatgctgtattagtgattttaaaatatgtaaaaaaaatgtgtgggaaatactagaaatgttatttgaaattaaccaattctgggtttgcttattttttttttttattttatttgccaaactgagaacaacagcctttacacattttctatttttctggacttgattcttaggaactttaattttgcacttttgcattcctctataaatgttaatgtcttagccaatgacatttttctagataaattcaaaagcttaacctaagtaatgtaatggtggcatttatgaaattgactcctggttctctctttaaattctttttattgtttatttctatggcaccattacactatgctatcacattgttcttgttttattccccatgtttaaaaagctgtatattctttgctgaatcttaaaggtcactttgaaacctcaagaccatgactgaaatacagtgaagattaaagataaaaaggagaaaaaaggttaaattataaaacctctaatatcattactcatatatatgatatacacagagatgcatcacctaggtcctccctgagagctgtgtcagtagacaggactcagctgtgagccccttcagacgtcacctcagctgcagagcttccccctgcctaaggtcctgaggttcccagttgtggtgcatatgcaatgactgattgaggtgaggcaaggaggcaggtgaaagaggtggggaggggacttggggcctataaagactcagtcatgtcattgcaatgtgaaaggatgccagtgggccattttatcttcaaagtcccctgtgagatgagccaaagctgtggtccaggacttcttttcagcccagctttttccctttccctcaatccagcttccttcttctccttttcacagtgccttggattcaagggcactccctagtatatatctccatgtccaagtctgcttactagagaacattgtatcatgaatgataccattcttcaaaaatatggggtactttgagtgaaaggagtggaacggtatagaagaacagctttggtagagtagttagaatagaagctactctacattgggttgatgcatgaatgggatattaggaagtaaagtagcaaattgaaaactcctttcgaaagaagagagttagaaaagggtcagcaagatagtaattggggcctggctgtgatggatcacgcctgtaatcccagcactttgggaggctaagatgggaggatcacttgaggtcaggatttcaagaccagcctggtcaatgtagcgagaccccatctctttaaaaaaatgtagttggaagctagagaatagcataacaaaaaagagggtgattttagaagacaaaagggcccactggagctctctcacattggagtgaaattctgaaattaccctctttttggttatgtcattctacctcaatcattttgcctcaatcatgtttacaggcaaaataagagatagagaagtggaaagggctgaaggcagagatacgagacacaataacaaatggggaaagatacaagatacaatgaaaggcatgagctagatcaattctacaagtgaaaaattatgcaagtgaaaaaattacaaggtgagaggaaggatgactcatcacccaattataggtaagtttataggagggtgggactggctacataaaggtagatgatactttatgtccttattttcattaaagagaatatgtcatttcctgaaaatgaaagatgtgggtgtgaatagagagttggcaaaatttggtatttatttgaaatcggcatttatttgggaagataatgtagggtaactaatccacttagatgataaatacttattaactataaactgtgtaccaggtactttgctataatataaaggcaatggaaaaaccaagattcagtcttgatttgacatccttaacatttacagtgtcgtggtggaaactatgtaaagaatccagtgtgatagaaggtggtagatgtggaaacaggaggtttagaaaaagctccaggacacattgctgacacatctaactcaggatcagggcatttaagaaagcatcacactctccctcaatctctctattctgtctttccatggaatccttttaacaaagtatcaagatggccctcagcactaaggaagaagtgttatttgaaagcatgtttttgaatagttgcatttatctaaacagaatttttcactcctgtgtggattttgcttggaattggtatattctggcattccatgttgtaaagcacttgaggtgcttaagagatatttggttggccgggtgcagtggccgaggtggttggatcacctgaggtcaggagttcgagaccagcctggccaacatggtgaaactctgtctctacttaaaatacaaaacttagctgggcatgttggcaggtgcctgtaatcccagctacttgggaggctgaggcgggataattgtttgaacctgggaggcagaggttgcagtgagccaagattgcaccactgcactccagcctagggaacagagcaagactccgtctcaaaagaaaaaaaaaaagaaggagagatatttggtaaataactgaggcaaaggtggaagaaaatagtgttctacaggaggtgaaataatgtgtgaagagaaaataaaaattttaaagaactaaaagaatcaggtattgaagtcaaaggtgagagggccactgaaattcaaaaatacaatgtgaataactacagaagatgtcatcattcctgatgaggcaatgaatgtgggtgcctaaattagagtagaaatacatgttattgaagataaggagatcaaaaggtgtaaggccagggtgttgaatgtattttgcacaaatgcgctaacgttacccagaatgttggcagggggaaaaacatctgatggcctgtagccagagttttccttaaaaacgcagacgtgtcctcctggaaaacagacatctttgaaaaaatgaaggaaattagggtctcacagcatgactctcatggagatggtgaaggactgatttgagagcagccacgcagagttaggacaatgccagcaacatctgacccatgtacatgaagctccagataacttaggtgattgctttaatgcaaaaggccacacagtgtgaattcgtgagagactatcttttatattccagaggttggaatggaataattcactcatttgaaaggcttgctggatatcctctatttcagggctctccaaacccatactagtccatggctgttaggaactgggctccacagcaggaggtgagtggcggctgagtgagcgaagcttcatctgtatttacagctgctcctcatggctcatgttaccccctgagctcctcctcctgtcagatcagcagcagcgttagattctcacaggagcatgaaccctattgtgaactaagcatgcaagggatctaggttgtgtgctccttatgagaatctaatgactgatgatctgtcactgtctcccattgcccccagctgggaacatctagttgcaggaaaacaagctcagggctcccagggattctacattatggtcagtcgtataactatttcattatatgttacaaagtaatactaatagaaataaagtgcacaataaatgtaatgggcttgaatcattctgaaaccatccccaccaccaccagctctgtgaaaaaaattgtcttccacaaaaccagtccttgatgccaaaaaggttggggaccactgctctatttctcttcactgcttagagaatctgttcttccactcatgatctacaaggattaaatgtttcaaacagttcaagtcttcaaaatatgttttttgtaaacttgagtttttagaaatcattcacagtatccatattatattttatttgctgcaatgccctatacatttcccatataatgctcttgaatatacttttacaacttcagtaactttaccctttactgaatctcaatctgtctctcaatttctctctctcagcaaatctaaacaaaagagaaacatattgacttgtgctatggtctaaatgtttgtgtctctaaaattcatgtgttgaaacttaatctccaatgcaatagtattaagagatgaaggctttggaatgtgactggcagagccctcatgaatgggattggtgccttcataaaagaggcctccaaaatctccctagccccttccaccaagtaaggacgcacagaagtcaccatctatgaagtagagagcaagctctcgccagataccaaatctgctgacacttcagtcttaaactcccaccctccagaactgtgagcaataaatttctgttttatagttgtctaaattatcctgtctaaggtgtttttttatagtaatgtgaatggactaagacaacttgaaaatgcaaggtaccacaccaataacaaggaaaatactcatgttttgtaacatttattttataccaaagatatgccaattactgtatacaaatatatgccaaatgttgggtaaaatactttacataaattatattaatcctgaaaacaacctgaaggtagatactgttgtctgcatttaaagatgaggacgtggggcttgaattaagtaacttacctcacatctcatcatgctaaatggcaaagctgggattcaaaccctgctcagtcggactcccatcaggctgctcttagcctggttatattttgaagaaaagaagttcagaaacttatccatagacatggccaggtagggccagagtccagactcaactgactctcagccaagaccagcctcaactcttccattttacctccagcctgaacagcttaaacattttttctcttgccatcttattagaatacataatgcctataatgatgggatccaaatgatatagcatgacaacactctggtttaaaaaaggtgaaatgtaatttttttttttaattttaagttctgggatacatgtgcaggacgtgcaggtttgttacataggtaaacgtgtgtcatggtggtttgctacccctatcaacctatcacctaggttttaaggcccccatgcactagctatttatcctgatgctctccttccccccagccccccagtaggtcccagtgtgttttgttcccctccctgtgtgcttgtgttctcattattcagcttccacttagaagtgagaacatgcggtgtttggttttctgttcctgtgttagtttgctaaggacaatggcttccagctccatctatgtccctgcaaaggatatgatcttgctcctttctatgactgcatagtattccatggtgtataggtaccacattttctttttctagtctatcattgatgggcatttgggttgattccatgtctgtgctattgtgaatagtgaagcaaaaaacagatgcaataggaatgcttttacactgttggtgggaatgtaaattagttcaaccattgtggaagacagtgtggcaattcctaaaagacctagaaccagaattgccatttcacccagcaatctcatttctgggtatatactcataggaatataaatcattctattataatgaaacataatgtaaaaatacctcgagtgtatttgtattttggtaatatctgaataagacataaaatataatgcacacatctttatatcgttttatccatatctctctttctttaaatccttctggttaaaatttgtcattgcctcctgactatgtatatattttttcttttctggaagaaagctcacctaggccttactcaaatgcatgttctcaatctttacctaccacccctcctgcctttttgttccagtttcctcttatcattgtactgatgtggagatacgaaagagaatatcactgtcagccaccagcagtgccttttcagagaagagcaatggggaagaaattgagcagacaaagccagaatccccattagcaaacagaaagagggagctcaggataaccacatacattaataattcttgccccgcaaagggaagctctgtaaaataagttgtattacatctgtacatagcagtactttaaatataactctagcttaagtattttaagcatctccgtgatatgaacctaagggaataaactcaataaatcaatatttataagctctgttcacttatgtcttgtggtttcagccactgatttcagaatatgcatgaaaaatatatttcttctgaatatttgatttcatgatcccaagtagacacatctctgtattgggtttcaacaagtccacaaaagttaaatacctacttttagccagctttgattttcagaagtttaattctgacatttagtgatatacaatatgtaaaacaacctggcactatatctgttatatcataagtacttggcaaatatttcagtttactctttctcataattgaataatggctcaatagtaaaactctgtagggaaaaatttaacctcttatttatcaattacaaatagtttaagacagataatacccctttccttgttagctttaatgctgaatcattaaaattgtgagcaatgtatttattttgaggaaactattttttactaaggattttgttttttttttagaattttatgagtcttcaaaataactagaaaatcttaaagtgttaccaaacagaagtggacatttaataaacacctcaactttaatacttacagaaaatcatttgaaggctgtcactcctctgggtattataaattttagccttggtcaaatcaaatcaccaggaggctacaaacttgaactacactgccttagtctccaacagtttctttccttgaattaagttttcgggccatgctctactccttttaataaaagaacaatacaacaaatagtcatatgaaatccattttgttgcctaatacaaaaatattgttgaagagtatcataattcaatggcccatatatataaaatgtctcagcaaatgcacttatgtcataattcagtactaggaaatgatttccttcaggcaagctcccccttaattttttttttttttttttgagacggagtcttgctctattgcccaggctggagtgcagtggcaccatcctggctcactgcaagctccaccacctgggttcacgccattgtcctgcctcagtctcctgagtagctgggactacaggcgcccgccaccacgcccggctaattttttgtatttttagtagagacagggtttcaccgtgtaagccaggatggtctcgatctcctgacctcgtgatccgcccgccttggcctcccagagtgctgggattacaggcgtgagccaccgtgcccggcccctccccattaattaaggtgagaaatgcataaatgatgatggtagtcattggtgcaccagttacgaaagagtgaggccgggtaactggatgacacctgcacagggctctgaggtctcaaggaaaatgacaggtgtttgtgtattccaaaaatgtggacatgatggcatgaggcccaatgaagaaggggtagattatgaatggtgttatcctgaacataaggagactaagatagtgtagttttaaaaatggcagcatgaaaaaaggtgaatgctaaccccaccccaccttatggtaagtgtctgaagaataatctttctagggactactagtgggtattcttaaaggacagaggcagctttctgtttgagtaggaaggtattggaagcagtatatgaaggaataaaaatataaaagagagaaatattggagcaagagtgggaagtatggttaaagataaagaaacggcagggcactttagggaaatatggtatgagacggaaaagacgcatttttgagtgatgaaaatactaatcatggctaacacttacatagcatttatcttatgtcaagcatttacgtgtgttaactgttatgatgctcacattaaccccaggaggtcaggcctatcactttacaggaagtttaagcaacttctgaaatattaacaattcttctgaattgcttctctggtgacaggaataagagtcgcagtagcatcaacttgctaaaaagtttaaaatggtgctcagaataaaggtattttactgctttttgagactcattgtaaaatggcttgaaatgtctttgccctgaatctctgccagtgggaaattggatgagttgctaaagaatatggaattaattatccaaaaacactttagatatttctctttgtatagggtattgtaaatggtctttagctaattataatttaatatctcatttgtctctctcatacataggtatatatgatatatacacgtgtatgtgtacaattcaatacatctatgtgtctatgtagctacctatgtatgcatgaatgtatgtatgtatctgcctatctattaatctatctctatgtatctacctacctatctatatctgtgtctatcaacttcaggaatgcttggcattcttctaacctctgcggggtatttagggattaggcgatgatgatagatttccagcttcatttctttttaaaatcttttattcttcttgctcattttccttttcctgtccctaaaggacagtttctcctcaatttaggacttcttccttttgctctcttatcatttgcacactttctgttctcagccagaacatcccttttgtgcactgtacaacctgttgacactgtcacagttgccacttgatcattgcagataaaggaggaagtagcaattctggaatgggtggcttatctcttggctttataactggatatcttcatctgccattcagtcactcttttttattatggagacatgttttctgggaaaatgctaccatgaagcaggaccaatctccagttcaaggcacctcttgatttgctcattccaaagcatcccctcttaggaattagggctcagatcatggggtcatctattctgtaagtaaaaggctgacaaaaagtctgttacttcactgctctttacattattagggtaatattaacaatggaaatccagtttgttcaataaaacaagtgtcgatgaagagtcaaactcggtaaaatattttaagagacttattctgagccaaatatgagtgaccatggcacatgacacagccctaaggagatcctgagaacacgtgcccaaggtggtcagggtgcaggttagttttatacattttagggagacatgagacatcaatcaaatacatttaagaaacacattggtttggttcagaaaggcggaacaatttaaagcagggattggggggggctttcaggctataggtaaatttaaacattttccaattgacaattggtttagtattttccaattgacaattggtttagtttgtctaaaaacctgggatcaaaggaaaggatatgttcaggttaagctaaaagattgtggataccaaggttcttctgaagtcttatagtggctgcccttagagataatagatgacaaatatttcctattcagacctttaaaaggtgcttgacttttactaatttcttcaggattgggagggcttggaaggaaaagatctagttatgtcaatagagattctttacagatgcatatgtcccccaacaaagggcagttttgcaggaccatttcaaaatatggcaaagaaacttgcttttgggataaaattttttttactttcttctttgtcacataatgttatgccagagtcagattgcaaagtaagccatgatatatagggttaaataaaatccatctgatgagaatttatggttagtaggggatgactccccagaccccttagataggaatttgggcaaaataaaaaaatcagagcttagtcttcacaagttattgaaaaacaatgagttaccaattttatttatttatattctttcagtggtcttcaacaggtggctcatgaattcacatatttgacaattttaatgtgaaataaatttaagatatttcaacaacaatcatataggaaaagatagataaataagaaactataaaaattatactttcaaacctttccctatctaagacacagggtttatctgatctcacatagatattggacatacgatttaatttttaaaattaatttttctcactttagaaaattggcatcttgaggccgggcgcagtggctcacacctgtaatcccagcactatgggaggccaaggcaggcggatcacgagatcaggagatcaagaccatcctggctaacgcggtgaaaccctatctctactaaaaatacaaaaaattagccaggcgtggtggtgggcgcctgtagtcccagctactagggaggctgaggcaggagaatggcgtgaacccaggaggcggagcttgcagtgagcggagatcgtgctactgcactccagcctgggcaacagagcgagattctgtctcaaaaaaaaaaaaaagaagaaaagaaaattggcatcttgaaacaaaagaaagtgtctgctttccccttaaagaatcataaagaaatataatcaattagactcagatagcctagaatttaaagcttaatcaattttattgattggcttcaagaattttattgaaatgtcatatatttataaattaagactaagatgatacatatactatctactgattttaaaatacaacaaatcatttaactaaataaaattaaagattgtagtcttttaaacttaccaaccagaaataataagccagtgaaataaaagatgttccaatagagaaatcctttgtcattatatgacatacattttaatatgttacacagataatctgtgtatttaaaattgaatgataaaaattatttgcaacatttaactgaaaaatttttattcagaatttatcttgagacttgacatgtattaatataattaatgtaccttataagtaaatattgattatattaaatttttagaattgggtcgaatgtgtatctcctctcctctgataacttagttcattctatgaaatggtgctagagactaagaaatacagaggttctgttatcaagtgtcatgaacatcaagtgcctttttctccactaatgttagaatgcctctccaattatcctctttagtaaactgtgagctgaaaatagtgaagtctgatattgcaagcaatgtctccagtataaagtttgcttgagatgagaatcttatctaagaacatttttcttgtcacataaagtatgtcacacggtggcatattcccacttaaagttaacgtgtactaatataaaggcctcagcggaatgtattaagtggatttcttttggcattgggtaaaggaatctttcaaggattctgtggatatacaaacaagaaacaaatttcaaaagaggcatatgcacaaaatttttataacctgttagaatcatgatctggactaaacacaaataagtgaaccgaagtacaacacaatacaaagcaaaaataaaaaataaacaggaaatttaattctatacgatgcagaaactatgtgccaatactcagtgtaaacatacactattaggaggacgttgctgccacacaagcagatggcagagtttaagcaaagctgaagaagttaggtagtggcgtgcggagggatcactttgattattggcgtagttcctaccctcctattattctggttaccatacattagtgaggtgtctccaatgggtttcgagggttacaaataccttcctgcatattagtctaccttccttagaacttcttaagatgggccattgtctcgtgatactcaataattcaggaaaatcaataattgggattaaaataaaccaattaattacatacttctttatcacagtgtgacataaacatacattttcagacaagttttcattactgggcaactatgatatctacccaatgttgtggccaaagttggaatattcacagttcccccatacttatgccctccgtgttttggttttccagatacatgctgttgcttgtacttcaaatacactttccctatatctctgtcaattcacgtctttctcaaaaagaacagagaagtcaaatggctcctctactaaacctctaaacatatatgatttctcctgtcttgacatttttaccaattcctgttctcattataagctatggtatccgactttcacttctcttcctctaacacccctggctttcttaccccattgtctacatagctcaacttcttgcaagttgtccattcttgctctctcctctgtctacagcgatttgccttctgctcccactgttcacaaaacttctgtcctccatgtattcatttacaatgttttagccttgggctgaccatacaccagctgttcacaaaatttatgttgaactgaatgacactcgaatcaataaatacaggaaaaaaggggaacagaaggggaagcaaacaacatccttcttcacatgatggcagaaggagaaatacagagcaaagagagaaaagacccatataaaaccatcagatctcacgagaactcactatcacgagagcagcagcatgggggtaacagcccccatgattcagttacctcccactgggtccctcccacgacacatggggattacggtaactacaattcaagatgtgattagggtggggacacagccaaactagatcagtgctgcaactgacttcactgtaaatgagtttacaatgggtaactccatattatctgaaccaaacagcatagagagacctcaagaagagtaaagaaatctttgtctcacgtacatggtataccatcaataatgaaactgaggaagattcacggagggaagtcaccaccctgcagcaggcaattatatctaaaccagtgagatatgaacagtgcaaagaagaactagaacaaagatactgtctggcatagaaagtccagtattaaagacacagaaggccctacatttgtccagtaaagccatgcttgattaatgccttggaaaccctggagactggatcagaaatctgtatataaaatggttcttcctggataaagttgagagaaaaagaaagcttattgtgttcaagtagaaactgggataagctgtgggccatctggcttttctgttgcaaaaaccagggcttaaatctacatctttctatagtcatgaatgagcaaactgatgttgaacaatcatctaacaacgaaatatttaggattcaaaaagaatgtacttatgaaaagaatgtaacacaagaaatctgaaaattagaaaatttcccctttttacactaaaaaagacagaagagccatgactttttaaaaaactggagcagtaagcttgtagtgggaaaagtgatggtgagaaatgcaggcatagaaaggaagcaggtttaagtaagaagagaaaacacaaggaaatccaaaatcccaaataaaataattttgccttaaattttattatgtttaatagtagactgctgttttcttttgtcaattgctgtcagataagttttgctcttttgatttattttaaaagtaacattaactcttggttgggcatagtggttcatgcctgtaatcccagcactttgggaggccgaggtgggcagatcgcttgaggccaggaattcaagaccagtctggccaacatagaggaaccctgtctactacaaaataaaaaaaattagtcggctatggtggcacatgcctgtaatcccaactactcaggaggctgaggcacgagaatcacttaagcgtgggaggtgggggttgcaatgacatcaccacagcctgggcaacagggggagactgtctcaaaaaaaaaaaaaattagtggccgagcatggtggcttatgtctgtaatctcagcactctgggaggctgaaatgggtggatcacaaggtcaggagttcaagaccagcctggccaatatggtgaaaccccatcactactaaaaatacaaaaattagctgggcatggtggtgaatgcctgtagtcccagatacttgggaaactgaggcagaagactcgctcgaacccaggagacggaggttgcagtgagccgagatcgcaccactgcactccagcctgggcacagacagagagtccgttacaaaaaaaataataataataaaaataaaattagcaaaaaattagccaaaaattctttaaaaataaatataaatatatttatatatacattttattcattcattttatatacattttattcattcattaataaaatcactttattaatcattcaataaaatgaattcattatatataatgaatgaataaaacgtatttttccattagggatttaaaaggagcattggataaattaaaaattttttttgtcttttcttttgaaaaaaatataaatttaatgatgtatttttggactttgattaaaaataattcaattttatctgtcagcataaatattagaaatactcagagaaatttagcagaaggataagcatcattttgtaatgacaataattaagtagggctgcataagtggaagaatggacatataaatgccttttttttttttttttgagacggagtcttcgctgtgtcgcccaggctggagtgcagaggtgctatctatgctcactgtaagctccgcctcccgggttcacctcattcttctgcctcagcctccggactggctggtactacaggtgcccaccggctgattttttgtatttttttagtagagatgggatttcacagtgttacccaggatggtcttaatctcctgacctcgtgatccgcccgcgtcggcctccaaaattgctgggattacaggcgtgagccaccgcgcctagccagattttttttttttttcagaggctccctctgtagcccaagctggagtgtagtggcgcgatctcggctcactgcagcctccgcctcccgggttcaagcaattctcctgcctcggcctcctaagtagctgggactacaggcacgcaccactacgcctgtctaatttttgtatttttaatagagacagggtttcaccatgttggcctaggatggtcttgatctgacttcgtcatctgcccgcctctgcctctcaaagtgctgggattacaggcacgagccaccgcagccggccgacagactttatttcatctgtaaagttctataatgtcattcacaataaaataaaaagatattatgcaaaccaaacaaaattttgcaagatatgtgatacactatacatagaaaattcttgcatatcagtaagaaaataactataaatagataaaatccatgaatagtaacaaaagtataggatattagagaaaaagtatttgacagaatgaaagaaaaaaatggttgttttaggatcagtggtctgagatgcattcatgtgttacttcattagcttgtatgtatttaatatattctatatgtgttcaacaattgatgcagattcaaaaacaaaaaaaagttcctttagtaaggagatacacaacaacaaaaatttcctataaaagtggattacaataatgaaagtatctagaaatctaattttaaaaagtggtactcattatctgggatcatctgggaagaactcatttaacagaccatttgcgtagacacttgaggatgaagataaattttcaggcagattaataacaatggggagagttttcaaggcagaggagatgacttttataaaacgaggaaagcatgaagtttatatagcttgaaaagtgtgttgtattcaggtagtaatgcactgactccatcactcttgcattttgtttgtttgttttgaggcggagtctcgccctgtcgcccagactggagtgcagtggcgcgatctcggctcactgcaagctccgcctcccgggttcacgccattctcctgcctcagcctccagagtagctgggactacaggcgcccgccaccacgcctggctaatttttttgtatttttcttagtagagacggggtttcaccgtgttagccaggatggtcttgatctcctgacttcgtgatctgcccgcctcggcctcccaaagtgctgggattacaggcgtgagcccccgcgcccggccacactcttgcattttttattgtaggctctgaggaaaggtctgcttccacgtgtgttcagattgttatacacacttagttccttgagtgggtattattgcagtccccatttccttgctggccgtcagctgggaccagcctttcctcctagagactgtccctgttccttcttatgcttttttcatgggcctttccagcagcacgaacatttcaaatatctctgcctttccctcctgccccgtctctcagaaatcaactgcacatggtctcagcttttaagggctcatagtgattagattggactcatatacggtcctcattttaatattcataattctaactgcaaagtctcttttgtcaggtaatacagaatattcaggtctcaaggattaaagtgtgagcatctttgggggtttttattctgcttacaacatttacctagagtataaattcaagacataaggcagaatcttatgagaaaaagaaagtactattttgaacatacctgtggcaatcctaaatgggaattagattcagatttggcagttcttgataaaagtcaaggctgaagaaataatttggtagtcatcatgttatacattttgtaaatgaagccattattatatatgagagggttagcattcacccagggagacttcaagtcagtttacaaagttaatattctatggcacgttcaatagtagcaccaccttttattcaattggatagtagcctggggtgaagattaaaaagaaagaaatataactatctctatatggagatgccatgaggtataaagaatttgtatatagatatacatggaaaaatatttatgcatacaggaaatcctaaggaatccacacacgcacgcacacacgcacgcacacatgcacacattaagatgataaagctgtgatatttttaggcataactttgtagtaagatgttacatcaggaacaggaaactactatagcaaagcacccagaatggtctaaatagtcttgaaacagaaaattttctaccaaactgtattaattcggtgttgcattagcataaagatagacatataaatttaatgaaataatattgagcattaatcaataaaccttatatttatgagcaattgatttttaaaaggatgccaagaaaattcaaaggggaaatagtagtcttgtcaacaaatagtgttgggacaactgtacatatgcatgcaaacaaacgaagttggattctgaccttaccttacacacaaagttgatcaaaacctaaatgtaagacctagaagtaaaaaactcatagaagaaaacataagcaaaatcttcatgaccttagattaaacaatggtttcttagatatagcaccaaattacaagcaacaaaagaaaaaaaagggggctatattatgcttaattaaaactaaattttttcttcaaaagaaaaagccaaggaagtgaaaagacaacctacagaatgggagaacaattttgcaaatcatacatcttctaaaagacttgtattcagaatatgtatcttacaactcaataataaaaaaacatataacctatttttaaaatggagaaatgatttgagtagaaaattctccaaaaaagatacacaataggcaagaagcacatgaaaagatactcaacattattggtcatttgagaaatgtgaatcaaaaccaccaggagataccatttcatactatgatcaaaaagaaaataacaaatatgtttgagaatgtggaaacaatcccacataaattgctggtgggaacgcaaaacgatgcagccatggtaggaacaattttgcagttgcactttgggaggccaaggtgggaggatcacctgaggtcaagagtttgagtccagcctggccaacacagtgaaaacccatctctactaaaaacacaaaaattacccaggcgtggtggcaggcacctgtaattccagctactcatgaggctgaggcaggagaattgctcgaacctaggaggcggaggttgcagtgagctgagaccacgccactgcactccagcctgggcgacagagtgagactctgtctcagaaaaaaaaagaaaaagaaagaaagaaaagaaaaaaaagttaaacagtgttatcaaatgactggacaattctactccttaggaatatctcccaaagaatgaaaaacatgtctacaaagaacctggacacaaatgtttatagcaacattatttgtaatggccataaagacaatgcaaatgtccatcaattgatgaatggataatcaaaaagtggtatatccatacaatggaatataatttagccataaaaggaatgaactactgatacatgatacaggtatgaatcatgaaaacattaagtgaaaaatgccagacacaaaatgtcacatattctataatcctacttatatgaaatgcccagaaaaagcaaatctatagagacagaaggtagatcagtgattgccaggggctagagagaagagcaaacaaggactggctaataagagacacaggatttttttgttgttgttcagtgatgaaattattctggaatttgcaatgattataccataaccttctgaatatactaatcactgagctgcatccttgttaaggacaaatattatggtgtatgaattatatcttaattttaaaaagtacagtaaagtaaaaaccaattgtgtttcaataataaaatattattttaatatcactatattaacaatatggaagaaaatctcatctcaatggatgcagaatatattttttaatattgcaaacaatagaatggaatgtatttaatctggtgaaagataatcataaaatcttacaaaaatattataattaataaggaaatatggaaagctttccttatgggatcagaaaaaaaattccctagtcagttcaataagaaaaaaaaagtaagaattagcaagaaagaaatacacaggtcattatttgctaaggacattattgtatatgtagaatatctaaaataaaatattagaacgaataactaaatatagctatcaggatcactggttacaatatgagcacataaaagtctattttatttccttacactaccaataaccaattacaaaataaaattttataaatatatcatttagaatcaatattttgttaacttcataaaattaactggaaagtttttctttttaaatatattttcaaaaattgaagaattcttcaagtcagttaaatggttttaaatatttctggcctgcaacaacaaggttaaatctgcatgtgataatggatctctctactgatattagagctatcccattattgaaaaccatttttagatataaatggcaggcacctaagaatgacttaatttcctgtggtgttcctttaaaacaattttccaaaacaggcaaatcttgctctctccctctctctttctctttaaaaagtaacacaggcttatttttaaagttgcaatcaaaacagacaggtaaaaagtagaaaattaaaatgacccatcaggcttgtcttaaaattaactactgataatattttggtatatgtcctcatatgttttagtgtattttttcaggtttgttctatcaaaacctaatttaacaaaatctgagcaaatcatccacttcctttcctaatatccttttatactgtgtgtttatacatgtggttatgaatatatgttcacaagtgagggtatatatacacatacacacatacatgtgtgagatagagacataggcagaggcagacagaaaggcagagaatagctaggaaagttgagctcaatttaatattgtaattataatatgcatgctattttaaaattgctttcatttctgaatttagacagcatatagaacttgataaatacagtaattagaaatccgagagttatttgcatacttacacatctgaagtatcttcctatgtacagataaacattaaccacaattatctacacatgttgcttaaattttttcctccagctgtcatgttaaagccatgattgacacttgtttgcatactatttgagaatttaatatttggttgaaattctctgatcctaaaacatactgcttggaaatacacattttgttttcatacacatgagatgttgcatgcataccgaaattaaagaattacaattagttggtacccagcttgcatccttaagcaatctttgtaaatactatttttcttattaacgctgctttctgttctcattaagtttcaacagagtactctcagtaatttaaaacatattgttccttcagttaaataggcaatttccctctcaacaaatgcctggaccttaaagtaaggtgtggaaatggacaaaatagtcccaaatattttaaccagcaatataaacttttgcaatgcttttataggatgtttaaaataacaagaaagacttggttctcgtgattttcaccaacggtggttacaaacagtcttcttctttactatgtttgaatggcatatttcacttcacatatcctttacttgctgctagagccttaatattgctagggggaaaagcttacctagctccgtgtttgtaaatgtcagctagccaaaagatatttggaaacctataaatgttcgcctttctaacatttgcttaaagctatctggaattaacgttctcctctttcctcttctctcacctcaagaaaaaaaaatctgtatacagaagttgacacaaaatatattaaataaggctggtattcagccctcttgcattcaagcaagaattacccatgtatgtaaaacagaagaaaatgtcttgatagtattctgtacccgtgctgtcaaactaccctttgatatgtctgcaattttctcagtaaaacacattttgtttattttggattaggagcaagctcttgcatgtctaccaggatttattagcctggtaaagaagcagcactacacagaaacaacgaatataatgtgctctttgctatggttttaaggtccccttcaaactcatgtgaaatgtaattgccattgaaacagtattaagaggtgggggctttaagaagtcatgcaggctgttgtcggtttttttcttccaggttttttctatcaaaacctaatttaacaacatctgagcaaatcatccccttcctttcctaatatcctcattttcactactctctccttcagccgcaatgatccattccatcatctaacattaatttagtaaagatttactaaatcccttctctgtacaaatcattttataggatctgagtaaagatacagtgattagcatatggcagcccttgtcctttaacatggcaagaacaacttttcctattttcaagagcttgagtattctgtcactaacagatctaaaactatccaagtttacctggccaactttttcccttaaacttctgcctcccttttacaaaacttcaaaaaaaaagaattccaaatttaatcatgctgttaaaacagattttcacatcatcccgtagttacataaagggcagtctccttagctcatacttaaaatcatatcttttcaacccttgagtattgttaccattacctcaaacgatcatacagctactgtctttcaggttattcacaatacaataatttgaatatgcaaaaacaccacagaatttaaatgaaaagtaactaacgcaccctactcccctcaaaaatcaattaataaaatttgtaatttcaacaaatatttttgaatatttacaaatcagaaacaaaaatggctaactggaaacacaaaacagataaaagatttggtaaattaacccaacatgcaattttgaaaaatgtaaatttaatttttacttaataagtgatttctcaaaaagtaacattaataaagggcattgtcagaaattttgagtcttttaagagtgaaaacatctgtttgaactaaaactaggagacacagaatgataagaacatatgaagttttagctaaatatccatgaattacaaggttattctctgttggtttggagtactcatttacacactaatactcagctttaggaatttagggctcattaactttgctaaacatggaatttagggtttttttaaaaactacttatttcttcactatttttatatccaagtatactcttctcattactcacaaaggacaaatcttcaccaagcccctgcccctacagtcaggatagtaatttcattcaagcatcccttgaaagcaattatttatgctcgctgcagaaattagggtaaatttgttgtggtcccatttattttctggagattggcgattacatgtaaaataatttgaacgcttgatagatagactcataaatatttggttaatacaagtaaagcagggggaggccaggcgcggtggctcacgcctgtaatcccagcactttgggaggccaaagtgggtggatcacaaggtcaggagaccgagaccatcttggcttacacggtgaaaccccgtttctactaaaaatacaaaaaatattagcagggcgtggtggcgggtgcctgtagtcccagcaacttgggaggctgaggcaggagaatggcttgaaccagggaggcggagcttgcagtgagctgagattgtgccactgcactccagcctggggaacagagcgggactccgtctcaaaaaaaaaaaaaaatggagctgggggggccgggcgcggtggctcacgcctgtaatcccagcactttgggaggccgaagcaggcagatcacgaggtcaggaaatcgagaccatcctggctaacatggtaaaaccccgtctctactaaaaatacaaaaaattagctgggtgtggtggcgggcgcctgtagtcccagttactgcgggaggctgaggcaggagaatggcgtgaacccaggaggcagagattgcagtgagctgagatagccccgctgcactccagcctgggcaacaaagggagactctgtctaaaaaaaaaaaaaaagtagttattttcttcttcatccctttcagtgtggccactatttataatgcagtttggttcattagtgtttgtattccaaaaacaccctcagccttcctatcctagttttaatgaattattagtgtgaaacataataagggtcggagctatacagaaaggtctactcagaggtgctttgttccctcctattctgttcccaccactcctactttccactactttttccactgaccctgtgagcatcatatttattgttaatggcagttacatttttaccaagtgcttactatctgtaggcacttggtgtgtattgcttcttctggtgttcacagcaacctcttgaggtaggcactattattatccaccccaccccgccccgttttttgagacagagtctcactctgttgcccaggctggagtgcagtggtgcgatctcagctcactgcaacctctgcctcccaggttcaagcaattctcctgcctccgcttcccaagtagctgcaagtacaggtgcgagccaccacacccatctaattttgtatttttagcaggggtggggttttgccatgttggccaggctggtctcaaactcctgacctcaggtgatccccattttttagatgagaaagcagagtcccagagagcataaggagcttgtccagagtggcatctctgatgcataaccagtactcaaaccagtatttttctgacaccaaggcctgtgtgtaaactgtaaaagggctgtttggtacctgctttcctaaagttgtctgatcccttctcagtccaggtcttcctgaagcttggcacttctgaagtcacctttctgaaaacattctggtaactgttagatcccttgttgtagctattcatatgttctgtgtggttaaacaaggttcacagtgggccacctggcctttggaacttggctgaagaggctgccttcagttcatcctccccacccccattttcaaaacatgggtttccatgtgttagttgtaaattaggaaacataaccatgttttgaggcttcatagaaaacaaacgtctggggtcacacaggttaaaggaggaaccaaattcagcactatcactgttctattcagcaggcaattctggggccttcctgtgtctcaggttctgtactagttgtttcaggactttgggataaacacaaactatccctgccctcagggggattaaggtcaggtgtacaaatgactctaatgcgaggcaaggctggattcagtgctggaagaggagggcatacctaatgctatgggaattcaaagaggaaatgatcagaatgaggagggagagatgggtcattccaggagaagcttcagggaaaagcaacacttgaaatgagactttggagagtgagggaggtttgggcagatggatagagaggatgcaaggccaggggaaaggtttgagccagaaagtcggcttgggcaagtgcatgggtaaaaaaagaaaatccactttgggaggccgaggcaggagttggagactagcctggcccacatggtgaaaccctgtctctcataaaaatacaaaaattagctgggcatgatggtgggcacctgtaattccagctactcgggaggctgaggcaggagaatcacttgaacccaggaggcagagattgcagtgagctgagatcacaccactgcactccagcctgggcaacaagagtaaaacttcatcaaaaaaaaaaaaaagaaagaaagaaaatcacaaggcagtgtggggaatggtgagtaatctaatttggttgttgcagagaggatgtagaaggaagtgacgagagaaagccagacaggtggcttggggtcatcttaagggcctttgtgccagttaggatgttccagactttagtcaggctgcccagctcagactggctcagacaatgagggggtttattggtcatgtaattgggaagtccagaggttctaggactacagaaaattattatttagtattagtttgacagcaacaccttctgttttctgggagcaggagatgcttgtcaagctgtaggtcactgagttgaatattagcctgctttattaaattgccaagggcacggtaattgttgagaggggagaagtacacaggaaaaaaacatgaccagcttagaaacgtcaaatgattatgacgttgttataaagtattataattctttgagcgtctactataagtagagaaacttgagttccaggttgtgggcttggttccgccaacaatcaggaacgtggttttgcatgaagcccttctttcttctataatcttcagtgtcctcacctgcaaaatgaggcctttatatatatatatatatatatatatatatatatatatatatatatatttttttttttttttttttttttttttttttttgagacggagtctcgctctgtcgcccaggctggagttcagtggtacaatctctgttcactgcaaactccccctcctgggttcacaccattctcctgcctcagcctcccgagtagctgggaccacaggcacctgccaccacgcccagctaattttttgtgtttttagtagagatggggtttcaccgtgttagccaggatggtctcgatctcctgatctcgtgatctgcccgcctcagcctcccaaagtgctaggattacaggtgtgagccatcacgcccggccaaggcctttattatattacggttcctactgttttttaaaatacttttattaagtccaacatttttattaagatcattgcttttatacatgcctatttatgaaaggggtttttgagtgtttaccactttttattagaaatagagacagtaagaatgtttgacttaattgacacaggcataattgaatgggtataaatggcatgccatagaaagagaaaattaagttgagctactctgttggtttcactgatgaggggatacatcattcaaacagccaggaattaaatccgtccaactcacaaatggggaaaccagctgtgtctgtacccatggccagccagattgaacacaaatcaggaaagtcagtaacttttcctcagttctgagggacttcagtggctgcggttcattttccttttgcttctgaaacagtgcaagttgatgctcgcctggacagagcggcagtgagtggtggcatctgaaggccaggtctctgttgagatgactacacgtcgtctcccagtgcccaatgcatagaaaagatacactactaagtgtgagatcctcagtgaaaaataaaatctggggttgaatcatcatgggggatactgcatactctgtttcccccctgcagatttccaatgctcattagtttatagagactctgagaattcctacagcaaaggcacctgccgaggtatttacaaactagtttagctaaaccagactttcaacaattggttactaaagaccactcaaagtctgtcaacactctgtcatctctacgtaatgatagaaacatagaaattcagggtaaatgtttagaaatttctatagaaacttgacattctcccagcatctgtatgtgacatcaggggacttgtctcaatgagcagttacagaccaactgaggttttgtcagactcaatggaaagatgcagaggctgtgagctgcaaacgagtcacatgcacaaggaccacattgcaagctgcgttctttaaggttagtttatcaactatagtataatctcacacatctgaaaaataggaacatctattctataaagtcttatatttgcaataattttaattttaaatcaagccaatgttagcattattagtgaaaacaaaagaaagttgtattatttattattaaacctaatttgagagtgaaataaattgtattaatttttttaaccaataaaagatgcaccttgtaaaccaagagatgattatgaaagtgattctgaggacatgaagaccaaaggagtttgtcctcgttttactcagaagtactatttctaatggacagatgatccctgacatacaatggtttgacttataattttttgactttatgatggtgtgaaagtgatatgcattcagcagaaaccatacttcagtattcaataaattacatgagatattcaacactttaaagtgggtttgtgagagataatttttgcccaatggaaggtgaatgtaaattttctgagaatgtttaaggtaagctaggctaagctatgatgttagtttaggtgtattaaatgcattttaatttaatttaatttaattttatgttttgagacagtgtgttttgttcttgtcacccaggctggagtgcaatggcatgatctcggctcactgcaacctctgcctcttgggttcaagcgattttcttgcctcagccttcccagtagctgggattacaggtgcgcaccaacatgcctggctaatttttgtatttttagtagagacagggtttcaccatgttggccaggctggtctcgaactcccgacctcaggtgatccacccgcctcagcctcccagagttgggattacaggctgagccactgcatccggccttaaatgcatttttggcttgtattttcaactgatgatgagctataactcctttgtgagttgaggatcatctgtcttgaatttggttttacaggcataactgaaggtgaaaggacagaatcaccgtgtgttactggcacaggtgcatcggctagtgaagaaagaagacattcaaactgtaagttgcattcacgtgggaagcacaaagaattaaattcaaaacaatgaaacattagagaaaagcatggagttaaaacacaacagaatcagatgtttactatttctcattttaacactagtgctttgcgggcttctaataaagttgtactccaggaggctaagactgaaaagtgacactagtgaaaaatagcattgaaatagttccgtagaaaagttgggtgaatgtggggcaaagatgccactaaactttaattttccatcgacacacaaattcaaagttttccagagctggcaagtaaaatggaagatccactcacaggacacatgcagcgtgtgaggggaatgcttttcagcacttcttgatggatgcacaaataatgccaacgtggtaaatgtctttggtaaacgtgcaatggaatgtagtggttgtgtgaaggaagaattttgttttcagcttcatttttgataaacacaagcagctctggactgtgtgaaaccatggagcactgcacagttaacagaggtggtttggagttttttagctttgcataagaggatgttctgatgcagaatctacagtgacaggaaaccgttctggacaagttacagaattaaggagcttgtgccgggatggaaataaatcaatgacttctgtctttgagaaggtttttctctgctcctctgtgatggttaatttttttttttttttttttttttttttgagatggagtctcgctctgtcccccaggctggagtgcagtggcgccatctcggctcactgcaagctctgcctcccgggttcatgccattctcctgcctcagcctcccaagtagctgggagtacaggtgcctgcggctaattttgtgtattttttagtagagccaggtttcaccatgttggccaggatggtctcgatctcctgaccttgtgatccacccgccttggcctcccaaagtgctgggattacaggcatgagctaccatgccccacctttttttttccttttctttcttttttctttctttctttctttttttttttttgttagtccttccctccagtgtcatggagataattggaaaatgttttagagcaaaaaagtttatttctccttcttgttgttagcaaagaaatttatttttccttcttgttatttattggccttggagacatacaccaaatagctcattctacttctgaaattttgttttgatttccctggccctccccacgaagtatttcagattagcagggagtcaagtattgtctgtctatctgtgaataaaatatttcaggctgcttttgcataatatacatgctcttgcctttacgagtcacactcacatcttctggttttgtaaaacaccaggtaaagaagaaaacaatgtttctgaattctgctttatcagcccagtagagaactcttcccttccctgaactgagggctacatctaaggggttgaaacagggccagtttacagtgattataaatcaaatgcctgaagatgctaagcttaggacagtgtttgctgtacaactttgataactgaacatttttaaagctgaaaatgtgactgtgtgtgtatatgtggcatattatccttagatgatccttacttcgattattaagaattttttcccctagtaatcttcaactgtctcaatattcagcaggaaccccttggagacaaagatcagtacgaatttggaacacctattgacaaaatgaatgtaatttaatttaggacagtagtaaagtcaaccacttttaggtgttgatgctgctgaaagtatatataagtgcagagatgacatccagaacttgtcatgaatattacaaaaaggtctctaagggctttatggaggtctgtaaattgacttcatgtgaaagagtgtaagaagtgaaaatgtgaagcatgactggagagccagagtgataaagcaagggtccctttttccagatcctttgtaacagtgtcatgtgacctcttctagatcattctgaaagacaatgccagctcggaacctaggaaagcatccagtgggtttctgcatgttaggtggttcaaatcctcattagcacctttgttttctctgcctcagtttgcttacagtgatgttctcagtagctgtaattgctgtctgtctttgaatatttaagcatttttttttagatcacagggtatatgtgcatttttattttaccaagtgttagaatttttaccctgcctttgtgggctctgggttagctacttggttgtttcatcgtaaaatgattagcaggaaaaactgtgtgtgtgtgtatgtgtgtgtgtgtgtgtgtgtgtgtgtattttaagtttcttaattgggttgggacatgtaaaccatttagaacagtgcctgctgcataccacatccccatcagtattcacgtctctcatattctaccctcacacttgattgatagtttgcttgattatgtatttctaggttgaggataattttaccttagaatttcaaagtctgtactgttgtcttctaaccagtcatggtggtgaagcctcatgccatcctgagtttcacttgtttatgcatgactttctccctggaagctttaggagttcgtcttttccttggtgagctgaaatagcacaacagtgtacttagtgtgggtcttttttcattcattatgctgggtacaccaaatgaacaggcctatggataggctctttcaaagttggagtcttgaatcttgtcatatttttgttgttaactttctcttttccattttatttgttcattttgaagtgtctgttaattggattttagacctcttgtcttgagtcttgtatctcctgttatttctaaatttttttaaaattttaagttctggaatatttccttatctttcgactttcaggaaattttatttggactgtcataactttaagttttgttttggttatttattgttgtttaaccaattatcccaaaacttaatggcataaaactacacatctgtctatctgtcactactgtatggattacctggggctagctggacagtttttctgctggtctcattttgcagctttcactgtgtggttaaacagtgtcagggactggtcatctggatgctcagctgcagtggaatgtccgagacggcttcttcacccacaggtctgctgccttggtaattcttgatgtggcctttctctctgcatagcatctcatcctctcggatctcttcatgtggcttttctttctccaagaaggtagtcaattcttatttttggcttccagaagcacagaaatggagctgccaggagttcttaaggcttagacctggaacaggtccagtgtcatttctaccacatgctataggttaaagtgagtgttggggccaacccagattgactatgggatgggcctgtctaaggacatgatgacaggaggtatggctcattggagaccaactcccaagatgaagcatgagttctaagaactttttcttctctgattatttcttattcatattgttttgttttatgcatgtaatatattcacaagtgtctttatgaagtgattttgatactctttgtcttctccctggcatctccttgttctttaataatttttttccttggtttattttggtcttatttttctttttaaagcctttccttaaatatctattctatgttgcttatcatttgttgtctttttttttttttttttttttttgagacccagtttcgctcttgttgcctaggctggagtacaatgatgtgatctcggctcaccacagcgtctgcctccaaggttcaagcggttctcctgcctcagcctcccaagtggctgggattacaggcatgtgctaccacgcccagctaatttgtgtatttttagtagagatgggatttctccatgttggtcagtctggtctggaactcccaacctcaggtgatccacccaccttggcctcccaaagtgctgggattacagacatgagccaccacgcctgacctgtaatcttttttccattcctttatttgttcattcatatttgagagaggtactaaaagactgggagccggggtgtggtggctcacacctataatctcagtgctttgggagaccaaagtgggaggatcacttgagcccaggagctcaagactagtttgggcaacatagtgagaccccacctttaaaaaaaaaaatagctaggtgtggtgacacccatctgcagtcccagctactcgggaggctgaggcaggaggattgcttgagcccaggaggttgaggctgcagtgagctctgatcatgccactgcattcctgcattccagcctgggcgaaagagcaagaccctgtctcaaaaaaaataaataaataaaaataaaaataaataaaaattgattgggagttctttgtggccaagacttgtcaactgatagctttaaggggaatgtatgctgattcctaattgttatcctccatccctctatcttatctcctggtgcaatcataaatgatggctggatgactactccattcctctggatgtaaaatctacattctcttgcctgaggtggatacgtttgcttgggttctgtttaaggagatggggccagcagtgtgtttcagggcctgtgaaatgtgttctctatccgggcttttgcttaatctctgttttcagtcttgcctatcagtcccactgtcgggggtacctcgtgtctgagtctagaacctttccaggttgctgtgggacagattagcctccttgtcctcagtatccccctgacctccacctttgttgctttgctccatgaattaaccattttccatgtactgtcattgtgtaatgaagatgaattctcttctgttggtaaccccattccttttttgtaattgtgtgcttatacaatgtttattcttcactgtatttctattggagcctcaggacaaagagcagatggtgagaatctatgttcagtgttaagttttccttctgtaagacatgtgcaacttgtgtttttcactgaatagatcatggacttaatgcatatagagctactttgtttttcatgattgtgccttcaattatatgtagaaatataatttgtgaattgcctgatgaaattttcataattttgaattgtctttgcattcctataataaacactgttagaatggctatggtaatgttttatttttgcattcttctgtattaaataagattatagttttgtttgtttcctttaaggctgttatttcatttcagtatcaagggtatgcagggctgagttgggaagctttacatcttttttctaagatctaggatgtagatctggtttacacagtaattttcaactgcaggagtattttgcctcctatgggacgtttggaaatatctggagacatttttgtggtcacaactggtcatggtcgggaggtcttattggcattctgtgggtagagggaatgttactaaatgcccgacaacacaccaggagaaccctccacaaagaattatctggcccaatatatcaatattgctgaggctgacaaattctggtttaaataaatatccaatttggaggatgagtctttgtctttttccttcttctgcatattggtctccagatttcccacttcttcagttagttttcgtaactgtaggttcttaaaaaaaaatgagcactttggccgggtgcgacggctcatgcctgtaatcccagcactttgggaggccgaggcgggtggatcacgaggtcaggagattgagaccatcctggctaacatggtgaaaccccgtctctactaagccaaaatacaaaaaattagccaggcgtggtggcgggcgcctgtagtcccagctactcaggaggttgaggcaggagaatgttgtgaacccgggaggtggagcttgcagtgagccaagatcacgccactgcactccagcgtgggtgacagagcgagactccgtctcaaaaaaaaaaaaaaaaaaaaaatgaacatgtcatccatacttctaaggtgttgtaaagatgtgtaaagttttcactttttgcatcatattcacatgtggctatatgcccttttctcttcaaagttttctttatcttgattacttatcagaggtttgactgttttattttcctcagtcttttgaaagaatcctccttcagttttattttttaaatctagtggtttttctttttcctttttccttatgtcttaattatttccccctttttgtttgttttgcttttcctagtttagtggatcaatgtaatttaaattgctttttaaacaaacatgtaagggtatacattttcgttgggtgctgtttgactttgttgcacaagttttaaaatctattttttaatagtttgtattttctaaattattttattgcatcttttgttcacattgctcttactattaattttttatttttattaataaataaataaattaattaattaattgagatggagtcttgctctgtagcccaggctggagtgcagcagcatgatcttggctcactgcaagctccacctcgggggttcatgtcattctcctgcctcagcctcccaagtagctgagactacagctgcctgccaccacatccggccttttttgtatttttagtagagatggggtttcaccgtgttagccaggatggtctcgatctcctgacgtcatgatccacccaccttgggctctcaaagtcctggaattacaggcatgagccactgcacccggcccaaaagctttgtgtttttacagatattagacatgtttcttgtttaagaaaaaaaatcttaacgaaaacgtaggagaataagagaaacatttttccaaaaaagagaaatcattgtgattattttatcttattagaatgttggataatatagtctgcttcattaatcatcaagcatgctatgcattttccatttttataggatctgtatctcagttaagataatactggtaatttttatactgtaatcaaagatgaaaaatgtaggccaaaatcatagaccttgcatagaagctggataatgaagacagctatagagaaaaacacagatacacacacacggacacacatatatatataaagtatacacacatatattttttaaagttttaaagctgttaaagcaaaagctggcccctcttctcttccagagtgggaggcctctcccctctcttagagtgggtgcggagagcggtcgcatgggcagctttccttgtgagccacagggccctctggacacgctgctgtctggccacgccccctttccctttcatctttctcattgaccaatgggcttggagcattaaggccacgcccctattccgcattctactggggccctggttacgcctcctctggctcagtcacacagctgcctggaaggtgactggaggccttgatcggttctcattgcgattttgctgctgtggccccaaccctgcctccctccccaccctgcgatggcagaagaaactcaacacaacaaattggctgcagccaagaaaaaggtaaaaacgcactaggtcatagcccctcaacccagccacagatcccctctgatgacaagacccctgccagagtctatacgactcctgaggcacactggactgttccccccaaccccggtgccttgggctacccccatcaaagttttgtcagtcagccccaccccttcagaaagcagcccagtccttgccctcgccaatcaccccagggtgactttgggtgggtgactcctgggacttcccgctccgttactgggccctcatctcctgccgccccaagcttgatctccctgggctctttgggctctcatctccaaggagccaggccccaccctcgccaatcatccctgggtgactttgggctggtgactcctgggactccctgctgcagactctgccctcccctcctgctgcctcaaggtcgacctccctgggttctttgtgctggcgtctccaaggagctgggtcccaaccctgtgcttccctcccccatcgtggagcggcgacttagacatggtgctgacacggtccctccccctgaccaggaggattggaatgttgtgatgtcacagcccacctagtaactgccgttactgcaagactggcctttgatcttatgacccagtcccctaagcgttctcaccccgtttctggttcctctggtcacaggacaaatttccagctggaaggggaatggagactatgggacctaggagcaagaggttccaggctgcctcactcccttacagatgttgacggtgggaaaagcctacacttcccccatgaactcaaaacattgacagtatctctgggtggcaatgagagaatgggtttggtttggttttctcccaggcttctactttccagagagattttaacattttttttctgagttctccacctcatattctaattctccatggttctgggaccagactctccttcagtcagtggtctctgaagtgacatttgctcatcttctgtggaatagatcttgggaaactgaacttgacaccttgaatcttcctcatattatctcaaccttgggtactttgagtgccacaggataaatgtgggacatctttctgaagcatcagtttcccttgattctcttgagatcaagagaaaaaacatgaatatacttagggatgacagtcacataggtttctaagagtataccagccctctctctgaaatgaggcttgggttgtcctctttctgatgaattctgatttaagagaaaggctgccttctgccgtgaggacacattgatataaaagtttgagaggtactggtgcacttcttcacactaacagacgtgtgaggatgtatgactctaaaccacatggcatacagttcctgcctacttaatgtttacttttctacctctgcctctggttttggtccctggcagctgctgattcttggcaaaacctcagagcttggagtcagaagactgagtttcaaagtgccagtattgcctttttctttttttttttctagccatgatatcaatccttctcagtcactaaatgagtgtgacaacaccttgtacagttgttggtgtcattaaatcagatagtgtgtaagtgtattttgtaaaaactgtaaaggaggatgtggctgtaggggctgacggttctcatgagtattactgctcttctttccaacagttaaaagaatattggcagaaaaacagccctagagttccagcaggagcgaacaggaacaggaaaacaaatggcagtatccctcagacagccacttctggtggttgccagccacctggggatgtgagtcttggctgaccaggcttctggggacagggggcccaaggggcaatagagggtaattgttaagattgtggatggactgctgggtacgggttaagaattctggctttagccgggtgtggtggcccacgcctgtaatcctagcactttgggaggccaaggcaggcggatcatgacgtcaggagatcgagaccatcctggttaacacggtgaaaccctgtctctactaaaaatacaaaaacattagccaagcgtggtggcgtgtgcctgtagtcccagctactcagaaggctgaggcaagagaatggtgtgaacctgggaggtggagcttgcagtagccaagattatgccaccgcactccagcctggtgacagagcaagactctgtctcaaagaaaaaaaaaaaaaaggaattctgggtttgaatcctgcctctccatctgctctgctagggatatgatttagggcaagttgctagacctcatcgggcctctcttttcacatctgtataatagaggtgttattgtttcacttccatttgtgaaattttcatgagatttgttattgttgtttttatgttaatccctagtacatggcctgctgtaaacactcaggacacccaggatatggtctttgctgtttgattttcctcatccccagtctcaaggggaagccaggacaatgagaacagccacttgccatcaggagtcactgaaagggccccaggatgggatggtggggagataagaaccatgagagaagttggcacaaaggagttatgggacaaagggtccaagataggcagaaaagaaaatgttgccagttgatggggaagaaaggaagtcagagggctcagacactgtgggggacagaacatctccatgtgcactctcatctcttgtagtcagcaacaggttttcacagggaaggccctacatcatctgctaccctgaaagatctggaggtaagaggctctgggcagaggtgcagtgacccttcgggtcagccctccaacctcctcctccaggagggactgggtgcccctctgccagctgagacagcccacacaccccagccctaatgattgttctctctacctctcccccgactcctgctccacctcctcctctctgcatgaacctcagagcccgtgccaagaacgagcagtagtcctggattcaaggtccgtagaaatcagtcaactgaagaacaccatcaaatctttggtaagagtccggtggggtcccctgattccacgctgccaatcctgggctccagtttccccttggggccctgaagaaaggggctgggggtccctggtgcccgggacaaatagggagcttgggtgcccaggcctcacctggagggaccccagagcatgcagcatggctcttcttttgctgccctctttgccgactctctcctctccagacacccctgctcgagtccttgctacacacgccctggggttgttgcctcttggggaagtgctagcctgactggttgtcaagggccccgtatttctgccatgactcagtccctaatttgctctttgattctggacaagccacctctcctttttgggctcgtgtttccagaggaggtagtgagtatcaaaggtctctgttagctctcgagtctgagatttaaaggcccccgagaatggaaacctcagggctaagggctcctgtctgtccttttctatcctatatctgctgtgaagaaccgtacctggcccatacgtgctcagtaggtgtttattgaatgaacccacttttctaaatcacaagctgccagaaggaggggcctttctgaaactccatctctagaggtttatgttgctgtcctctcaagagattccagattcagactttgagttctgtggctgtgggcaaaagcccacaaagacccaaatcctctgtccttgggagcttgaggagagtttaccagttcgtgttcccattatgtctgagaactttgcctttaaaatccattcctggcccctgcctaccgcttcctggtctggggaatagagttgagggggccaccctccatcaccttatttgactctccccacagaaacaacagaagaaacaagtggaacatcagctggaagaagtaacgtgatttcgtttccttgcaacatgactgctggaagaaggctcacccttcagattccaccccatcccctcagggccccgataacctggtcccatgggtgggcctgtcctggggcattggtggcattctgggggcatgtctcttgctgtgccatctctgcctccccctggtaagagctctgtcttcctcttcctacaggaaaagaaagcaaacatcaagaaacagaaagccaaaagggtgctagaggtgagtggagggtgtgcagtttcctcctgtcctccggagaaggtttctttccttctctttcagcacttgcttggcttttctcccaaaggttcaaatccagacattgaacatacagaaagaggaactaaatacggacctgtaccacatgaaacgttctctcagatactttgaaggtgggaatctgggcaccctgtcatccttcaacctggcactttgacaggtcttcagggggagtcctttgggccccatctcaactctctcattacagaaaagtccaaggatctggctgtccgcctgcaacattcattgcagcgtaaaggagagttagagagtgttctctctgatgtcatggccacacagaagaagaaggcaaaccaggtgagtccaaccacctgccccatcccctgggagtctgcctttgcagatggaggagtgagcctaaaggtcccttctgcaggatggcgtgtcctgcccagaaggcagcatggccatttcttgctacttttttgtatggtttttagtggcagcctggggctgagtcagctgctgtgggtgagttgggggtcactgtgtggagtgagcactggacgcagagcttggaggccaagtgcctgccccgcccttacctggctgtggtcttgggcaagtcctaggtggggtattgggtacttgtactgtgaaggtacagaagagtacctttagtatgttaccatttctgtagaaagaggaaacgtgtgcatgtgtgtgtgtgtgtgtgtgtgtgtgtgtacatactatgataatatacataaaacatgtctgcaagggttcataaaaaattcaggagagagcaacaagatggccgggagatacttcccttctgtaccttctgagttttggactatgcaaatgtatcatcctttcaaaaagtgaacaaaagattaattttccccttcctatctgtggttgtgaggattaaatgggattgctagcatggtatctggtgaagcactccataaaagttcaaacagtggtaataataacggtaataacaatagcaatattatctgatctctctgggcctctgttagccagctataaattcaatctcattccctgtccgttccaactttactgtgttcttttaaaaaccagaccatgggcttggaaatgccatgatctttactgaccgagttgtatattgggcctagccctagccctgttaaggggcactgtgtggaaatgcccaggctctccagattgaaacttctcactctttgccatccagttgtccagccccagtaaagcaggtacggagtggaagttagagcagtccatgcgggaggaggcactactgaaagtgcagctgacacaggtgaggttttctgagggagttatgtggaaggaagatgaccccaggtggccaggagcaggtgaggaccagtgacagcccttcctaacttctgtgcccattcttgcagttgaaggagtcatttcaacaactccaattagaaagacatgaatatgctgaacatctaaaaggagagagggcccggtggcagcagaggatgagaaaaatgtcgcaggaggtgagatctgacccttcagcccccccacattagataggtcactggatctttctggtcatctgtaaaatgggaatagtacagccagaggtggtcatgggtctgggctttgtggaggtgggggcagagagggagagggcagcctgtccagcctccagcccctctctccagggccctttccccttgtgctttgggcagatttgcacattaaagaaagagaagcagcaagatatgcgtcgggtagagaagctggagaggagcttgtccaaactcaaaaaccagatgggtaagatggggctggcatgacctgggagcaggactggcatcagagggctgtgagggtggcttagagtgccccagggaggtgggtggatggaagggctttgaggcagagggaaagaggtctgtgccaggagacggcaagtcttgtcatctcaatgagcctcagtgtccccatcagcaaagagggcccgttgtcagccacccgcagtgctctttctctgaaagtgctctggaagactggctaccatctgggtgtgaggaatcattagcagtgaggccaagtttgaggagcctgagaggagctgtggaccaagaggaggttttttcttttccgagaatccagaggcccttattatctgcttcctttctcagctgaacccttgcccccggagcccccagcagtgccctctgaggtggagctgcagcacctgaggaaggaactagagagagtggcaggagcgctccaggcccaggtcaaaaacaatcagcgcataagtctcctgaaccggggacaagaagagaggattcgggagcaggaagagaggcttcggaagcaggaagagaggattcaggagcagcacaagagccttcagcagctggccaagccacagagcgtcttcgaggagccagtgcgttgccccagctggggagcctgccctcctccctagccctccgggcctttgtttccccacctctaaaatggggcagtgtagccctcacatgaaatgttacttctaaaggcacctgtgagccaggtggctgtgggagagagggggtgatttttctaacctgtctccagccttcccagtgccatgggaggcagacaccaagttctggggtctccagctgcagtgggtggctgctgattgcttctctctgtccagaacaatgagaacaagagcgcactgcagttggagcagcaagtaaaggagctacaggagaagcttggtgaggtgaaggagtcggaaacctccaccccatccaagaagggctgggaggcgggcagcagcctctggggaggggaggtaccaggccagaggcagcttccagcctgggggctggtgaccacagcaccccccagggcagtcctgtttcttgcttcctgcctctgacttttaaaggtgggtagccctgggctcctctcaggtctggacatcatcatcctagctagaggcatggagcccccaatcacaggggaagagacagtggtataacaggctccttatgccaggtgcagtggctcatgcctataatcccagcactttgggaggctgaggcaggagaatcacttgaggtcgggagtttgagatcagcctggccaatgtggtaaaacctcatctctactaaaattacaaaaaaaaaaaaaaaaaaaaattagcaggacattgtggcacatgactgtaattccacctactcgggaggctgaggcacgagaattgcttcaacccaggaggtggaggttgcagtgagctgagattgcaccactgcactccagcctgggccacagagtgacactcttgtctgaaaacaaaacaaaaagactccttagattaaaactggattccagcctcggttccactggtcaccattcaagtactttgcatctctaagtctctgtttctttaacttcaaagggaagttagcattttccttacagaggtgctgaggattaaatgagaagagggtatgagatttgaggctggggaaggaggcatggggttctaggaaagggaggcagtcacttaggcctggagtaaggggacaggggcctgggcagctgacagagccccacagtgccctcgctaccctattaatgggcccagaatctggaaaccagccaccacgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtgactgcagcagacccagctaatgaaccagctgcagcagcaggaagcttggggcaaagcagtggctgacatggcctgccaaaagttgcaggagacccaggggagggagctgcggaggatggggccgtgagggggacgacctggcaaactccatcccttctcactctttcctggccccttaggagcacctggaagctgccagccagcagaaccagcagctaacagcccagctgagcctcatggctctccctggggaaggtacgggagaccgctcagaggaagaggagagagccccaggaggaaggggggactgctagcagcataggattgaggagttggaagagacctttagaacagctggtcattatgccgaccgggtgcctgcactaagttgggcatcagtgtggtgacctcctgtgagcggggggtcaccaagttgcctaaggatggctgaactggccaaggtcagaaagggagcaggtcagaactcccacatcgaccagtagtgggaatgtgcctgggcggaatagcaagatcttgattcttaaaagtaaaaataaagaacaacagctcattcctctctggggaggggctggctcaggattacacagtgagggtggaggtagaggtgggcccacagtacctcccttgttgggttgtctgaagacccctctggccaccccccacaggacacggaggagaacatctggacagtgagggggaggaggcacctcagcccatgccgagtgtcccagaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtggccaacaggtgcactctctgaggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtatgctgccagcgcctggctcacccggtggcctcggcccagaaggagccagaggcagccagaggccctggagccccagggcctgggggcgagtctgtgagtggggagacccactgggccctgcaggaagtcacggagaagctggcccatggcaggactcacctccaccttctccatgacttgaaaatgccacctgagggcaggtcgctgccgagatgtgactgcaatattttggctccagagcagctttatggaccacctggaggagaaggcagacctgagtgagctggtgaagaaaaaagaactctgcttcatccaccactggcgagagagatgccatcagtgagtgggaggccagggcacggcagggggagctacagggccgttggaggggccccagcgtatgagccctgtcctcccgcaggaaaacccatcaccttttatcagaaccagggggccgtgccaaagatgcagcactgggaggaggacaccatcaggctggagctcagggaggagatgaaggtagggtgtgcaacatctctgtgggggtgggggtgggggtgggtgtgagggtgggcgcaggcagcggcatggcagctgagcacccctccctccaggtgaagctgctggagctgcagcagatggtattgcggcttacagcaactacaacaatgggcacagaaaattcctggccgctgcccacaaccctgctgatgagcccggtccaggagccccagccccccaggagcttggggctgcagacaagcatggtggtgagtagagccctcaggtggggtgggcaggcaggaagagggggctcccactgtgctcagatccctgcctccctctctccaaagatctttgtgaggtgagcctcacctcctctgcccaaggagaggccagggaggatcctctccttgacaagcctactgcacagccgatcgtgcaggaccaccaggagcacccaggcttgggcagcaactgctgtgtgccattcttttgctgggcttggctgccaagaagaaggagataaacatcaccatcatcaaacagctgctcaagaaatttttaaataagaaaccaagttatggggttaatctcctacacaattcatttacttcctttgaatgttagagtcactcatgattatttgtgtttctaatttatagtttaagtttatttataaaaagttaaaagagagtgggtgtctgtggctctcactgatgttcactctggcatccttttagcatttttcttttttaatttcataattgtaggtcattagcatgcatatcgagtttgcccttacgtggtgggagttcaaacacacaaagacccactctttgcccaaaactgttctcgctggtttggaataggctgccatgcttttttaatgttattgcagcatgtatattcactacagaattcagacaaaatttgcctatgttctgctgttgtttgatctaatcttaatcacagtgagctcttcgttagctcaatatgtagtttgcccccaagtgtgcactgtttattactttgtaatatgccactatgagtactgacatttagagttgtttaaaggccaagaactggaaacagcctttcctccattttctgtgtattggtgatgggagtgataaccttttgggggagctttttaaatctcacagaagaggaaagtggcctcctctggcaggtatgtgcaggatagagtgtgtttcatctgttccggtgccaggaattagcagtgtattatgatggttcccttaggatttctatgtgctctgggctcatgaagatattgcatcatgagctgcagcagttgcactctttttggatgacctaaaaagggcttatttctgaggaatgaaaggttcccatcgttgactgtggatgtggaaaacctttcctagcttagagcatttgtatctacaatacattttaaagtcagagttcatgttacctgttttaatcacatgactacatgtcccagtacacaaaagggcactggttggcattcttcttaatgtatttagtgaagatcataacaaatcctttatgagttcaaacgtccctggaacaggcatacaggctctagtcaagaatgaattagagtgaaggaaagctgtgtgacacctggaattcctctctgttcacggatattctttgaggcttgaagattgattttaccatctagacctctttggctaatacctattcttcaaccaccttggttactctgacataggaatttacttccttttccttgaatggaaaacactttaaaaaataatagaaacattattataaactaatatatgtgagatacttagttgaaacaaaaaggagttttagtagacggtattatactatctttgaaaatcaaggagaagtttatgaaacttaaaatgtgtacaaactgcagtgcaatctactgttcgtgaatgtcaatgtattatcaggaaacgtgtctatacaatcacagagttatattttctcacagacttctttacaaagtgaaatatgtttttgtacctctgggtttctgttcgggacatattttgtgcaatatttatgtgattgtgcctatgcatgatgaatgaatgcatttcagttatatattgcctaaatcgtaacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttcaactgactcttccaaattttatgaatgtatcaatgtattagataaacccagtttcagaatgataaagaaaaaatgttagaccaaataatgcggctaattaacagtggtacgatttgtagcccgtgggtttaaaatgcacttaaagtcctgttctcgccttttattttctgaacttgccgcttttgcattctttgagttcagtttaaagacggttactttaagagcattttaaaccctcgggctagaaatcggaccactgttaatcagccacattatttggtctaacgttttttcttttatcattctgaaactgggtttatctaatacattgataaattatttcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtcatatatttaagaaaaagctaaaaagaatggaaattgtatgacaataacttaagtctttctccaaagtgcatgcagtcttttgcgatacctcattcagccgagtatttgtgctcttcctcattcggtataaggcagctttcagtttgcttagaaggcaacattggaatgttagagttcatcagaaacacagaattttaaactgtgagttccactgaatacattttaatttctgtaggaagaatcaaaatacctatttaaagatggcaatatataataatcattttaaaagtatttgattaaacctgataattttccagaaatgaaaaaaaaaatcagctctaaaaccaaagctgattttagaaaatttgaaaatgtaaatcagccctatccataatatagtttctctaaaacttaattttaaagagtcgttttaaaataatataactattaaaatatgtaactgctatcttaatgttctgaaataatttaaaacattttaaaatatgaatactgtagtataaaagaaagaaacagtgggaacgaaaagcagagaaagaaatgccaattccagtccaaagttttatttgccaagttttcttagaatgaattttaccagtttatgaattattgtaaacagaatgtgtaatggaaatactgaaagatttttccctagagtggccttattgactgctggtgtgatgccactgtaatgtaataaattattaagttgtttgaatgtgttgtttttgccttaaaattttattttgcgtttcttgaaaactatagtattaaaggtattgatactgtgcaaatgctgggcatgcttggcatgagataatgtgtttcatttttacaaagttgtaatataactatgcaagtgtttattaaaaaccaaaataaaaaagttatgggtttattaaaaaacttttattaaagttttataaaaagttattttattaaataactttatttaaaaaagttatggggtgaaaaagttatgggataaaaatgtaaaaaagttgtggcaaaaaaacttctgggaaaaaagtagaaaaaagttttatgaaaagttacaaaaaaagttatgaaaaataagttatgggatttttttaaaaagtcatggaataaaaataaaaattaaaagcaggcccctgtcagcaaagcctggagaagtggggctggagtctccaccgccaccatgtccctaccacctcttcccaggcacccctttacaattagggtagcagcacaagacctctgtctaatggggaaagacaaacagaccatttgccaccttgagcagggctgagtccctaaatttctggatgatgatgatgattgttatttaagagccagaggctggtggagttggtttgtttggaggaggcctgatggtccccttactctcaccatggcaacgtttccctcaggggggctcccatcttcttattcagagaggtagctgaggccggaaagcggggctaactgtggaccagcgagggcatgggctgctggggtggcccaccttccccggtgtacatactgtgtctgtgtaacattttgtatattccagagggtagggctgcccctgtatcatacctagcagaggttggagctggcacatggggaggaggttctaataattatttgtggctgggaaacttatttattgctagcgtaggacagaggaaggaggcggggatggggtcgtggctctctggtggtatgatcacagcttactgcaacctccaactcttaggctcaagtgatcctcccacctcagcctcccaggtagctgggagtataagcatgcactactatgcctggctaatttttaaatttttttgtagagaaaaggtcttactatgttgccaatgctagtcttgaactcctggcctcaagcaattctcccatcttggcctcccaaagcactgggattacaggcacgagacattgctcctgtccattaggttttctctttattactgttttgttgttgtggttgttgttttgttttgttttgttttgttttttgacagagtcttggtctgttgcccaggctggagtgccgtggtgtgatctcggctcacggcaacctctgcctcctggttcaagcaattctcatgcctcagtctctcgagtgtctggggttacaggcatgagccactgcgcccctggctaatttttgaatttttagttgagacagagttttgccgtgttggccagattggtcttgaactcctgcctcaaacaatccgccctcctcagcctcccaaagtgctgggattacaggggtgagccactgctcctggctaagatcccatctctatttaaataaaaaaagaaaattcagagcatgtggaatacagaacaccaaagtccaaagttatttacctctctgaggtaatctgtgtaaacaatttgaaatatatcttttcaagttcatgcttgctatgcatatacatacatatacacacatacgttgacatagtcccccttccctgctgtcatgctattagagtcttcttttttttgtagaaattggaccaactctatgttctttgctggcccatatttctcctattcagtgatgtgttacaaatgtgtgtttaagtcaatgtatgcaactcttcaatatcattttaaaaggttaaatatacgatcatatgaaggcattagaatttattccaacagttccattttgcacatttaataatttccattggtttgccagggagaacattctcatgccatggctaaatccttttgtacggccatccttaactattccctgaagataaacttttaaataaagttgctagatgagtctcatttcttaaaaagttcttttttggtagtttatatgtaacactgtagttttatatgtacttgcaaatagctatagtgccagtaaaaaatgtgataaaattaaactcacgtatgccaaatatattttgatttagtgcttcattaagtgcatgattacagtctctatatcttttgatttacctttctacctttacaattttcagcccagatacttagaggtcacatagtaaattaaggttttctttttataataatctccatctttctaaatttggtgcgtcacagtaagttatttttcggttgttgaaagctgtggctctgttctaaatttgagcccagaaatcatgccacttacaaaatatgctttgtcttccaacatcagagtgtctggtagaaggtgactgttcttggaattttaaaaatctaaacaggacaagacaagaatatggaaaatatttctgtttctgataatatggctgagtaggtactctgcaaagcctctgtcataaaatagacattctggatagtccttgcaaagacatatttgatcttgccaaacaaaaaaaaaatatccagaatctctaagaatgaagatgaagtgaaaatcagaagggctactacgagaataatggggaagcagccccagttatcaagggatgtttgcatgtgttcaataaaaagtttcaaacctaaaaaaagttaagaaaaataatataactgccctacatacatacatcatcaacaatttttcattcatggcatggccagtttttgttttgtatttttttttaaaggtgggcttttgctgtggttgcccaggctggagtgcagtggcatgatcttgacttactgaaacttctgcctcccaggttcaagcaattctcctgcctcagcctcctgagtagctgggattacaggcacccgtcacaacatccggctaatttttgtatttttagtagagatagggtttcaccacgttggccaggctggtcttgaactcctgacatcaggtgatttgcccacctcggcctcccaaagtgctgggattacaggcgtgagccaccacacctggccacatcttgttttgttccatttgtattcccacttcatttatatacattccttcttcctctgaattattttgaagtaaaacctatatatcatatcatttttaaaattaccttatatgtatctgtagaagacaaggaatttttaaaaatatactcataacgccattaaatatcaaaaaattaatactttctgaaaatagccacaaatccagagttcacattttcttgactttctcataagtgattttttctaggttatctatttcaatcagatacctgtttgctcatatttacattcctaactgaacaatgtcggaagaggtacttaaacctgacataaaacacaaatgagcttatgaccaaatgcttagtgcaagaaaaaacttcacactgtaagatgagtccctccaaatacagaaaggaccagtattttaagaggtatgttaactaaaatgttgcagtgtatggagcagagcaggaagaacctttaagtctgaaaagtacaagtaaatttcatagtttccctggtccttccacaacaacctctggcatctgttttttctacaatggaggtaacagtagctctttcagagcaggaaaaggcttacagcagtgctagaagagggtggtggctatatacagtgtagctatttgtatattgtaacaaaccaacttttttttttttttttttttttttttttttttagtcaatagtagatttcttttggaaaaatagcagcctcctgtctggggacacctgcagttccactaagtgaacattggtgtctgctcacctttgcctctatttctctcaatatactgtcaagctgttccctgatttagcaattttatatactttctttttctttatttttttttcctttcccttttcctgagacacagtcccgctctgtcgcccagtctggactgcagcagcgccaacatggctcactgccaccttcaccccctggctgaagcaatcctcctacatcagccttcagagtagctgggactacccgccgggcccaccaggccaggctaatctttatggtttttgttttgtttttccattaagagacctggtgtcgggtcaggcgcagtgactcatgcctgcaatcccagcaccccagaaggcggagtccggcagatcacctgaggtgaggagcaggagaccagcccgagtaacatggagaaacccagtctctaccaaaaaaataaaaaaataaaaaactaacttggcatggtggctcacgcctgcaatcccagccactcaggaggctaaggcaggaggaccacccaaacccgggagatggaggccgcagggagccgagaccgtgccactgcactccagcctgggcaacaagagtgaaactctgcctcaaaaaaaaaaaaaaaaaaaagagaccggtttcaccacgttgcccaggccggtctggaactcctaggctcaagtgatcctcagtgctcggccgtccaaagtcccagctgggatcacaagcgtgagccaccaggccaggccaatctattcctttctgattaataaattgggccggtcacggtggctcacgcctggaatcgcaccaccccgggaggccgaggcgggtggataacctgaggtcgggagtttgagaccagcctgaccaatgtggagaatactcgtctatactaaaaaaaaaaaataaaaaaatacaaagttagcaggtatggtggttcacacctgcaatcccagccactcgggaggctgaggcaggagaaccacccaaacccaggaggcagaggcccagtgagctgagtccacgccactgcactccagcctgggcaacaagagcgaaactctacctcaaaaaaaaaaaaaaaaaaaaaaaaaaacaaaacccaaagcgaccgggtttcaccgtgttgcccaggctggtctggaactcctaggctcaagcgatccgccgctctcggccgtccaaattcctgggatcacaagcatgagccaccactccaggccaatctattcctttctaattaataaattgggccaggaacggtgactcaagcctgcaatcccagcacccagggaggccgaggcgggcggatcacctgaggtcgggagtctgagatcagcctgacaaacatgaagaaaccccgtctctaccaaaaaaaaaaaaaaaaaaaaaaaaaaaaaaaagccgggcataggggctcacacctgcaatcccagccacttgggaagctgaggcaggaaaaccaaccaaacctggaggcggaggccacaggcagccgaaaccacgccactgcactccagccagtcaacaagagcgaaattctgtctcaaaaaaaaaaaaaaaaaaaaaaagagaccaagtttcatcatgttgcccaggccagtctggaactcctagtctcaagtgatcccccacgctcagccatacaaagtcctgggatcaatcgtgagccaccacgccaggccgatcagttgctttatgattaataaattgggacttgcgcagtggctcacgcctgaaatcccagcacccctagaggccgaggcgggcagataacctgaggtcgggagtttgagaccagcctgaccaacatggagaaaccccatctccaccaaaaaaataaaaaaagagccgagcatgatggctcacgcctgcaatcccagccactagggaggctgtggcaggagaaccacccaaaccggggaggcagaggcccggcgaggtgagtccacaccactgcactccagcctgggcaacaagagcggaactccgcctcaaaaaaaaacaaaaacaaaaaacaaacaaaaaaagtgacccggtttcaccatgttgcccaggctggtctggaactcctaggctcaagggatccaacacgctcggctgtccaaattcttgggatcacaagcgtgagccaccacaccaggccgatctattcttttctgattaataaattgggctgggtgcggtggctcacacctgcaatcccagcaccccggtggctcatgcttacaatcctgtagcaggatttttaaggaattagagagactgatggggtttaggaggttattaattaattatttacgtgcattggcccagtcggattaacatttaaagcactgagttctgaacaagacttaccttttaagcattttatggggtgggggtagatctgtgcagggtgaagcatatgatagaagtgagaaacaaagataattgttcaattgaatcatgcattatattattttttccttttttaggaaaaatatgttttgtaacttgagtttgtttagtgaccttgcagttgtacagttagggaattagggtttttataatgcccgggaagggaggagagataaggctcactgccatagaaaagcaggaggtagtagttttttttgaaggactctagctcttctctttctcagggggaattgggtttttttacatacaactgagtttttgtttacacatttttaaatttcttttaattcctgttcccatcccagcaccctgagaggacgaggcaggcagataacctgaggtcgggagtttgagaccagccccacgaacatgaagccccatctccaccaaaaaaaataaataaataaattagccgggcatggtggctcagcctgcagtcccagccactcgggaggctgaggcaggaatattttctccctcccttagataaaagatagcatataccattgtgcactttgttttttgacctggggtggggtctcactctgtcactgaggctggagtacagtggtgtgatcttggctcaatgaaacctctgcctcctagactcaagctgtcttcccaccccagcctccagggtagctggaaccacaggtgtgtgccaccacacccggctattttttttgtatttttggtagtgactgggttttgccatgctgcccaggctgatatcgggctcaggcgatccacctgcctcagcctcccagagtgttttcaaagtgctgggaattacaggtgtgagccactgcatccggcccattttgcacctttttaaacttctcttagagatcacttcatatctgtttatagaaatgttcttcatcttttttaaaattagtactttgtagtgtggatgtaccacttttttattcagttaggttttttttgacatttgagtgttaggtctttttttctgacattacaagactaaaatatgaaaagaaaaactagaaaaaatttcaaagaaaatttacctgtctttgtgatcttgttgtagggaaactttttgtaatggttagtatccaggatatgaaaaatagcctaataatgaaaagaaaaacttaagacaaaatgggcataggatgtgaagagttactttatagaggaagaaactggaatggtcagtaaacatgggaaaagatacttgaactagaaactcatggataaattgaaagttaaaatgactattctgtcatcttcagattggcgaaaatgtaagtctgacagaattgctggcagagatatgggccagtggaaactcagctaggtaaagtggagcgcaattttataatctctaatgaagttgaagatgcacatacctgagcaaaaaaacacatgtgtacaaagaaatttggaaaacctgtttatcacagtagtatttgcagtaacataagatgatgcagaatgtaagttaaccaacaagagattggataaactcatatccatgtggtggaatattatacagcaattaaacatgaacatactagattgaaaagaattaacatgggtaaatctcatgaagaaaactttgggtgaaaaaggcaagctgcagaaggatatgggcaatataataacatatgtgagtagttcatttccatatttatgttgtttcaaaggagttatcggccaggcacgaaggctcacacctgtaatcctggcactttgggaggctgaggtgtatcgggcaaaattcacccccgatatttcacatagtttcttttctattttccctaagtgttggccggtctgagaaataaaggaacagagtacaaaagagaaattttaaagctgggtgtctcggggagacgtcacatgttggcaggttccgtgatgccccctgagccgtaaaaccagcaagtttttattagcaattttcaaaaggggagggagtgtacgaatagggtgtgggtcacagagatcacatgcttcacaaggtagtaagatatcacaaggcaaatggaggcagggcgagatcacaggaccacaggaccggggcgaaattaaaattgctaatcaagtttcagacacgcattgtcattgataacatcttatcgggaaacagggtttgagagcagacaactggtctgaccaaaatttattaggcaggaatttcctcgtcctaataagactgggagcgctatgggagaccggggcttatttcatccctctgctgtgactgtaaaagacagtcgtccccaaagcagccatttcagaggcctcccctcagggatacattctctttctcagggatgttccttgctgagaaaaagaactcaacgatatgtctcccatttgcttttcaaagaagagaaatatggctctgttccgcccggctcaccgacagtcagagtttaagattatctctcttgttccctgaacattgctgttatcctgttgttttttcaaggtgcccagatttcatattgttcaaacacacatgttctacaaacaatttgtgcagttaacgcaatcatcacagagtcctgaggtgacatacatcctcctcagcttatgaagatgacgggattaagagattaaagacaggcataggaaatcacaagggtattgattggggaagtgataagtgtccatgaaatcttcacaatttatgttcagagactgcagtaaagacaggcgtaagaaattataaaagtattaatttggggaactaataaatctccatgaaatcttcacaatttatgttcttctgccatggcttcagctggtccctccgtttggggtccctgacttcctgcaacagaggtgggtggatcacctgaggtcaggagtttgagaccagcctggccaacatggtgaaacctcattttggggtgtggtggtgcatgcctgtaatcccagctactcggtaggctgaggcaggataatcactcgaaccggggaggcggaggttgcagtgagcccagattgcaacactatactccagcctgggtgacagagcaagactccatcaccaaaaaaaaaaaaaaaaaaaaaaaaaaaaaaaaaatctcttagtttctgatggttttcctgaccatatatgtgatgccgaagttgcttttttgttgtcacatctattggcatcaagtgctgaacttttcatggagtggcaattttttggtaataaagcaactttcaaaatgagtctaagtttatctctggaaaagtttgaaagaatcagtgaaggttcttttagacagtacccatgttctacagatcagccattctctgtctctcaaattttcagtaaacctttccacataggatgtcagcacgattttaatacgttaaatatatgtaaaataaggcaaattaagacacaactccatcaactctcatctgctctgggcttatttctcttcatagtacataacaccatctacgtcatatacttattgtctgtttctattagagcagggtatttttgttagtgctgttagtgtgctcagcatatacagcaacacttggcagacagtaggtgctgaatgaaagaatgaagaagaacagaactcattttactaaagacattttgatatcacttttgggataggatactatacattaaagatgatacactgtttattccagaatggtcttagctacagtgttcacagcacagtatttgtagacttaatgctgttatccattctaccttcctttgaggttggcatgagagttgcccgtcagcgtatgtgtgctcttagaaatcagggacaatactatcattttaagcttcttggcagtgacgtgtacttaactagatggtgaactcataggtggatggggagtatctaatgcttttgtattctgcttttcagcaaataaatattaccgtactgtgtgtgtaacatgagctatgtaagtgtgtgatgattaaattagaagatagggttctctgcaatccagttttccaagataaatttttgccttgtttttgttaggtaataaaggtaccatattgactgttgatatatgcctacttagtcatgcttctcttgcagtaatcttatcaaattaccagctttttacttttttagagagacagtcctagaattgagaatcctcctttgcctacattcaaaatgagactatattatgtgggtaggaaatttctggtgacctacttttaatttttaaatttaaaaaaatattagcatagttttatatttagaaaacagttgcaaaggtggtatagagagtttctgtgtaccacacaggcacccagtttcccttgttgctaacatcttacatgattatggtatatttgtcacaactaacaaatcagtattgatatattataactaaactgcatacttttaggggtagtgacccagttttaaagcttatttcccacaatttgttaaaaatgacaatcagtattgagtgcccatgggtggtggcttcctgattcttcaaagaaactgagtaattttgtaaccattgggacttatcaggaaataaggaactcataataatgtgcgcttaaatttccagtggaggaattgtacagcttaacatacggttttgtaagttgggtattaatacataaagaggctgggtggggtttgatcactattaaaactgatttgttttgttccctggaaaatatgttactaccacatggtctacccttcatagataatcgaacctaagatcactgggcagaaaagggttgccctgtagtaggaaatgtgtcctcctgggactgagttgagatttagtttagcacacagaataagtagccaatggctgctatgagtctgacttctataattcaaattggtataaattaaatctaattcttttccccaggactgcccaatttaagattaagttttatactggcgcttattagagatatggccattttgccatttcagtggaaccttttaatcagctttaatgctgtcttaggtaaagtaaaaacttaatctaagggcttttctagtttgccatcctcaaagcagaaaaagcagcaatgaagcagcactgcctcatatagactctgcttttattaaatttgcttcaataatcctcttccagtcatcttttgtgctgcatatttgaaccataaaataagcaaaaactgtacccaaatgaaaatttcaagttattttaatgaagctctggaaacatcccagagctcagaagatgttttttcctagtttattttttaaattctggaaagtaggtcagtagacataccctgctttaattggtttaattagaagtgaaaaattataggactaactcaatttgaagtatagatttcaataagaagaattatactgggatgaatattatttaaggttttgaatttaagatgcatttaatcaatgcttataatttcctcttgaaaagatttatattgcaaaaaagaagactaagtgttggaatatgtcaatatatagggaaaaactttgccatgaaatataatatttgataaaatcattttagaattgtatctctaaatggtatgcctaagaatattgttctataggaccttaatagatatgcctcgggggaaaaaagtattgtgtgctcaagtgagtttgagatatactgcattaaatataagaagttgcctgcaggacttctcagagtctttaacactttctgaatttctgagacaagatatatagagggtacagtactttgcaaacctatttatccctataccacctagtaacatttttcaggaaaatgttttgagaacacgaatttgacctgttttaggaatttatacctttgacaatgttgaggaccttgttttttcctattataatgatgatgtgatattcacatatattactttttcccaattctttaagatatttttccaatgtattatattcaaccctctgctcagtgccttccttctgctaactaaagtgatggtttccgtctgttgctacacatcagacatacttggccctgaccctggagattctgtatgaacagaaatgccagaatacctgctcaggattctgtatttattacaaacacccaggtgattctgatgcagccaacactggtcctccaactgatgctttggaattgttgaactaaaagcatgcctttttttctagatggatgagtagattggggcatagtttgtggtcctagaacacatgggttaaccatccctcctagtgagaatgatagcacaggcctctgatgaccccacgaggtgctgtgctggctataacctaacatgaaacgatcattattccttaagaaaagcagaatatgtctaaatgggcttttagccaccttcctaataatgaagtaccatatatatgactaccatttgttttaatttcaagtaattcccttgtagatgatgttttatttattcttttttttttttttttttgagacagagtctcgctctttcgcccaggctggagtgcagtggcgcgatctcggctcactgcaagctccacctcccgggttcatgccgttctcctgcctcagcctcctgagtagctgggactacaggtgcccgccaccgcgcccagctaattttttgtatttttagtagagacggggtttcaccgtgttagccaggatggtctcgatctcctgacctcgtgatccgcccgccttggcctcccaaagtgctgggattacaggtgtgagccaccgtgcccggcctattctttaaaaagaatattagattatattttctaaatgtgccaagtatctaagaatatattctttcacctcctgctgataagagttatacatttaaccttaagcaaatctgccaagattctatgtcatttatgctttgatttatgtgagtattaatgtagtttctgtgactattatatggttatatataccctccacctagtaaaacagttccatattcctggaaatggtcttttacatcctacaagtgtagctggaaaggaataatataaatactaatggtttgagagacaactagtcttgacatgtcttggttgaatagtgttctataagcaacaatatatgaaatactagacatacccattaaaagcagaaaatacccactactgttttaaaattattctgcaagatctcatcaatgcaatgagacataaaacagaaataatgggtgtaattattgaaaattggagataaaatttttattacttgtaaacaaaattctgtcaaaaacctgacaaattaaacaatacaattaatatgtttaatagaactaattacatatgagaggcatccaaaatccattttttctatacaaacatggtttgatatacagtcattttatctgtgtattaattggtttatgaaataacaaatagaaaaatcaagtatgcattatcaagttaaagaagcaggagagatggagctataaaaacaaagagagaagaatgttgtaaggagggcttaacaaccaggataaatgttgtagaaagatcaattaaagtgatggcctagagatcacgggcttcctttggcagagccatgttggtgaagtgaaggaagtggaagccagaccacaatggttgaagaatgaatgtaatgtaagagccaagacatttatttgagtctgatagtaatgaaaaaggacaagaattttcttcttgctgttgtttttgtcatttcatgttcaaaaccctttatctcccatgtggtactgaaaactccaagatgggatctctgtttctgtgaggcctgtagtgcttagtacatccttgaatgtgtgaggctctcattggtataagtttaattcctgactgtggatgaaagctttaaaactttgcgggcaaaatacagaatgaatttcagtgagttcccatgtattaaacaaggtggcgctggctggagacatgctgtccctgtgcccacaggagtagcagtgctgtgctcatcttcctgacccgctcttcacagtcttcaccgcctttcttcaggagtctcccctttggcttttccacagctatgaaacccacgtagtcggacaccctaatgcttctcctgtagggtgtgtgatgaggaggtgagcttggctttggagtgctgggaacctgaggaattgccaaggacccagagcccagccctgaccacccagagagcccaaaacacaatgaacaaattgaatttccacaacaacagagtcatgcaagaccgccgcagcgtgtgccttttccttcccaatgagaatctctgaacatcatcataaatgtgagtagatctcaatataattctgatagctggaggatagtgtattttcaggtttgctggagggaaaaaactggactttaaataattaagacaaaatgattgtattaattgacttctattcttaatcactaatttcattttttatatttcccttgacttttgggggagaaatagtctttgtctcaaaagtgggcttcagtgacctatgggtttgataaagcaaccagagataatgagacaagaatatttaatggcaacatgccagcaattattattagttaattgaaagcgtttatgattttggcctggggccaatgctttccccctctgctggactaacatgtgggtaaaggagaggaaaagctttgtttcactttttaaataaaagtattacgtaactttgaaatttgtataaaattaaaagatagtaaaaacaactattctaacagaattcaaaacctgttatgcttcagtggagagattattcaagataagtccgtgggaaattgggagtacatttctactggcaaagttagtgataactatgcacttctgacaaaatgtgaaatggggggtatgggcgtgtcatatcatcatggtgcagatacgtggatgtgtgcttccaaacaatggcaacctaactgactgctggaaccatacaaaatacctgaaactactcagaaagaaggtgaaaattgcatgcaaaaattatttgaaaaatattgagctaacacaacatgaatttggaattataagtgaggtattgtaactcacctacagatgtgttttttgtaatcaatattcatggactcagactacacagtaaaagcttacatagaaatcattctatctaaactttctggatacgaaagtaacctagtatgcgttttgctactatatctttatatgaatttaaatcacatttccaagtggcttacagtaatcaaggttgtcacaaggaagatgcaaattaaaaccacattgcaatatcactgcacacccactagtacggtttaaaagaaaaaaaaaacagaaaatatcaagtattggtgacaatgtggagcaaacagaactctttttcaataatggcaggtatgtaaagtggcacaaacactttggaaacctgtttggcattatactgtactaaacctgaacacacgcattgtttatgacccaggaatgcccctcctgggaaccaacaacaacgcatatatgtgttgcatatgttcaccaaaagacatttacaagaatgttcatagcagcactatttgaaatcacccccaagtagaaaatgcacaaatatttaacagtagttggataaagtgtggtacgtttatgcaatataataccatatagaaatgagagtgagggatctgcaaactaatatgcaactgtacaaatgaatcccacaaatataatgttgggtggcagaagccagatgcaaatgaatacatgctgtagatttcattcttttacattaaaaaagctagtcacacaaagttatgctgttagaagagagtgatttggtcgggcgcaggggtagttacaggaagggagtacacggagatttctggttgttagttatgttcagtgtcaatctatgtgctaaacaggtacaataaagattttagaattcatcaatttgcacacttatgatagatgcactttcctgtatgtatatttcaataaaatcttttaaaaagtaaaatgacaaaaagacactattaacaaaaatgacatattatattaactgttatactaaggaaaatataaaaatgagttctataacaggggctctgcaggtcatgtggtcatgccaaggaccatatgtgctcaagattctcatgacattttggaaggaggttgggctttctttatctttcctttcttctctcccttcccttcccttcccttcccttccctatttttaaacctaggtttggtattttcctggggtgatggtgactttggaaaattgggccggggcggaagtgaaggctgcaacattccccagaacattgagagactaaatggacagggggtgtgccagattgagtgtggagctcagttcctactggcgctcaccaagtctggagtggtgtggacatggtacgtaaacgtcctccccgtcacagtgtgcgtgcttgtgccgacgcgtgcagggaacttgggcctcgccccaggaccaccccggcgtgattgtgacctgtcatatttttacttatgcatgcatctttgtcctttaaaggatattgagtcgggattagtgacaatagtacaagaagaaatttcctattgtaactgggtcattttgaaaatactagaaaaattttaggccacttacctttcctgtttgggcgagatttataggaagtgtttcttctgctgaagcctaaggataaaatgagagcaaaatagccttctgaatcctttgatcctgagaaagttaacatgtatttcttgtaaaagcttattatattaatgtgcaaatgagcaggtgcccagactggccttggatgctgtgtcaggccttgctgcctctggtcataacattggcactatttatttatttatttatttatttatttgagatggagtctcgctctgtcgcccaggctggaatgcagtggcacaatctcagctcactgcaagctccgtctcccgggttcacgccattctcctgcctcagcctcccgagtagctgggactacaggcgtctgccaccatgcccggctaatttttttgtgtttttagtagagatagggtttcaccatgttagccaggatggtctcgatctcctgaccttgtgatccacccgcctcggcctcccaaagtgctgggattacaggcgtgaaccactgctactggccgacattggcactctgagaaagatgtataccagataggactttggataggtgtttgcagtaatgtgtcttattttcagtctatatgaaaacctacaacagtaacttaaatattgtagaacatgtattaaggtattaaggtttttcccagctgacttaataagttaatttgaattaatggtgtatgattttgaatacaagttcgaagaccttgggtgctgtgtgtgatgtcattgagctggctgtgaaagatgtgagacaatgagtgtcttcttgtatagcattgtcagaccacaactatattgtaacactccaccacgggcctccttctcaggggaaagggggattacttcaggttgcgccagggctctgacgtgcacgtgtggaaactgtaggtggtggaagggctgagagggaagaagatcgtgcatgtggctgtcggggccctgcactgcctggcggtcacggactcggggcaggtaaggctgcaggtggcctgggggtggcgtgccatcctgacttgggggacgtgggggtcacgacatggccctcgtcctgttgaaatcacagctgttgatgaactcagccgagtcttactgcttgaagaaccatgaggccgggacccatccgttttgcccgctggtgtatctgcctactcagcagcaggggttgggggcggggtcctcagaaaagaggcgttcccactctgaagtccacgtgaaaagtgtgtggaaagattgttatcctttttttttttttttttttttgagacagagtctcgctctgtcgcccaggctggagtgcagtggcgcgatctcggctcactgcaagttctgcctcctgggttcatgccattctcctgcctcagcctcccgagtagctgggactacaggcgcccgccaccacgcccagctaattttttgtatttttagtagagacggggtttcaccgtggtctcgatctcctgacctcgtgatccacctgcctcggcctcccaaagtgctgggattacaggcgtgagccaccgcacccggccaaaagattgttattcttgaagatgctcctactgcaaggtattaacaagactttgctttaggaaattgctaactggtgaggaggcacccatgcctcattttagagacagagctagtgcctgacaagtgttacactctcttctgcttggagaagcatatgctatgaccggcttgtagatattcaatttaaaattttatttatgaaaacaaaattaccattactgttttttagtcaaaatgaattatactttataattctataaggccaaggagctacttacttgaaaaatgagcatattgtttttggtcatttttctttgcaaagtaaaagggaaaaaattattgcacttagttgaagagaggaccttctgtgtgacttgcaacaaagcagaattaatttgattaatattaagaaaatactccttttatggttattggcattttcatggttagattttcttcagaattatagtacaccgatgccattttgtaagattgtgaaatggtttgcttttacttttaagaactcaattctttcaaataccatggcatacacgttaagcattttgaagtaaaaattacattaaagaaaatgtcctgaaatgttgaaaaattataagcttttttctcctcgtaaacaggtgtatgcttggggtgacaacgaccacggccagcagggcaatggcacgaccacggttaacaggaagcccacactcgtgcaaggcttagaaggccagaagatcatgtgtgtggcttgcgggtcatcccacagtgtggcgtggacaactgtggatgtggccatgccctctgtccacgagcccgtcctcttccagactgcaagagaccctttaggtgcttcctatttaggtaacacagatttgtatcctgagatttttctgtaggttacagcaactttacatttatttaattgtgccaacacattagaggttgtagtgctgcgttaactacattatgaatctaaagacacagaagaattatggtgtgcgctcatgtgatttatacatgctggaatgaaagttttagaagaaagtatgttgctgattcttgtgtttatgatcaggtaaattcacagcgctgtacttgtgtgtaaacaggactcctaataactgcctgagagatacaggcactgtactgggctcttttgtattttttaacagctttattcagttataattgacatataataaactgcacctatttaaagtatgcattttgatcgactttggaatatgtatgatccatgaaagcatcagcacaatcaaagataatgaactcatacactaccccagcgtttctctctggccctctgtacccctcccttttgcttttaactccctccttcctgccgtatgcaccaatttaatttctgtcactagagatcagtttgcatgtctgctttttgttgttgttgttttgtgggtgttttatttgtttgttttcttttttttgtagacagggtctcactctgttgcccaggctggagtgcagtggcacgatcttggctcactgcagcttccacctcctgggctcaagtgatcctcccacctcagcctcccaaagtgctgggattatgggcaggagccactgtggcaggccagtttgcatgttttacagcttactataagtagaatcatacagcatatactctttttaaaaatcttactttttccactcagcataataattttgagattcacttacgttgcatgtatcaatagtttattcttttaaattgttgaatagtatcttaagataaacaaatgcaatttgttcatccatttttctgttgatgaatgtttgggctgtttccagtttttgactatgcaagtgaaattgctaatggacatttccatacaagtttgtgtatggacatccacttgaaattctcttgggtaaacttctaagagaggagtggttggatcatatggtacgtgtatgtctagcttcttaagatcgctacatactgttttgcaaagtggatgttccagaggtccacatcctccacatttttgtcaacccttgatacattcagtctttaattttagttatactgacagatgtatagtggtatctcgttgtggttttaatctgcatttccctaataactaatgatctcaagcatcttgcttatttacaaatcacataccttttttggtgaatgtctgttcaagtcttttcccatatttaaataggttgttttcttactggtttgagagttccttatatattctgagttacaagtcctttgcctaatatagaatttgctagtattttctgtcagtgtggcttgtcattttattctcttcacaggtgaatcttaaagattagaagtttttaattttgatgaagcctagtttattcattttattcttttgtagagtgtacttttgatgttgtgactacaaaacctttgcctcaagattatgaagtttgtctttctatgttctgttatagaagttttatagttttagacaggtatatctatgaccagttgattaaattttatatatagtgggaggttcagattgaaaggcttttttgggcatgattgtccagttgtttcagttgtatttgttgaaaaactacgcttttcctactgaattgccttttgcctttgtcagaaatcagttgtctatggatgtatggatctatttctggactcccagtactgtttcattgatttatttgtgtattttggtggcaatgccacattgtcttgattactacagctttataaaaggcctgaactcaggttgcaacagttttttagctttgttctttttcaaatatattttggctgttgcaggccctttacatttccatatgacttaaaatgagcttgtcagtttttataaaaccgcttgcttgggattttgatgtggattgcattaattctgtaagtcaatgtgcaaggatggattcacagtattcagtcttctaacccatgaacatagtgtttctctttatttgttaggtgtccagtacataatgacacatgaagaggcaaaaaaagcgactaaaaatgaccagaaatgataggagagaaacagacccacaagggctccatatattggagttagaagacacagactttagtataataaatatgcttactgtgttcaaaaagataatatttcagcagagaaccaaaaactactgaaaataaaatagaaagactagaactgataaatccaatatttaaaattaagaacttaatgagtaagtttagaacacactgaactcagctgaagagaaagtaaaaatatctggaatgaagaactgaggagcaaaagtttagaaaacataacaagaaggtaaaagatctgcaggacagaggttaggcctaacacaagtgaaagaagagtccccccaaaaagatagaaaagagaatagagcagaggcaaaatgtgaagaaatactgaaagacagaattttccaaaacagacaacagatatcatgccccagaagccctaccaaccccaagaaagataaacatctccatgcacatgtaaaacctgtgccagatgaaaacaaaaagactctctgaaaagcagacgaaggaaaaataaaatgaaccacaattagacttccatccaacttcaggagaaataatataaaccaaattgcaatggaatactatttttaaagtgctgaaagaaaacacctagcaaaaagacttttcaaaaataaaggagaaataaagacattttcagacatacaaaaatagataatttgtaaccaacaaagacacatttttaaaaatattaaggggattttcaggcaggagaaaaacagtatagatggaaaattaaagaagaagaaaaaagtggagagaaattacaaagtatgcagaaaaatctaaatcaatattgactacataaaatcgtcatatgccctgcatgtattgtttgatcctttgacttgtttttttgctttttttgttttttgagacgtagtcttgttctgtcgcccaggctggagtgcagtggcacgatctcggctcactgcaagctccgcctcctgggttcacgccattctcccgcctcagcctcccaagtagttgggactacaggtgcccgccaacacaccggctaattttttgtacttttagtagagacagggtttcaccgcgttagccaggatggtctcgatctcctgaactcctgattcacccgcctcggcctcccaaagtgctgggattacaggcatggatcatgaggtcaggagatcgagaccatcttggctaacacggtgaagccccatctctattaaaaatacgaaaaattagcttggcatggtggcatgcgtctgtagtcccagctactcgggaggctgaggcgggaggaatggcgagaacccaggaggcggagcttgcagtgagctgagatcacgcgccactgcactccagcctgggtgacagagcgagactctgtctcaaaaaacaaaaacaaaaacaaaaacaaaaacaggcatgagtcactgcgcctggctgatcctttgactttttttgaaattttgtttgagcatatgacccacttagcatatgactggattttatgaacattttctatgtgcataaaagaatgtcttcgatagttctgttagatatatatttgtataaaatgtataaaattttggctggacgtggtggctcatgcacataaccccagcactttgggagactgaggtgggtggatcgcctgaggtcaggagttcaagagcagcctggccagcatggtgaaatctcacctccactaaaaatacaaaaattagccaggcgtggtggcaggagcctataatcccagctactcaggaggctgatgcaggagaatcgcttgagcccgggaggtgtcagttgcagtgagccaggatcgcgccactgcactccagccagggcgacagagtgagactccgtctcaaaaaaaaaaaaaattaaaaattaaaatatgttaagaacatataaatcagaatgaagataaatgatgttaaagagaactaaggtctttgcattgtttaggaggagactttactaaataataatagatttaaatcagtcaaaaatagatgttataattaatatcttcagtaactactaaaactaaaaatgtatataacacatacactccttatagacagagtgagactctgtctcaaaaaaataataattaaaaaaaaaaagtagaaaagttagctgagcatggtggcaccggcctgtaatcccagctgctcagcaggctgagacaggagaactgcttgaacccaggaggtggaggttgcagtgagccaagattgtgccactgcactccagcctgggcaacagagtgagactctatctcacaaagaagaaaagtgatatatgcatacagtggaatattattcagccattaaaaaggatgacgttctgacacatgctacaatacggatgaagcttgaagacattatgctaaacacaaaaggataaatcttacatggttccatctagatgagatgtctggagtggtcatattcgtagagaccaaagttagattcaaggttaccagggttggggtaaggggaagtagggcagttaaattgcttaatgggtacagagtttctgatcggagtggtgaaaagttttggtaagagaaagttgtgatggttgtgcaacactgtacttaaggtacttaataccctgaattataaacttagaaaatgactaagtggctaattttaagttaaatatattttgccacaatgaaaaatataataaaaggtatacaaattaaaacactcactctccatctaaccaattccacatgccacgcaactaaacacttactagtttcttgagattcttttaatgtttctttatggaaaaacaagcaaacaagcctagttattctaattcttccccgataccccatcctgatttttttaaaaagccagccagtcatcagcgggtaggaccgtcacttccgtctcactgtactcactctacagaattaccatatgcaaaggaaccttaaaataacaaattccagtacactgtggtccacaataagtatttcattaatatttggtggaagagagaatataaacattctgccatacctggttcatttattctgccaaatgtatgcctggtattgtgttttttggtcttgaaacacgtttcacaaaaatcaaagtcatcacagtttctgcatttgaatctggatccattgataggaaacatctgacatccatcacacctatttgtaaaatagcaactgagttaagaaaggtcatttattaaacttaattcaacagaaaaccattcgtcccaaagcaaatctagcaatcataaaaataactcacgtaaccccaggatgaatactgggcaccaactccatttctgatagcaacccagtccagtgagactgctggggaaagtcaacaatgatatcttttccattggcactgaaagccaggacacaacagaaatcacctgatccatcttcctcttcaccaataaaaacctgaacttaaaactgcacctagccatgtcatactacattgtagttatttgttttttacaaagagtctatcttttagagataggtactaaaatgcttatggatgaactaatatatgatgtcagcgcctggtttcaaaataatcacaagaagggagcatgaataattttggccatgaggcgacaatcgttaaagccaggtaatgagcacatggaggttcattgtaaactacattccttacttttgcattaggtttaaaataggacattttggtttctaattacaccaagtcaacaattccatacaatacctttggtatctcagggaataaaaaccacattaataacatgaagacttctttcatcctttgataagagcaacgtgtcactcaaaacaaagaaaccaaattcttatttttaaaatttgtcttgttttgatttgcaaatattttaacaatctcttaagcaaagaaaaatgtttaaagtaaaatattaaataatccacttgttcttatgtaacatgagaagctctaggaacctctcaccactggggaaccaccaactgtggccattttctaagcgatctgatgaaaagagaggcttccacaaggttcaaacgaacaaacaaataatctctttatgcatcaagagtttataaaactatacacatacttatttctcatgcaactgttaaaacggacatagtgtgcctttcaaagtgtgccacggatttgatttggaatctcaacagtatcatattaaatataatctgagaattgtttccagttcctaatttccatcattagcacatttccatttcttaaattcagtcctaaatttttatacagcatgaaaaagagccaggcatggtggctcatgcctgtaatcccaacactttgggaggccgaggtgggcggatcaataggtaaggagttcgagaccagcctggccaacatggggaaacgccatctctatgaaaaatacaaaaattagccaggcacggtggtgggcacctgtaatcccagctactctggaggctgagactggagaactgcttaaacccgggggcggaggttgcagtgagccaagatggcgccactgcactccagcctggtcaggggaggagaaagaaaaagcagtcctgacagtcaggagctggcctgttaatgtcaatgttaggccatttcacagaacaaatgacaggacaagtttacagaacacgaacatcagataaggccactctgtgactgatgaatcaaggcacaaccaaaacccctccttaaccatgtgtgattaaagttgagtctaatccaaaccacaaacaaccacacagtcccctatcctggtgatatgaatgactgcttccttaccaatcatgacgttagcatggctccattctttctgcctgctaggtaaatttattaagacatcctgttttaggattacccctgctttctcgacccctcccccaaatacccaacataaacttcattagtcctcgctcactccctctgatggagacacccattccccaaggtgtgtgttctcctgtaccgcaatgagttaatattaataaatctgattgtttcactgtaggtgagttcctttgtggcctttggcagaaggcactgacaagcaaaggaacactctatctctttcttcacacttgttttctgttttgtgtgcttgaacaaaaagaaatactaagtacatatgcattaatgaaaagttaacatcaggaatttaattacccagatgatattacctttcacaacccccacactctgatgagtcacagatccccatttgtattttggtgtggtgacagaggctttgacccgcactttatcaccaatcttgatgtgagaagaacttcttggtggaggatagcctacagatttcaataacaaatcattataatcagtattcatttatgggaattctgtctctaagaaaaagtaaaagcactaaacaaagaatgtgctcacctataagttccacatgaatgtacctaaaccagtagatgccccctttctgctgccagtcacactgcacattgagatcatgcaatccatctctgtccagcttgatgactttgccaacatcacatcaccttcgcacacttcttcgtatgttcggcagcatctaaccatcattcccacctagaattaaaatgaaattggagatccagtccatcatgtacacaggtgaaatgagccatgataagtagtattactctactcttaataaagaatttcaactgggcacggtggctcacatctgtaatcctagcactttgggaggctgaggtgggaggatcacttgagctcaggtgtttgagacaaacctgggcaacatggcgaaacccacctctaccaaaaatacaaaaattagccagatgtgatggcacatgcctgtggtcccagctacttgggagacttgagttgagaggattgcttgagcctggaaggtggaggttacaatgagccaagatcatactactgcactccagcctgagtgacaaagtgagaccctatctcaaaaaaaaaaaaaaaaaaaaaagaatttcatctagcacccagagtgcattctaagtattatttaatgataaagggaagagaaactctttagaacactgtctggctttgtgtctcaggcaggaaatatacaggaagaggctggatcaacttgtatcataaaggaagggagttttcaaagattactcaaaaggattccctgatcatcaaaaatataacagtggagacatcacaccctaaaagccaatggattggtcatcatgacaataaggaaaacgaagcttcctggtcatctttatacatatcagaacaccaatgcatcattgtgaaaactgatgaagtctccctgtattatcaagagcaaccaagattaataacaaagctttttttcacagaagagaattccagctaatgaactcagagaagatgaagttagaaaatcactatggtgcagcccctaatgataggtctaggtgatgacactaatgcctgctggagctatgagatggacaattaatacagaatgtcatcaaggaaggagcaggctgacaagacctaacccacccaaacctgcttgcctgttgagatggggccggagggagtacatgcctatgaagcttcctgcctgagattcagcctggtccaatcaccctccaaccctaactcctactgcattggagaaacagggagagaggaagatgttagccacaaggaagccacctccaaatgcagactgtaagacatttggaggacatggtttcagccacaaataaatagcatgaaaggagaggaagggagaaggagggttactatgaaatgaatgtttgtatcccccccgcaaaattcatgaagtcccgactcctaatgtggcagtattaggagatggggcctctaaggaagtcattaaggtaaaatcaggtcataagagtggggctctgacacaacaggattagggtctttataagaagagactccaggatgggcatggtggctcacgcctataatcccagcactttgggaggccaaggcaggtggatcacctgaggtcaagagttcgagaccagcctgaccaacatgaataaaccctgtctctactaaaaatataaaattaaccaggcatgtggtgcatgtctgtaatcccagatacttgggaggctgagacaggagaatcgcttgaacccgggaggcagaggttgtggtgagccaagatcgtgccactgcgttccagcctaggcaacaagagtgaaacaccgtctcaaaaaaaaaaaaaaaaaaaaaaagacaccagtgctcccctgctagctccagctccccccatccccagccccacgtccacaggaggacacagcaagaaggcagccacctggccgggcacggtggctcatgcctataattccaacactttgggaggccaaggcgggtagatcacgaggttaggagatcgagaccatcctggctaacatggtgaaaccccgtctctactaaaaatacaaaaaaattagctgagcatggtggcgggcacctgtagtcccagctactcaggaggctgaggcaggagaatggcaggaacccgggaggcggagcttgtagtgagctgagatcacgccactgcactccagcctgggtgacagagcgagactctgtttcaaaaaaaaaaaaaaaaaaaaaaaaggtagccacctacaagccaggaagagggccatcaccagaatccagccaagctggtaccttgatcttggatttccagcctccagaaccatgagaaataaatgtctgttgttgaagctgccagtctatggtactgtgttatagccaactgagctaagacaagggggaaccactctagcttggaatagacttcaaagatccatcaaccaaatgcagataaggcatacaatcttggtttatccaagttcaaaaactaaccattaaagccatttctgagaaaactggaaaactacaagcaagcgttagatatgagatgatattaaggaattattatttattttgttaggtaatgctggtaaacagaaatgtcattatgttaagattctttattagtgatactcactgacatatatacaggtgaaatgagatgatttgggggattttctctaaaatatactaaaacaagagaattaggacaagaaatgatttaaagtagataaaggactatataaaacataattagatttttaaagtttgatggcaatgagaattacataagaaaaacaaggaaaggtatgtaggaagtgtcacaagtggggctagtagaaaacagccatccctgcgccatgtccaccgtggacaggccacttgtgctctccggctgcccctgagcccatctgcccctctgtcctctggctacaccggggcagccacagcagcctctgtctgggtgcccatcctgctcagccacccttcacaccctgtaggctttgcacccatctcaccttctcattgcagatcccgatccctggactgtgccctcactcccacccctttactgtagtctgctctctctcattccagggtacacagcaccttctagcgtaccatgagctcactggtcaggtatgtcttccagcaccagaaggcaggctccctgagggcaggggcctctgtccactgatgtttggcatataggacatacccaaatatttgctgagtgaaaaacggatcgaggctccagcttaagacaattactcacctgaatattctctctcacatatacagcataatcatcattacccaagaaaccagctcggtttttgtacgtctggctctccgtcacaacagcaccagtagactacaagaaataaatacattcaaagaaaaaaaaaaaggagaactcaataaatctactcaaaaagaaatgtctgtgaaatctataatattaaaaagtaaaggatgaaatcctttattttctctataaaaatcttcatttaaaaaagactaatagcagtagcatagtaggcagaaatgaatctcaaaagctacaagtatacaaaatttccaaggcacttccaaattaatcctatgaacaatttactcaggtcagaaactgatgtgtcaaaacatggtattttaataaaatatcctctaatggctaccgaagatcatgagatgtttgaacaagggtctgttctgaagctaaaagtaattatgatatagaaacccaatcatcccttcagtagtgaaacacagctttgttctgtgcccggcaacaccataggttggttttatgaaacagtccacagtagatatagttaattctttcaagggacagagaaagccaaggtgtaagactgttagagcgctagacggacagcggcccaggtgcgggcggtcacatgggaggcactgaccatggagtaggcggcatcatccatgtcctccaccacctcctcgtcagaatactcgtcggacaccgtgtctgcatctgagagctccgtgacctgtatgtcggagtggtccagcagccacccgaccaaggcttccacacctaagagaggcacacacagcacaccagccactgtgagtcaacagccctgaagcgggaacccacacacgtacaagcagaggccaggaaaacgaagtaccaggcaagccggacgcattcccggaagcaccagtgagagacttcagggcaaactcgatgttccttctgggaaatcccatctccatgagctgcaccacgatcggcagagcgggaacgggtgactgcttgcgcctcttcactctggcagggcggatgtgctgcacgttgacaggcgtggtggcctcactggagctgcagtcttcaaatcctgggctcgaagggtgagtggactccacaacggccagtgcagcagtctgggcagacaagagggtcctgggaggtttgggaagtgccctcggctagcttacacagtctaggaacatggggcatcatgcaagtctagaaagcccacattcacatgtgcgtttttcaatgagttcctaaaacatgttagaaaatgacaaagccaagtttcgcagtttaatgcagagaaaatacttggtggtaaaataacttgcctgtttcagcagacagagagcctactaaattagccaagtatcaatgtccattaaggaaaacttcattacagccctaagcgagcagtcacaggggcttgagggagcagggagaaaggcatttcccctgccttaaccaggcactgtggtggcggccacaggcacctgtgttttagacaggccagaaatgacacaggactctcatgtaccattaaaacaaccctcaactattcaagggttaaataaccacagtgaggttaaacaaggtattaaaaagtaagagaaataaaagagtattagttgggaaacacactgcaatgaatcagtgaacatctaaactgccagtctctacagctgggaactccccacctacagcacaaatagcacttccctgatctgtctgcaactccctggtcctcctccccagctgctctcatagcactgacttgctattttgttaaacggagcatgtgaggaaggaatcaggaagaaaccgaggacactgtggagccccccggtgctcaggaagtatcaaagcctagggttttgcagcgaagtctgggtaacttggaagtgacaggtttcatcctaaaagtttaaaattcagagccagattgagccaagagttctggttctgataatggggagttagggtgcattggactaacccttggctgataataatcatgaactctggataaaatattttttaaaactgcttgagggcactggagaacagctgacgcaatcagcaataaaacaagcacaacccctgaccccgagaagcctgcaggtaagacgcgcatttaaccacagacggcgcaccttcctgcactgcaggggctggggtcccggcctgccagagcaaccagaatgtgagggaaagcccgcctgagaaagaaaccacagagggaaaaccacgaaatatgcggacggactacccgcaaatctacagctgaatctaaactgaagcaccactgaagagcctgcgctcggcacaaagggaccgctggaaggctgcaggggctccccagctgcccagggccaggacagcatctgaggctcaagctcaaccaactagaggtggggaggagaatgtcaaggcttccagtgacgcccagaagagattctaaatccttgagaattaaggatccacaaccagggctaagggcaaataaaaaatcattagaaagcctggcaccaagccacctcaggatcaaggaggactgccaggtactgaactgcctgtgagaagaaaactccccattctccagaggaggcagaacccagagccaatacaatgtaacgtccaaagaatccagaatgaaataaaaattctcatatgtgaaggacaacaaccaataactgactataatcaagggaaaaaaactgcaaagagcagcagaccaacaggtgggcagatgttagaattagcaaacaagaaattcaacataactatcagaaatatgttttaaaatgtacagcaaaagatagatttggccaggcacggtggctcacacctgtaatcccagcactttgggaggctgaggcgggcagatcatgaggtcaggagttcgagaccagcctggccaacatggtaaaaccccatctctactaaatatacaaaaattagccaggcatggtggcaggcacctgtagtcctagctactcgggaggctgaggcaggagaatcacctgaacccaggagtcagaggttgcagtgagctgagatcacgccactgcactccagcctggtgacagagcaagactccatcaaaaaaaaaaaaaaaaaaaaaaaagatagacttaaaggatgaagaaaggaactgtcagaagagatataaaactattaaatgagagccaaatggaaataagagatgtgagaaatataaaataaagtatgtcttggatggatataacaacagattaggcccaacaaagcaaagcatcttgacctttcaaacagatcaagacaaactaaccaagctactaacaaggagaagaaagactttctattaaagtcataaaaggaaactcactaaccgtgtaacagatgtataatagtatttccagaaaagaacaaaaagagcaagacggggaaaaaaacagcagtcaaaagtttccaaatttggtaggggaacaaaaatcaagccaaagatgcaagcagcttaaataaatttcaaggaggatggtggggtgggcggggtgggccaccattgcatacatgagcccagcttagggaaactgcagaaaaccaaagataacacaaaatacgaaaagcaaccagagaaaacagacatttcatacaaaagaagagatgagaacaacgactctccatcggaatccatggagacaaaacagcggaaggtctttttttgtacaacagtccttctcagttcctgaagaacaactctacacggccttctaggtgttcacactcggcatctcccagcatgactgcagggagcacgtgcaccgccccacgtgctctcaagttgctcagcgtcttttgatctctgccagggagactggaaacacaaccaggccctttaaaatgaaccttcaccttggaggttcccagacctgagaagaagctggagttcagaagagctcatggccaacctcctcccttcctgcccacacccgtttcttgctttctccctttgcacccccaccatctttccagctcgttctaggattgggggaggcctcccacctgtccaaggcagtggctgcctcatctggacccttgctcccagaagggccctgctatctgagggtttctgttagggtaatttctgattgccaaactgagtactgatagttttatttttgtctctgatattttgtccagatttttaatgtattacacagcaagaaagattttggaatgaacatctctaatcctctatgttgccagccatgaaagctcccatccctcttacactcaatcacgtcgcctcctctatgcgaacgtcccgtagccctgaccctgtgcctcgctgctgccctcacctgctccacagcatggagagagcggagaggctggcggcaccagagcacccccaagaggctcctgagtgaatgaaacaaacggctgccagagtcctgacgagcctctttgaataattctacttcctggaaaaagatcccttcatgaagatgtgagcgtttaacccatgctgcatctagttaatattttttcacaatttacacaaacccaaaataaggttaaacttcaaccctctcagtctttagtattataatgttctgcagactatgcacaaacatggttaaaccccaatgaatcattagaattatttgcgtactatcatttaacattcagaatagatccttaagaaaatatacacctagaaaaaaagtgttcacaatttagtgctgtggattaaaaactgtcaaggctgcatggctgtacctcaagttcctgtttatcaaatatggccttcacaggagacggctgggtggccgaggccagcagctgctgcaagaggatcatggggggctgcggcccttcaggagacatgtccccaaggtcaggtgataccactgctccatcatctgaatttaaaaacaaaatatgtgtaagattctattttcaactgcgaacaccactttactattaaagaaaatgcattaagcatgttaaatcaggtatgacttctgcctcattatgtgatagaaaaccaaaatcttcaaggttcagacatcgaacaaaaactagactctaggttgggtgcggtggctcacgcgtgtaatccctgcactttgggaggccaaggcgggtggatcacgaggtcaggagatcgagaccatcctggctaacacagtgaaacctcatctttattaaaaacacaaaaaaattagccgggcatggtggtgggcacctgtagtcccagctacttgggaggctgacacagaagaatggcatgaacctgggaggcgtagcttgcagtgagccgagatcacgccactgcactccagcctgggcgacagaccaagattcggtctcaaaaaaaaaaaaaaaaaaaaaaattagctgggcatggtggtgcgtgcctgtaatcccagctactcgcaaggctaaggcaggagaattgcttgaaccagggagttggaggttgcagtgagccaagatcacgccactgcactccagcctggcaacagagcgagactccatctcaaaaaaaaaaaaaaaaaaaggaactagactctaaaccactttcactgcctgcttttggtctctgtccttcattagtgcatctgtctcttagagccagcaaatgctccttcccagatttctgcacttggtctgattctttctctttttcttgagatggagtctcactctgttgcccaggctggagtgcagtggcacaatcttggcaaactgcaacctctgcctcctggctcaagtgattctcctgcatcagccttccctgtagctgggactacaggcacatgctaccacgcctagctaatttttgtatttttagtatagatggggccaggctgttgattagatttcaccatgttggccaggctggtctccaactcctgatccacccgcctcggcatcccaaagtgttgggattacaggcgtaagccaccatgcctgacctacacactctctttcatgttcactcacggcttcagtaacccctgacacagacacatcccacgtgcatatttctagctgtagcttttccagctaagccttgttgagatcattaagtgaccccaagtccaaatgtgacatgtgctcagggtgatggctttttgtctgttatgagtagctttaggtgcagcctttaggactctgtttgacacagccccagggagatccactgcgctcaagcccacttcacacatctaggtactcatccaggtactcacagcatttgcatgtgctggttttcttcagtgacaatttcaactaactagaccaggagctggaaatctttctcttaaagggccagagagtaaatagtttaggctgatgggctgtacagtctctgtcccaactactcagctctgccattgcagagcaaaagcatccagagacgatgtgtaaacaagtggtgtgcctgtgttcccataaaaatttacaaaaacaggtgcatggcagttttgtcaatctagctctgttcggagtccctgctcggcccaaagcacagacttgatcatcctgattcaggtctgctgtaattgctcatcgggctgagtgcagaacagaacagccaatccaattcccaggctccaatctcccaatctctacaactgggaaatcttcatgttccctacgacctctactattaattgattctatactttcaattgatttctttcatcctcagcaggtttaaaattaatttcatagcatcctctcctcttaagaagcaaacgcacacactccacattctactggacttgcttatttgtttcaaacacactactcaatattcctccctcaactcaagcttgaaacagcagtcaccttccactttttgctggttccccataaagttatcatctacaagactacaccatcacagtggatggcaccttccttccaccagaaccttctttcccttttcatgccttccccctcatcacctgacgcaggagcaattctccatctctgtcatctcctgtttcagatactcctataccttcctagcaggtgtatcacccgaaggtcaatgcttaccatgtggcccctaccacagctttccaagtgggcctcaagtttcaccctggtctcccaggtactctgtaacaggatgtcagctgcccatctagcttcagccccaccactcatcgaaaaaccctgagctccaagaagaggagagctgctcaacgtgcttccaaagactcaccacgttcactcctctcctcctgcctccaccaccagcagagtgcttgtctgctggcatctgtctgccacagccttcaaaggctgcccgtccagtgctcagctgccactggctccagacgcctgtggaaccactcacatgcctcaccgccccctggccccagagaacaaagagagccatctgcattcacttcctctcctcatccaaaccctagagagcaatgatcatagaaaaggacttctccgcaaaagacttagcataatgtctttcaatagttggagatcaaaaaatgtttttttctattaaaagtaacacaagctcattctagaaaactaaatatagagaaatataaagaaaataaagacagccaaaattccaccaaagattactgggtcactgttttgctaaacagataactatggcatatctataaacggatatacatagcagtgtgcttttctgttcacttactgttttcatgtttccacagcaataaacatatacagctagccctccgtatccatgggttctgcatccaaagattcaacaaaccacacatcaaaaatattcagaataaaacaattttttaaaatataattttaaaaagaatagcaataacaactatttacatatcatttattttattttatttttatttatttatttatttttttgagacagagtctcgctctgtcacccaggctggagtgcagtggcacgatctcggctcactgcaagctccgcctcctgggttcatgccattctcctgcctcagcctcccaagtagctgggactactggcacccgtcaccacgcccagctaattttttgtatttttagtagagatggagtttcaccgtgttagccaggatggtctcaatctcctgacctcgtgatctgcccacctcagcctcccaaagtgctgggattacaggcgtgagccaccgcacccagcctatatatcatttatatttttaaagtatttcggaggatgtgcataggttatatgcaaatactacaccattttatagaagggccttaagcattagtgaattctggtataactgggggtcttggaactcatccccatggatattgagggaagactatacatgtaccatcattttgaatggcaccatgatatcacactgtacggatacacaacataagaatgggtattttggtgtctacagtttttcaatacaaaaacaataccaaaaaggaggccataacgacactgttgaatacattatttttatttattattttttttgagacgaagtctcactctgtcacccaggctggagtgcagtggcacaatctgcaccctgcaatccgcacacacggcaacctccgcaccccccggttcaagtgattctcctgcctcagcctcccaagtagctggcattacatgcagccaccactatgccccgccaattttttttttttttttttgagacagagtcttgctctgttgcccaggctggagtgcagtggcgccatctcagctcactgcaagctccgcctcacagattcatgccattctcctgcctcaccctcccgagtagctagaactgcaggcgtctgccaccttgcccagctaatgttttgtatttttagcagagatggggtttcaccgtgttagccaggatggtctctatctcctgacctcgtgatccgcccgcctcggcctcccaaagtgctgggattacaggcatgagccactgtgcccaggtggtgaatacattatctttacatgccttttcgtgtgataaagtcccacagaatgacttgctgggccaaagtatataaatacatacatacatctatgcatttcaaagtccaactcatttcctcagacgcccattagatggctacaccaactgaaattcccagcagcagcctgttcatggagtgcggctttacgcgcatttgaagaaccagcttaggttcatcttgttacaatacaggctctatttctttggtctggggtgcagcctgggagtctgcatttctaacacatacctgcgtgccaccaatcttgctgacccatgcagcacactttaaatgggaaggcatgaaaatacctttttccctccccacccaccagatgccctcagtcttgtcttataagatgacgatgacaattttattcacagttggtggttgctgggcaggccacgtgtctgttttgtacatttataagccacctatgtccatttttatgaactgattattcacttcctttgtctactttctactgcccttcttataaagatttaagaactttttaaaaagacacctgtgtgaacagttccagtctcctgaacagctggctgagacaggatctgccgcagtttatcctggtgggagaacagcgcccgacctgctttcaggatgtatagcttcaactgctggcgccgcagcaggtccaggtccacttgtcctgcggaaggaaagactcagtgagaagggcgtgccctgctcagactccctcctcgccagcagcaagcctccgccacatggcgacgagtaacgctctgcccttcaggaatctgccgaccgcacacactgtccgtgacgaagggcttgcctttcccagagttacactcggtgcttctgggtaagcatcttctgcctcctgggtcttccttccctgctctccaggcacctaacttgataggacgcaggattcaatgggtttaacacggttagaaccatgttagctactattaatatgatcaaatgttccccaagttgctgaagtttcagccgcttccactcttcttctaagactcctctgagagaatctgtcagccccactagctctttaactgatgaagatcgcagcaatgcccaaggcttatctgatagcagaggccgcagaagcagcacagagagcatggggtgggaaggaaggagggccgcaggtgccgctcggacactggctcaactaactggcagacagttttattcaccacgatgggaaacggcagctactagagaatgccagccagctgaatttcggacatgtggtgatttgcatgcactgcacctccaaccagagatgtgaatgggagatccagagttgaaagtgcttacatcataaatgctgaagcagcaatcgtaggtctgtgggagcaagaggggagaaaactcaagaagactgggcagaatacgccatagttatgggtgaagccacacagacttccaggacataaagaatgagcagagagaagagctccctagaaacatggaaacaaactcaggagaaccgccttctagacccgaaggaaggcaaagccaagccaggctacagtcacagtcttagccatcctgaatgtcacaggcaagccaggcgcttccgggacagaggcccctggatccggcagagaacaggctgtgagccatggtccaacagggtgacggggccacagggccctgggatggaggggaggagggaagaggtgaacagacttctcttccgggataaagggtgacacggagaagagggtgtgagccatggggttcttcaagtgtggctccgaacatggcgacaaaggctgactcgaaaatactcattaccacgaacacagggttacattcccaaccgcaactcaacaaatggtgagcccacgtgaaccccaggactttagtacgtccgtgaattcactcataaaagaacactgtacaaaccacacgagtttaagacggcagctatttcatcaagaagcgccatgtactgacctgcaaaggcctgtttagtcgatttctttattttgtgcttttctaacttgcttccagcgaggttcaccaactgagcccagacagacagcatgggctctgtgaagggcaggttgttcacattaaaggccacggcagggagctggagaggacacagaagctgtcagagtgtggccaatatgactaacaaatgaaacgttctgaaagtcatcaaaaccatgggcttaatcctgaaatgccacacatacccgtaagcctttttatagctgagaataatcattttttaaaatgacattaaaggcaggatagagatttacacatataataagtataatctatattaatttttctttacaaacctgtcaacaataattacatcagtgtggtggttactatcttctcagatattttctatatacttcaagttttctacaacatgtatatattcctataataataaaaaagagtactttatagaaaatatagtcaggccgggcacggtggctcacgcctgtaatcccagcactttgggaggccgaggcgggcggatcacctgaggtcaggagtttgagaccagcccggccaacatagtgaaaccccatctctactaaaaatacaaaattagccaggcgtggtggcacacaccgtaatcccagacactcaggaggctgaggcaggagaatcgcttgaacccgggaggcaaaggttgcagagggccgacaacattgtgccattgcactccagcctgggtgacaagagcaagactccatctcaaaataaaaaagaaaaagaatatatagtaagattgcacttgggctacatcaaaataatgtaaatggctccttctccctgtgcatccttgattcacagattaagatgacagtagctgctacattaagtcacgtcactcaaaactactaagcattttctacatgaagaaaggctgtttttttaaaggtgtttaaacatgtttgtttttttaaaacttgagttgttgaataaaaagtaaacttcataaattcacattttaaaataattagaactacctcatagatgcacggtaccttctaggttgctaaagccctcttcgtgtctctgaggctgaaatacacacgaaccactgctttaagtgccctgtgagacaggccctgcttaccacagaagcacaagctcgcacagcttcctggaaggcaaacttcaagtaccagaatcaagttctttcaagtgctgatgttggtgctcggttctagtgtaaagtcaatttcccttatcatgcagtaactaagcacaagttcacctactggtttcagctgattcaatgggcaaacgcgacacgtccgcatgtcagagaactgcacggtgattttgcccttcagggtgatgcgagtcatggtgacttctccaaagtcatcgtgcacaacttggccgcccaggcacaggcgaccatcgatgcctccaaccacagccaggaccgccatgaggccccccacttcagggttctcggaatcagggaagtagtcatctaactgggcctagtgcagaccaaacagcgagctcgaccggggacactcacggagctgcccaatccctacaggtttactgttcaactaaattaattctgagaacacaaacccacccctttggaaggccttcccgcaaagctgtgggtgatggagcggagctgggagttgatgtacttgttgatgagcccattccaccgagtcagggagtgcagcgtgtgcagcagtgccaccacctcctccgccagtgtgctgctgtgggtggcagtcagcgaggcctgcgggcacaccctgcgccgcctcagcgtggactctgaggaggaaaccaggggagaagctgctgcaccactcttcaccagggcacagggaagggagacggccactcacctctgagtgacggcactacacggctcttcaccaggacacagggaagggagacggccacccacctctgagtgacggcactgcaccgctcttcaccagggtacagggaagggagacggccacccacctctgagtgacggcactgcaccgctcttcaccaggacacagggaagggagacggccacccacctctgagtgacggcactgcaccgctcttcaccagggtacagggaagggagacggccacccacctctgagtaacggcacgtcagaggagcacatagtgagcaagctccccaagaagtcaaacagcttctccatgaggcatttcatgtccctcaccctttcggtcttgtcccatgacggaaggactgcttgcaacaaatgcacagctaagatctgataaaagaaaatttaaaatgacaagcattaaaaaaaatctgatgaggaaactacagattgttattttctttttttttttttttttgagacagagtctcgcactgtcgcccaggctggagtgcagtggcacggtcttggctcactacaaccaccacctcccaggttcaagcgattctccttgcttcagcttcctgagtagctgggattataggcactcaccaccaagcccggctcattttttttggattttcagtagagacaggatttcactatgttggccaggctggtctcaaactcctgacctcatgatacacctgcctctgcctcccaaagtgctgggattacaggcatgagccactgcgcccagcctctctttattttctgttctcataatgcaagtaatcatgtgaaaattttgagattcattattttacagccaggtaattacactcaagttgattagtgattaggattgtcagggactttagaaaaaagcaacattacagatgcatgtgtttaattaaaaaagaattatttttagtttaattcttaagacaattacactacaaattctgtgaagcagatgagtaagtagttgcaggatttaccacttaagagaaaagcaggtaaactgaaggttagcaacttaccaattatcaaggacctctgccccttgcctccagaaaatctaccctgtcacttctagaccctttctgcactcgttacggaataaaggcccctgactctgagggcagggaacttcagtacatggaggcctctctcagggaactggttttgcctggcagcacattacctgcctctgcagcgaggtggcagtgaagggtgcgtgcccttccacaaccttcatgagcagcgtgatccactgcggggagctgagggcgccgcacacctgcagcgtgagagcgatgctctgcacaaaccccagcgtgcaccagctccggtgttgctccctgtacaccagcctgtttggagaagctgcgggagggaaaatagacatgcttggtaacaagtccctaaagacaaatccctaaagatatatatatccttatttttttatcaacttattttctacaataagctcctttaaaatatattgcagtttgtaaattaattcaaactaattcaaagtgagaagtggaaggcggcttttaagttagttcaagaaacatttccgaagttttcttttttttttgttttttttagagaagggccctcactgtgttgcccaggctggtctaaaactcctgggctcaagtgattctcctgccttgccctgccgaatagctgggactacaggcatttttaaaaccttctaagtatgtgtcgtaaaagtagttagggaattttagctatgcattgtttctaggcaataggaaaatgatctataattcaaatagtaatttgcaacagtgcatctattatatttttaatttcgtgttttaaatatctccacaatcttggttatatttaatctgcaccacttaaatactctttttgtaattttagtagagacagtttccaatccaagtttaatgcatctgcattaacaaaatgagtttttcactaggtttacaccactggattctggcaccagtgggcccacctctgctccgcctggctccaggactccactactccctcaatggaagctgaggcttggaggctgggccccctgagggaccccgcccacagccccacaggacctgctctccctcccacctcccccaccctgccctcagctatccaagcttatgaggacacctgccttccttcagcacactcacatgcgctcacacacacacacacactcactctcacaccctcatatgcatcctcacactcacactgatactaagttattcagacacactcatgggcactcatacacccaccctcacactttcaggtgcactcacaccactgtcgcaatcactaacacacacacaatcccagtcacacgtatgcacaaacagatgcaagctgacacacactcccatgcactctcacatacacttacccctcccaatgcatacaaaaactcacatatgcactcacactcctcaacactagtaatgaccgattactcacccactcacacctttacccacacactttctcactttacactcacacctatactgttataacctcccattcactgacacaagcaaaatgctcacattcactcacacgcattcacaataacatcactcgtgctcacactgacacaaggcactcatacacatttacacaaatgctcacactcaatcgcacacttacacttgtgcctgccacccactcatacttcctcacactcaccaaccctcactgacttacacttacactgggtgtctcattcgcacacccagtaatcccctcacactcacactcatgcctccctcgtgctcaccctcacacacacacattggctcaatgcaccgacgctttcactcccacttcacctgaatgtagtcacctgcccactcacatgctctcatggacatacacacacccacacaaccacatgctacaaacacaccatcacacttgcaacacaaacgctcagccacttgcccatcgaccgctaacacactcactctcatcaatatgtgcggacgctccagcacaccactaatacacgcatgctctcacacacactggaggacgcccacatacccacccacactcacacgtgctcactctcagtcacatgcacactcaccccactccctcagctcacatttctcatacttactctccacacacacaaacactttatggattaaactgtgcctgtcctccaacttcacatacattcggaacctcagaatatgatcttatttaatgaggtctctgtagacgtcattaaggtaagaatttaggtgacatcatgttggattagagtcaaagaaactcaatgaaagagtcctttcagagacagaaaaggacatgcagaacacaggggcaggggccatgtgaagacgcaggcagagactggcacaatgcgtcccaacaccaaggaagcctggagctcccagaagctggacaaagtaaggaaggaccttcccctagagcctgtggaagaagcatggccctgcccgcacctggatttgggacttctggtctccagaactctgagagaacaaatttgttgtttgaagccagtgttacgggttgaattcagaattgcaaaattcgtatgttgaagccctaacccctaccgtacctcggcaggtgaccttgtttggaaatagggtcgctgcggatgtaatcagtttgatgaggttgaatgatgtcctcatgaaaaggggagatttggaggcgactcacacacagggagaatgccatgtgaagatgacggcagagataggggtgacacctctacaagccgaggaacgctaaagagaccagtaaactccagaagctggggcagagccctgaagcagcttctccctcacagccccagaaggaactacccttgatctcagccttccagccaccagaaccgtgagaatttctactgtgtaagtccccaagtttgtatactttgttacagcagccacaggaaaggaatccacacacatccacacccacccacatgcacacccagacacgacaagcgtgcggcccccagcgctgactccctgggccctcgatctctcattccatacatgtcttgtccgtcgttccgctttccactaacattcgcagcagtccgcataaagtcttggtggcttcactctgcatgatctcagcatgaactccagcagacagacaaagagtctgcagtaagttaatagtgctggtaaacatcattgcagtggggtgaatgttcctttcagtttgttcggcttctaaaaaaaataatcaaaattacaaattatattggcagccccagcctcttggatggtcttaccaagcccaaccatgtgaagcttcacgtgttttaggaacagctaagaaatgtcacgaaacctcctcccacaacctggatctccacagataggatctagctttcttggtccacccctaaattctcacctctgcttccctagaagcgataaagtgctgactaactccacattacatgaagagttcagagtcagggaccacagaggaaaggtaaaggcaggtggcaggtggggtgtgcttgggcaggggctctcactggaggaggacgcgatggaccgagaccgcagggcaattccaccaggcctcggctcactcgctcagatgcaggctcagcaccaaccacatgagactcactggtgatgcagctgcccccacctggccaccacattctcaaagaggggcgggtgcacacatgagaggaaaatgcagaaagtcagttccagccagatcgccggatcccacagtcactccacacacctgcatcggaggtgcctgggagcttatttaaattacaggttccgaggacagagcgccagctgcaggtgtgtcctgacatcccattctaaggcccagatggcagtggcagcacccagcaactggacagtttgtaggctgccttggactaaacaccttcctgagtcacccaccagagtcgtcctctgtgtccgaatcctctgctgagggctgtgcaggggctggcagctctgccagcttgaggtcgtattttccttctttccccatcctgtaggagttggtgctgcctgtgtcccactggactcttatccacccgtcctctcccagctcaccaatcactcggcctaggcctggaggaggcccatcctgagaaagccaaagtagagatcagttaggagggtgcgtaacctgccctggtccttccatggctcccagcagacctcagttaggagggtgtgtgccctgccctggtccttccatggctcccagcagacctcagttaggagggtgcatgccctgccctggtccttccatggctcccagcagacctcagttaggagggtgcgtgccctgccctggtccttccatagctcccaccagacctcagttaggagggtgcgtgccctgccctggtccttccatggctcccagcagacctcagttaggagggtgcctgccctgccctggtccttccatggctcccaccagacctcagttaggagggtgcgtgccctgccctggtccttccatggctcccaccagacctcagttaggagggtgcgtgccctgccctggtccttccatggctcccaccagacctgccacacagatgtcgccatatgccaccctgtctgtcaggggctgtccccagacacagatttcacctctcctacaaaatgtgtgcttgcatcattttaaattaaatggcataaaataacgtgctcatgctgctttaccaaggaagtcggggaaatctcatctcaatgaggatcctctgagtcaatgcagagacagggctttgcagcaagtcctgtccccacaatccctcacgggccttgcaagagcggaaacctgaaacaagcaccagcacctccacattccctttgcttcagtttcccctgggccccagggggaagctctgtctctcacttctgcaggagaaagctgtttctaggatggatgctgtctccagacactgctatttctaagatgactgtgacaaagccagggcttaccagcgtggctgagaaaagccagacagaccatgggaaggtgaacactgccctaacttagctagggctgtggtaagtgacttccacctgggggcacctggcagagatttagaagagacctgcgatgagggaagatggaaacgtggccacaggcccatgaagtagatccctaactactggcttcagggcacttcgcagcacatggccatcagcccacaggggcagcatctgggcttcctgcctcagagccttcactacaccaactttcagaatgagatttactctcttgctcactctcacactcttgttccagtgacccatcaaactgagcctcatgccagtgagtttcctgaaaagagctgcctctctttccagacttgattctgctcagatgccctacttatgattccctgtttgtgttcactcccttcagctgctcgggaaccaacacctgtgtcatcgatcaactgacacatcctggattattccaatttccacccaccaatatcgtacagaactatgcagaagataactaatgtgtggctaatgtgttcacatcaaatctctgagtacctgatcgccccatttccagtccacacctctcatgacccttgttccaatcttcatcatggcagccagttctggccctgaaacagggagctgcacaggagccgtttccttccttgtttcttccaaaactgtggcagaagcaccttgggcagaagcattcatatcttcctcaacgctgtcacaactggggcctgacggagcgtcaaaaacaatagctgagccaacaagtagctacagtgtccccttaatacacacaaaacattcacaaagtactaatgaagatcgtaattttgaacaatccatactatatgttttatcaatataatattatgaatattttactgatataggataaaaagaagataaacggaaggatgaaatacataaatatcctaggaagatataaaagatattaaaatgctcagtaaagctactttctctacttctaggaattactcccctgaaaaaagcaaaataactgagttagaaagatcctcatcacattttttattaatagaaaaacaaagataactacctaaatatctaacagtgggaaactaacaaactttaatcatggttctgtgcagaagacagctaacagctggcccgagatacaacctcagacagggttgctgcaggctggccctcagctggagtctggatctcaggagggctcccccattccctaggtggtaggtgtggttccctgtgcctgaactgtctgtacaaacaatgtggtctgtgctgaaacctgctttccttagtctggaacttggtacacgccaggcagggggtgcccgtgtgatcagtcctgatggaaaccgtgggcctggagtctctacccagcttcccggcagacagcacttgacacggctcggtgccagggcagttaagctcgtcctgtgtggatcctgtggaagcttgtacctgctttcctctggactttacccatgtcctttttcatgattttgctctgtgtcccttcactgtaataaactatagccctgagtacaactacatgctgagtcttgtgagtcctcctggccaaccatcaaacctgggggtggtcttggagacccctgacaattggtgccctgggtggctacagagtcatccgtagcacaaaacagaagccgagctgctgtcacctgagagaagtaaaacttcccaatggatctgaaaataggagcgctaaccctaggagagtaggctagatttttaaccccccttttcccacttgctaaactgagagggggtaggagtgtggttctggtaactcccttgattttagttttctcctccaggtgggagggaaaaagatccaaacagtcccaaaggtgggctggggtggaccaaaaaatgtaaaaagtttgtgtttctctctcttccaagagaacaaaaaaggatattcaattcccagggctggagcaaaactttagataaactagcaggagaaacagcctttcctttagcctagccgctactttagggcccccaggaaggggccccaaggaagggacaggagttgcattccaggtggatctcccaggagcccctgggcagctatactgttaactctgtaaagactgaatgtattgctaagggcttgaataaatttgcaaccaaaaccggggggaatttttttattttacatagctttatgttttgtggctgttacatgtggatgtatacattaagctggtataaaatattatatgtttataatttcttaaatgataagaaggataccctgatcagggcaggctgcaaatatagacggatattcatgagacacaacttccttgctttttgcagccagtgggccagatgaaatttaaacacatgaatattatcaacagaacaagtccccatacttaatgatttgtgctgtgatttttacttattggaacctctgggggaaaagtagacaacataaaaaggccatttctcgatggagatatgcttttgtaatttttaaatgcaacttttggttgctaatgaggcctcaggaaatcagatataacccttactagatgattcttttcagctgtaatatacatattaaaatatatatttaacataatacaacatataaacataatatataaattaaaaaataattatatatatatatatagagagagagagagagacagacagacagacagatagaaagattccacccacccccaagacaggatttcactctgtcacccaggctggagcccaggctggagtgcagtggcttgatctccgctcactgcaacctctgcatccctggctcaagcaatcctcccacctcagcctcccaggtagctgggaccacaggcacacaccactatgcccagctaattttcgtattttttgtagagagagggtttcgctatgttgcccaagttggtctcaaactcctgagctcaagcaatccacccgcctgagcctcccaaagtgctacgattacagcctggcctgatacatatttttgaatggattaatgtgaactctaaaactgatgtgattataagagcttgggaaaaccttgctttttcactgtgactttgacaactggccctgcagcatctcagttttagccaaagaacaccaccataaaccaatcagatctaatagacatatacagaacatttcaccaaaaagagcagaatacacgttcttctcaagtataccacaggacactctcttagactgaccagaccatatgttaggccacaaagtctcaaatttaaacagacgaaaatcatacaagttaccttctccaaccaaaaggaaatgatgagaaattaataacaaaaggaaaagtggaaaattcacaagtatatgaaaattaaacaacacatggtaaacaatcagtgggtcaaagaagaaatcacaagggaaattagaaaatactatgagatgaatgaaaacacaacacaccaaaacttctgtgctgggccaaaagcagggctaaaaggggcaattatactataaaagtctgcatttacaaaagatgatctcaaatcaataactctacatctggaagaactaaaaaaataagaacacaataaaaaccaaagttaggccaggtgtcgtgcctcacacctgtaatcccagcactttgggaggctgaggcaggtagataacttgagcccaggaggttgaggctgcagtgagccatgagtgcgccactgtacttgggcctgagggacaaagtaagaccctgtctcaaaacaaagacaaaaacaaaaacaaaaaaatacaaagcagaaagaaggaaacgatagagattagagcagccataaattaaatagagaatagaaaaataatctacaaaaccaaaagttcggtttctggcaagaacaaaaaatctgacaaacttttggtaaattaagaaaaaaagaggccagtcaaggtggctcacgcctctaatcccagcactttgggaagctgaggtgggcggatcacaaggtcaagagatttaggtcatcctggtcaacatggtgaaaccccatctccactaaaaatacaaaaaaaattagccaggcctggcggcaggcgcctgtagtcccagcttacttgggaggctgaggcaggagaatcacttgaatccaggaggcggaggttgcagtgagccaagactgtgtcactgcactctggcctggcaacagagtgagactccatctcaaaaaaaaaaaaaaaaaaaaagaaaaaaaaagagaaaagatgcaaataactaacatcagaaatgtaagtggagacagtactaccaacataaaaataaaaaagattataaaagaacactgtgaacaactgtatgccaacaaataaaatagcctagataaaatggacacattcctagaaacataaattacccaaactgactcaagaagaaatagaaaatctgaatagagccataacaagtaaagagattgaatcggtaattaaaaatctttcaggccaggcgccgtggctcacgcctgtaatcccagcactttgggaggccgaggcgggtggatcacgaggtcaggaaatcgagagcatcctggctaacacagtgaaaccccgtctctactaaaaatacaaaaaattagccgggcgtggtggctggcgactataatcccagctactcaggaggctaaggaaggagaatggcgtgaacccgggaggcggagcttgcagtgggccgagatcatgccactgcagtccagcccgggcaacagtgtgagactccgtctcaaagaaaaaaaaaaaaaaatctttcaacaaagaaaagcttaggtggtcaactctaccaaacatttaaagctgaactgacaccaatcctcaaactcttctaaaaacagaatatatgggaacactacctagttcattctatgaggccattattaccctgataactgtaaaacaataaaatattgctgaaagaaattaaagaggacagaaataaatggaaagacattccacattcagagaatggatgttaacattgttaaaatggcactatttcccaaaacaatctacagattcaatccctagcaaaaatcccaatggtctttttttgcagatatggaaaagccagccttgaagttcatgtgaaaatgcaagggacccaaagtagccaaaatcatcttgagaaagaaaacacacttctcaattttaaaacagtacaaaactacaatgttcaaaacagggcggtacctgcacaattatcaacatatagaatgtgataatgtaattgagagtccagaaataaacctaaatatccacagccaactgatttttgccaagggtacccagaacttcagggaaagaacagtcctcaacaagtggtattgaaacaatcagatcaacaaaagaaaaaggctggactcttacctcacactgtgtaaaagaaattacctaaaaatggaccaaagatctaaatataagagctgaaactataaaacttacagaagaaaacatgaggataatcttcatcaaccttgtgtttggaaatggctttttggatatgatatcaaaagcatagacgacaaaagagaaacagataaattgaacttcatcaaaataaaaaacttctctatctaagggaatacaatccagagaacaggagaaaataccctcaaatgatatacctgataaaggtctacagatctgtgaaggtctagtatacacgaactttttaaagagtctgaggactggtgttaattcttctttaaaggtttgatacacttatatagtgcatttattggtacaacaagatgacgacaaataaccctatttaaaaaggagaaaggggctgggcgcagtggctcacgcctgttatcccagcactctgggaggccagggcaggcagatcacctgaggtcaggagttccagaccagcctggccaacatggcgaaatcccatctctactaaaaatacaaaagttagccaggtgtggtggtgtgtgactgtaatcccagctacttgggaggctgaggcacaagaagtgcttgaacccgggaggcggaggttgcagtgagccgagatcgtgccactgcgctccagcttgggcgacagagtgagactccgtctcaaaaaaataaaataaaaaataaagagaaagggacttgaatagacacttctccaaagaagatatacaaatggccaacaagcacaaacatgtaaagaagctcaatgtcattcatcattagtgaaatgcaaaccaaaatcacaatgagataccacttcacacccgctaggatggccttaatccaaaaaaaaaaagaaaaccacaaaaaatagtgttggcagggaagcagagaaactggaaccctggaatcctgcccactggtgatgggaatgtaaaaatgatatggcactgtggaaaactttggtagtttctcagtaagttacacatagttgtaccatatgaccctgtaattccagtcctaggtgtataatcaaaagaactagaaacaagtgttcaaacaagtacttgtatataaatgttcctagcagcactattcacaaaagtcaaaaggcaaaaccaacccaaatgtccatcaacagataaatgagtaaacaaaatgttatatattcatacaatgaaatctttttcagccataaaaataaagtactgatatataccaaatgaaataacccagacacaaaggccacaaatggtatgattccatttatatgaaatatccgggatatgcaaatccatagacagagaaagcagatttgtgactaccaggggctggagagcaggggagtcaggactgatggctaaatggggtgcatttatagtgatgaaaaagttctacaactagacagtggtgatgactctagaaaattgtgaatgtatttaataccgctgaattgcgacgttaaaatgctacactttctgctatttgtgtcttaccataatttacaaaaagctttttttaaaaaaaagaaagaaaataaatcaaagcaaaatcttgacgttttcccaaaggctctcaagccagtgcagacctaccaatcaggcgcagtgccgtctgagcgagggccagcgtgccggaattgagcaggaggtcaaggttgtttgcgctgtgctgcagggtgagcatgctgagcatcaccaggaggaagtgggcttgcgggatggtccccaggctcggtcccgatgggttctcattggtgatggtttgcaggggaaccggctggatacctaatgagcattggcacccactgacatttcttgtaatggatacaagaataaatgtaatgcagaaagcacgggcaattactctaaacatctgactaataagcactgacacccactgacatttcttgtgcgtggatacaagaataaacgtaacgcagaaagcatgggcaattactctaatcatctgactattttgacacccactgacatttctctcgcatggatacaagcataaacgtaatgcagaaggcacgggcgattactctaaacatctgactatttttcagtggtttccacagagtgggcagctctgtcatgctgcacgatgggcctaccccctgcattctatgcacaggtcgttccatctgtctacaggacttagtatgctgctctctgaatacaccggtgccctattccattccttccatttcaaatataaaagttatgtctcacttttcctccacaaaaccaatccaatcaactctctgtagatgctcaaactatccaggaaataaatatcaatataggacacagacactttaggatatgtggtgatacacataaaaatgtcaaaatgtaaaaatgttatactagagtacttcaacattgtgtctcctgctaaattttaaagttttgtttaaaatctgagaaagctgacagcagcatagattatacaagtacaaagtacaaacttattaaagtcttctcaaaagcaaaaattggcatttgcaagtttccacaacatataattaaaggcaaactataaaataacattgatacaattattgactcaccaagctctttaaatttggcactggcatccaccaaaacatttcgaatgttctgaacagcccaagcgtacagcttgccaaaggtgacttccagcagcatccgattaaaaggcgggatcaaatcaacatcctttaaacaatcagtaagaggttccctttcaaataaagataaagaatttgactcgggacactgccagacttctaactgttacagaaaaacattctgttgccacagcttccttaattaagaaaaaaatatgctaacgttttaccctatatcgattccctcaggaataagtctttgccatccacaaaacatcgcatacggcacagatggaagtaagaaattcttgctcaccagatacaattttaaaattgtatctatcccttccaggcgaacctctgctctctccaactgcaaaatatcaatgcatacagttaagtgttatgtatattacccaatgcagagaagcatttctcatcaaatgttacctgttttagtaggcactttctcttttccacatccactggctcttctttaagggcaaattcagcaattgtactgaggagtggagactgcggataaagaccctgcacattctgcttcaaccacttgtatttgtgaacatctgtaacagtactcaacagcggctgccatttgtcctaacaaaggaaaacaattttcatcattagtctaccctatttaataataaactgtgctctaaaagttattcaagtaaaatataaataatgcttatgggtttaaattggttaaaatacgttaaatttagtaatacatgtttttaaaactatgctataaatataagtgaatttataatctctatactatatgttggaacaggctagcttggcatactaagttaagttatggttcatattaacagccacagggcccagcactgtttctggaacaaagaatatatttaaggaatgaatggtgaataattaatgatacaatctaataccaaaaataaaaggaaacccttctccagctacagctctgaccaggacatcataagtcaagttcatgaagcatcactggggccgtatttctaacaaccgcccgtccctccctccagatgctcaggtacagaggtacaagactgtggattcctgtgctacatgctacgattctattcagccaacctcagaatcacagaaaataccgcaccttgggtgatttaattgcaatgggtctcttgtccacatttattggactatgaggcaaaatgcaagcttcttctaaatcactctcttcgtttccaattttttcttcatcatccgtagattctggcttcttaggaactgtgttttaaaacatcattcactataaaaatcatacacttaaatattaattttaaattaagacatatttagatttacatgaaggacaaatatttcattcaaataaacatctgaacaacattataaattgcaatgctcaacaacaagagtgaaatgatcaccctggcagaacaaaaagacaaagtgagagtgcgacgaggggagaagccccgaagcaggggaagcccggcagccagcaagctcttcctcaagtgccagagagtgaacatttgagtctttcaggccatgctgtctgtcgcaaatactcaactctgctgctgtagcacaaaaagtaaccacagataaagcaacaggtgtggctgtgctcctgtaaaactttatttatggtgctacaattttagcttcatgtaattttcatgtgccaaaataatatacttcttttaatttttaaataacaatttcaaactggaaaaaaaaaaaaaggtcttagtccatgggcaacccaaagccagcaagaggtagaatttggcccatagttcctggcttgtccaccctggtccagttcagtggttctgttactgtgtaactgaatcaactgaattcactgtgatatgtggaatttcctccctatactttatctcttttaaaatttttggtctaaatctcctcagcatataatataaaaaataagcaacatgataatacatctgggcagtaaagagctaacatagcaggccggggttgctcaaaccctgcaaattcccaaggaaggtctgtcccttcaggattggtccttcttctaggagctgagctctgagcccttggaacatcctgcctgagaagttttttggtatacctgacacccaggaccttgtggcagtggtctggccaggtagtttatgctaatgatgggacttgcgagggaccacttgtttttgcactggggcactggagcctgagtgaggtcagtcacaggggcactgcctgcgtatgtgactggcccccaacaaaatctctagactcgaggctcaggtgcgctggcctggttaacaattcttcacacatgatgtgacactgttgctgggagagctaagcacatccacgtgacgccactggggagagacaccaaagcgtgtgcctagtttcctctggacttccctccatgcacccttccctctgctaattttaatctgtatcctttttgcagtaaaaacacagctgtgactataacagctcttctgagtccttttagtgaatcaagcctgagagaaggctcggggatccctgacacagcaacaggaatattaatcacttaatcttttcaagttacttactttccaaaaaaaaaagaaaaccagcttgaaacaccacacgataaatctataaacccacaagaaactctaaaagtgacagtgtgggctcagaacccacggatatgagatggcaaatgtggagtctctctccctcattccgaggcagcctgtctcctgggcccaggctgagttcctgcatgcctgggttaaaggaatcgcagcagtgtgactgctgtgacttcctgatccagagcacccctcgcattcagacaggctgttatggtgtagggtttgttcaggaacaatcaaattaggatggcttctaacacactttagtctttcataagcttattgttcaaaatgcccatcagaaagtcagtaatcaatactgttcaataagcaggtttgtgagtaaatcagtataagtcataatatgatcagaggccaggcgcggtggctcacgcccgtaatcccagcactttgggaggccgaggcaggcagatcacgaggtcaggagatcaagaccatcttggccaacatggtgaaactccgtctctactaaaatataaaaattagccaggagtggtggcgcgtgcctgtaatcccagctacttggaaggctgaggcaggggaatcgtttgaacctgggaggcggaggttgcagtgagctgagatcgcaccactgcactccagcctggcaacagaccaagactccatctcaaagaaaaaaaaaaaaggatataatcagaaatttctgtagtttatttataatcacaagtgactaaattctaaactattttataatttctaagcatttttattcaaatttggatttaatgcaaaaagacttttctgtacccttacacagctacttccaggaaaatgtcagtaactcttttagcttccctttatagttcttcatgtatcagaatactcaatatttccaaacaaaaaacatttctttagaagaatggcaataagtttaaatgttcccattatatctcattaccaggataactaataaaagtacttccttgttcccatcaatttagcaaagattatttacgttttcaacatcaatttactagtaatcaaatcataccacactcaattcctaaactgcctcattgtctgatcatttggaaaaataagcgagatgtctgtatttaatcctaactataataaaaatgatggcagcaggtagaaatgttacatggaatcaacagtagagaaacttcactctgaaatcacagatccaacgtggcagggtgaagcacaagctttaatagtatcttctgtccttttacattcttacctctctttttccttggttctcgaattatcttctgagctatcctcctccaatggggcaaagaacttaacaatttaaacttagacattatagagaggtcattacaaacagcaggtctcaattcattaaagaggaatctcaaacgtttgatgacaggagcgcagacctccttgtaagaacggccctgttcttgatgagtctgcaaagttaaccaggaaaagacaactttaacaacaaatatttcagcaactgtctgcaaagcacagaataaaaagaattaaaatctatcaccttaatgagcgaacattttgcttggtagacaactctacaaacatccaccactgacttaggcaacgttctgtgctttacttgctcaatatcaagtgcacctgcatgaactaaagataatgccacatgacctgtaaaaagacatttaaaagaagggcagtgaaggaatgaatacgtaccacaggttagtcgaggaatctgcagtgtagctaaagtacaaagatattgagctccttacctaaatcttcatgttttaagaggcaacataacagcaagcgaccgacctcttccacgggatgctcggggggaaacatgatcggtgtggtcaaatggcactgcctacagtacctttctatttgacacaaaaagtcctgcaacaggaacagctggaagtaacttcagggaaacccagtgagtcttcacaaatcttaaacatgccacagcttctgacgcacttgcaatcactaatgcttctgaagcctcgctagcatgttaacacaatcaggttctcacctcaaaaccctccaaataatacatgaaacaaagtctgtgctgtgttaaccaaagagcacataagtattcctatgtcaaagtcctcagataaacagagcactgaggtggcagtgggggcaggcctagctcaccttcacgttgtgatcctgaatgttgttgtctgcaatggcttgcagaaatgcctgggaatggtcccccagggcccgtctgtgggagcagagtcgagatttgctggcaggtgtgccccctggggagctgcagtggtcctcgtctttctcctcgttgtagctgtagtggatctggctggtctgcaggcctccagagaagatggatgactgaagccattctagaaaatgcacacacaaacatgaaagagaaactcaagtgcacaactcaaaataaatactaaaaaaaaaaaaagatgctcaactgaacactcaatttagaaggtgaaattcagcatcattcatatgaaagagctccacctaacatgtttacacaggttgacttataattcctctatctacgtgaacacactttctggtgattccacacgcctcaggcatggcatcagaactcaggatcgtagttccagtccaacattctctggatacctgtgctctgcctgcagctgcctggttccacaggtaccgtgtgaagactgaggtgcacattctaacagggaaggcagcaaagggcaccgctgacacaattaatcacaggatttcaagtccgaaactgtgcaacagatgactatgggggtaccagggagactggaagacagaccaccgctattctgagggtcagtgagggacttgtggaagcaacaactgagctaagatgaggaataagacccagacgctgagtatccaggcagggaatagcacatctgaagggtttctacaaagaattacatcctcagggtaggctatgtattcctagagcacttataaaggaatgaaaaggagaaaatatttaagaaacacacaatctgtaatgaaggatagatccttggagatgggagggccgatggactggaaaggagacctgtgcgtggtgcaaggcatgggatcaaccagtgcgaatgttaattacaactgcttatggcaacttgagggagtgcaccactacagatctctattaacgatctgtgttatcaaatactgctccaaatccaagcaatcaaagcgggatgcacttagtgttcttttactggacatttagattttagagcactcaggagcattccccaacacaccacattcgttcttctgaaacactaatccaatgccgactctctctggccccctctctttaagcacaggacagcccctccttactgctccaagataagcctctgatcctcctgtggatcggacccacctgccagggcccatggcaccctctgccctggagctcgccagccctgccctccttgccaatttaaacaaagcccatcttctggcaagcaatgagccttgaggaggagggaaggaagcagacacctcagagggcaccacaggcagcccagcacctagcactgcacaaaggtccgcccaacggggggctgtatggacaccaagatcctccttccctgcaagcctctgccacacccactcctgcaagcagcaggaaagccctgctcctctcagcagtgcccttgacactcctgtgttttctgcccagaatgctctctcacgcaatttcaggactgctgccaatgtgaagcctttcttctcccagaaccatgtatgaacatctccatttcaccattcaccaccttgtaatgtgacctgcttagaatggtggctcatcaacaagcagcagctgaaagcagaggcgtgtcctacccatcactgcatcctgaacacctcgcatggtaacggcaccagaaagcagaggtgtgtcctatctatcactgtatcctgaacacctcgtatggtaacggcaccaggcaaatgctcaacagaagctgctcacatggatggacagacagacagatgggaaatgcacaactacatgaaggaaaatggaaacacatcttaggagacagaaagaagcttattattttaggtggttacaaaggctgccatcctgaaatataactgacttgagcctggtctggtaaaaacgcagtgctcaaatagtatgctcttccctgagaggacagctgatccacattctgtgcaatttctgggcatgcagggagacaaaagccatgctgggcccatcaggcagaggctgcaatacgtgagaccaccaagggcagacgggtagacattcctgcacactttttagcttcctctgcagcaacagaccatgagggcaaatgacaaccactcacagctgtttctacctgattgagtctcactatccttattatttttttttttgtcatcatcaactgtgttgaatcctcctctccttttttttttttgagaccgagtctcgctcttgtcacccaggctggagtgcagtggcgtgatctcagctcactgcaacctccgtctcctgggttcaagcaattctcctacctcagcctcccgagtacctaggattacaggcacccgtcaccacacccagctaatttttgcatttttagtagacatggggtttcaccacattggccaggctggtcttgaactcctgacctcaggtgatccacccgcctcagcctcccaaagtgctgggattacaggcatgagccactgcctggccatctcctgcttttttaaagagagagtcttgctctgtcacccaggctggagtgcagtggtatgatcatgactcactgcagcctcaacctcccaggctcaagcaatcctcctacctcagcctcctgagtatctgggactacaaatacgtgccaacatgcctggctaatttttgtgttttttgtagagatggggttttgccatgttgcccaggctggtctcaaaatcttgatctcaagcaatccacgtgccacaacctcccaaagtgctgggattacaggcatgaaccactgtgcctggccctctcccactcttaatggcacttacagttcaaaaaaaaaaaaatctgctgattagcaaaaagtaaagattttcttactggcacattcaatctcgacaggagacagcggtgtgctcattgctaaataggaagcgtgtaatccgagaagcaggcccagattcctctctgtgtctatcagaggtgaggagagactccccagatctggtatggtgacgccttcttggtcaggctggaaaaataaatttaatcatcaatctgaggaaacagaattaattaaaaacataaaaccaaaaggacagctctctcctgcagctgtaccgcacgtgagcccaggggtgctctgggcgttctgcccctccatcctgtaatgagttggtgctgctgtgcccaagtaacagcagataccatataaacccacatgccctataaagcaggcagcaaccgcacagccctactgtagaaaaactaaaccacagatacatgatttggctagaatattccttaggaatcagtttccaaagtgactgtacaccatgcttcagaaagtataatgaattgttacatgcataaagaacccactgggcaacaaaactatgacaagtattcgatgacaagtattagtggactgtgaccacacatgtagaggaaatgaaatttattctaacaaaaatcaaactctgaaaaaagcaagagttcaactttttcagtcacagaagatatttacagcaaagttaattctccccttcataaactgttttaagccctgccctaatggcatttaatacatcttattacttgtcgatacctagtaagctaatcccaatatataaattctatgtgttcgtgaatacataggaaggacatatttctattgtaaagaattacacttctacatagttcttcccaaaaaatacatacctcaagattataagccattccaaatttctacataagaccaaagtttaacctcttttcttgtggaacactgcctatatttctcacaaattgatcatttaaaaaacaatctttcaagaccagtacatcacagatcttaacatgaataaatgtaaattcatttatgacaaaacttctaaaggatctttatatttatccctaatgccccgcaaaagacccagatatcagtacttctagatccaaatattcctatcacaaacacacagagggtatcccctgccatcctctgcatcactcaaggcatacagcctcacctccaaatactggccaacacaaaatgcgtgcatggattcccgggtgtcttcaaactgcaaagcagcttccaaagctaccactgggtcttcccctgcaaactgagctgaaacaaaaagggaaaaagcaacatgagttcaattcagcttgcctgaagagctacaggagaaatagtgagtaggaaataagttaggctcttaactcaaaagtgagggttaccagaatataatgacctcccactgtctcccagggttgcctgggccaactcggaacttgaaatgagttccaagtattaaaacaaaagatacataatgaaaggaaattcttcgaatgtgctgaatttgttgataagacagacaccaaagccacagatacattaaaatatgcgggggctggcacaaaactaaaggaatcatttataagccaaatactctgcttaaaatgatacaggctgtaacttttaaccaggaaataacaagtgtaatcttaccaagaatactattttctgttaacgactgtgtctggaagtcctttatatcatacactttcccgtcaatcacagtccagaagcctccatcgttattatggttctccaaatcagctatgcgtacaaatgtcactttctcattatttctacagttctgacctgtaaaaaatgactctgtatatacagaaaccagaatcagtccattgatcaatcaacaggtaaaatgaaaagaacaaactgtgtgaaagaactacaagcagaaataaacaaatccacaatcacaatgggagaaatacatacctagctctgaaactaataccacacatacaaattctgttaaatatagaatgctttaaaaaaaagtctaggcagcatgaataccaaatcgggccatgccaggccatagagtaaatctcaacagatttcaaagaaataaacttacagagcatgtgtgctgactacaatgcagttaaattacaaataggttttcaaaaattcattcaaaataaaataaaaatgactctgtatacacagaaaataaaaatattcatccacatatttgaaaattacaagatacacttataagtaacccaaaattctaagaaaaaatgactatgaaaattagaaaatgtgttcagttaataatcaaaatactgcagatcgaaattggtgacatacaactaaatgcatgcttgagggcatttatgcctttaaatgtatatatttacacattaaagggggaaaaagctaaaaaagaaaagaaacaccaaatcaataaaagtctgttagttcataaaaatactcaaaaaaaagaaaacctgagtggtggtcacctatgcaagtgctaggataccaactcaatattatgaaaaatagttaaagggaggtggcagttcaagaagtcaagcttagattatgtccttgctgtacaaattgtacctcctgctaaccagacagcagagggcaaggttggtaggggattttatagaggatacgcaacacatgaattccctggtctagcttcacagaactaaagcggggagccaccgagcattacaggcctcctgagccaacagaaagcatgcagcatgaccccagacataacaccgccccaacgagactgaattcaaatccaaccaaacctctagatctaaccagcagattaatgtaactaacagaagaacatgttggtctagaataagagaatgcaatcaaccaagttcagaaaatgtgaagttctccaaaataaccaacctgcttctttgaaaaagaaaacggtatgatcagagacagggagaagagggcctggagccatgttgtttggggaaagagactagaagcatatgtcaagcaatgccaatacgcagaacatgctcaggtcttaattcaaaattaccacctaaaaaaggcatttttgagatagtccaggaaaatgtaacatggactgcatgttagattaaggaatcactgttaatcttatagacaggataatgatattgtagggtttttttaaaatccttatcattaagaggtaaaataccttaaaatgttttaaagacagagttatgctttaaaataatccaatcagccgggcgcggtggctcatgcctataatcccagcactttgggaggccgaggcgggcagatcatgaagtcaggagatcgagaccatcctggctaacacagtgaaaccccatctcgtaccatgccatattactgcatttaacaggtatgatgaagcaactgaacaggctatttttccatttccattgcatttcaacagagcccattaaaaagtagtataaatggcccttaaatactaatatattttaaaatgctcaaactatatcggggtcaccactttgtgctttagcaggcaaaatcccaaaagcccacacacaaggctgggagaccagcatccctattggtggtgagagaaatcaagatgtacaggagcaatctggtgacaaccagcccacacgaggtccatccccacctgtgcatgtgcacaggcacacacgcgtgcacacatggaggacacgtgttccaggccaggccttgcagtactatttgtgttttctgttgttgttgtttgagatggagtttcactcttgttgcccagcctggagtgcagtggcgcgatctcggctcactgcaacctctgcctcccaggttcaagcgattctcctgcctcagcctcccaagtagctgggattacaggcacccgtcaccacgccccgctaatttttgtattttttagtagagacggggtttctccaagttggccaggctgatctcaaactcccaacctcaggtgatccacccacctcgacctcccaaagtgctgggattacaggcgtgagccactacacccgaccctcagcactatttgtatagcaacattgtggcaataagcccaagtgtccaccaataagagactcactaaagaaagatagataaaagacacatccacacactgaagactaagctgatttataaaaacaaagagggacactctgataaggtactccagtatatatggttagttaaaaaaaaaaacaaaaaacaagcaacacaagtaatgaagcatgctaccacgaacgtactcatgccagagaacaaggaggttacagaggagactggaaagtcagagggagcaggtgggaaaatgggtggaaggggtgggcaggggaagcgacagtgtgtctctgcctaggtttgatttttgaaccatgtgactgtattttttttttttaatgactgtaaaacaaaataaatactctttatactagaaataaaatgttagaaaaatctggattcaaaactaggattactgttctgcactggcaaagttcactaccattcccaaaggcagttttctcattgacataatgagatacaacagcgtgcatgaggtcctcagcgggcctgcaccctacaggtgctccacacatgcaaatcactaccattactattacataagagatataatacataattatactgtcactactataaccagcatgacatactaagacagcctgcgttcagagtatgaagaaggctgtggaaccccctgcagaaggtgggagggcctggggctgtggataaaggggagctctctggggctgtgccacctgaacctggaacccgggcccccaggttgggtcgccaggcctgtgcgcctcagcttgctcatcactcactctcaacacggataacaccttcaactgcaaacacgtttaaaaaccacaggccagctccccctaccaataccagaaaaaacaagtctccacacgggcccaggatgagaacctacaagtggtactagctacaaaacacatggagaacacggttcttgcacacaccttatgagacgtcggagagctacacagaggaggcatctacagggtgtagccagacggtctaaatgggccatgacaacaaccgccgtttgttgcagatcaatggcaagcctgttgtcttgtggaagggtgaggtacctcaggaaactctcactggggctcagaggaccagacaaaagctagaaaggaaaagtaaacaaaaattcagaaatggtgggaaaaactaaagtaacacagttttttacccaagctttatattttggtattgactcatttgacccatcaaatgacaatgttgatgatacagttatactatacgtctatatatttatgcagcatataaactgtataaatctctaaatctgctgtatacatgtacacaacattgactgtgcatgtatacatttatgataccataggtaagttgaatccacacagattactaacatgaccaaaccactctacaagcctaggacccctggagaaaggcagaaccacctctgtgggaacccagcacagcatctcaagctggccttgaaatctaaaaccaaaacctttattttaatctaaatgttgcccactctggagaacacctactttcatttgcaaattaaatcacagttctaattcttctaaaggcagaagacccctattatcattagtttaaagactgccaaataataggctgggcatggtggctcacacctgtaatcccagcactttgggaggccgaggcaggcagatcacaaggttaggactttgagaccaccctggccaacatggtgaaacctcatctctattaaaaatataaaactgagctgggcatggtggcgggtacctataatcccagctactcgagaggctcagacaggagaatcattcgaactagggaggcggcagttgcagtgagccgagaacgtgcactgcactccagcctgggaaacaggcagagactccgaagacgggaagggacgggatgggacgggataggacaggacgggatgggataggacaggacgggaagggagaaagaaagcaatgtacccgcaaaacaaacaaacaaacaaaaaaacagtctcggggacctatgggactataacaactccggtcactgaactcacgaagggacaggagaaagaaggtggggctgaaactgtactccatgaagtgatggcttacaagttcccaaatttggcaagagacataaatctacagatctaacgtaagcaaaccctaaacaggatgaacccaaagaaatccaaactaagacatataataatcaaactccaaaaaacaaaagacaaaacatttcaaaagccactaaacaaaaacagtgccttaactatcgtggattaacaagtcaaatgacagcgaatttctcatcagaaaccatggagcccagctgaaagtacaaaatatttttcaagcgatgaaaagaaccattaacccagaattcttatatccagcaaaaatgtccttcaggaatgaaaaggaaagcaaaacattctcagaggaagtgaaacagaatttgtcaccagaagacccacaccaaaagaaaggctaatggaagttctctaagcagaatggcaaccatcaaagaagaaaaccctggaacttctggaaggaggagatgacaagcacaccaacgcataaatacaatagacttttccctcacctcttgactttgctaaattacgtctgaaggttcaaccaaaaattataacattgtcatatgtggttatcaatgtaagtaaatgaaatatttaaggcaagtatattatgaacagaagaacataaaggaacatcaagggaggtagtttctatatccctgaagctggtaaatgacaacatcaggtaaaatctgataagtgttcatacatacacaggctgagtgtcccttataaaatgctcaggagcacaagtgttccaaatttcagatttttatcagatttaggaatatctgcatataaataatgagatattttggggataggacccaagtctaaatacattcatttatgttttatatataacttatacacagagcctgaaggtaattttatatagcatgcttagtaattttgtgcatgaaacaaagttcatgctaagtacttatgaatggaattttcaatttgggggcgtcatgctggagtgccataaagtttcgaattttggggcatttcagattttggattttgggtttacagatgctcaatctgtatgcaatatattacctagaaaagccactaaaaaagctatacaaaaagatacactctaaaacactacagatgaaatagaatgctaaaaatggtcaagtaaaccacagagagccaggaagaaccaaaccgaaaaaatgaaaaacagaagaaatagaaaatgcaaaacaaaatggcagtgttaagcctcaatttatcaatgacattaaattaaatgtaaacaatctaaatacatcaattaaaagacactaggagagtagactagagaacatgatccaactatatgttgtccataagaaagtgacttcaaacaggcaaactgaaaatagaagtatagaaaaaaaaagatcatgcaaacattactgaaaggacagcaggagttggctatatttataacaaataaagtaaacttcagaacaaagataattaccaggagggccgggcacagtggctcacgcctgtactcctagcactttgggaggccaaggtgggtggatctcaggagtttgagaccagcctggccaatatggcaaaaccccatctctactaaaaatacaaaaattagctgggtgtgatggcagaagcctataatcccagcttctcaggaggctgaggcaggagaatcacttgaacctggtagggtcggaagttgcagtgagctgagatcatgccacttcactcctgcctgggcaaaaggagcgaaactccgtctcaaaaaaaaaaaaaagataattaccaggaaccaacggcaacattacaaaatgagaacttggtcaatccaccattaagacacagcaattcgaaacgtgcagacaccaaacaaacaaaaaaacaatgaatagaaccgaaaggagaaaaagacatttatacttttatagttggagacctcaaaatctctctctacagctgataaaattaggagacagaaaagctgccaggatatagaacgcaacatcaccatccatcaactagagccaatcaaaatttatagaacactccagccaataataacagaatacataatcttttcaagtatccacaaaacaaatactaagttagaacatatcctgaggcataaaacaaacctaacaaattttttgaaattaaaatcacacagcatatgttccctcaaacaatgggaacaaatctgaagtcaacaagagaacaattacaggaaaattgcctaactctcagaaactaaacaataaacttctacataacccatggatcaaagagaaagtctcaagggaaattttaaaatatattgtgaactgagagaaaatgcaagtacaatacatcaaaatgtatgggaaagagctacagtgggtgacgagagacaaatttacagcactaaatgaatggtacattagaaacttggaaacaaatcaataatataagtgcccacgttgacaacctaaacgaaaattaaaaatagcaaaatcaacccaaaagtaagcagaaaggaagaaataattaaggtaagagtagaaacaaagtgaaaacagaaaaacaataaacagtaaagcaaaaagctggttctttgaaaagatcaataaaactgacacacctctctaagcaagactgacaaaaaaaaaaaaaagacataaattacccaacattagtgatgaaacaagctctaaagatatgaaaaaagataattaggaattactaggaacaactctacacacataactttgacaacttgggcaaaatagacttattcctcaaataatgcaaattaccacaactcaccaaatataaaatagatcatttgaatagctctaccactatcaagaaaactgaattcataattcaaagaatcccaaaaaaaaaaagaaattaccagatccaaatgaactcactggataattccatcaaacattaaaaaagaattaacacagactcaaaacaatctcttctggaaactagaaaaggaaaaacttcccaattcatattaagaagctaatattagagccaatattagcattttaagaagctaatattagagccaatattagcattttaagaagctaatattagagctaatattagcattttaagaagctaatattaggtaccgtaactaaagacagtacaaactacagaacaatataccttaatatatatatagacacaaaaatattcagtgaattattagcaagtagaagtaaacaatatataaaaagaattccacatcatcgccaagtagtttcattccaggaatgcaaagctggttcaacagtcaaatatcaatgtaacccaccctattaatagactaaagaacaaaaatcacataattacatatcaattgatttagaaaaagcaaatgacaaaattcaatactcgtgaatgataaaaattctcagaaaatagcaacaaatgggaacttcatcatcttgataaacagcatttacaacaccttaagctaaaacctatgccaacaagaatgtcagaaagggtcctcccagacctatttatacagcagagagaatcattaagaatgatttagatagttactaagagtttactctcctaagagattacaacacccaatggccagcaagcccttttcattagacaaaaagaaaagctgtgatctgtcaacactctcagaaggttcactgtgaaatgtgcacttctgaactcctgctgagggcctacacgctgcaatgttgagaagcaagtgtccagaggtctccttggaaacattgcaaaaaaaatgtgagggactgatggatgaatagaaggatgaaaaggtggagagaacggtgataaagcacgtgggatgatgccagcggcacaatcttaggtggtgaatatgtgggtgcgcgctgtaaaattctttcaacttttctgtatatatttttttcataataaaatgttggaaaaaataaacctgtgaaaaaggaagctttagtcaaacatatctaagcaaaagaaaaaacaaattctaaattcctatggctcaaattaacgtgtttttctttttaggctgagatggaagagtaaaaaaacagaaaaagaaatgaaaggaataggagctattctaacagctacaaattccacctgcagtttgattaaagatggcgtggctcaagaatatgctttgaatccaagccccttcaaggctgccaggtacagagtcggttctgcaaaagctctgtacctgtgaacaagcagagcttccaaataaaccgattaaagctgccctgagtcaataagccgggctttaatctgagcaagaaaggtacatttttagtctagttacccacccataactgtaggtactttgatacctaggtgaggggaaacatggagaaaggcaaaataacagatttttaaaatcacaacaaatctttatcaaacatttgtgccaggcactgacttaagagcttcaaatgcattatttcatgtcatttgcacagcaactctctgagtaagtactttcacttattttatatataattttaattatttacattatattatacttattccttttttttgtttgttttttttgttttgagatggagtctcaccctgtcacccaggctacagtggtggtgcaatcttggctcactgcaagctccgcctcctgggttcatgccattctcctgcctgagcttcccgagtagctgggactacaggtgcccaccaccacgcccagctaatttttttgtatctttagtagagacagggtttcaccacgttagccaggatggtctcgatctcctgacctcatgatccgcccgtctcagcctcccaaagtgctgggattacaggcatgagcctctgcacctggccacttattcctattttatacatgagaggcccaaggtgagacaaagtgatttgtgtagagtcagagataaagccaaaattgatacccagacagactgaaaaacttctctgtcagaaaatctagaaatggtaaagggagatcttcaaactgaaggaacatgataacacaaggtagctgggacagaaacaaaaccttaagggcccataatggtaaaatgaaagttaacataaaaaacttttttttggccagccatggtggctctttgggaggccgaggtgggtggatcacctgaggtcaggagttcgaaaccagcctgaccaacatgacgaaaccatgtctctactcaaaaatacaaaattagccaggtgtggtggcgtatgcctgtaatcccagctactcgggaggctgagccagaatcgtttgaacccaggaggcagaggctgcagtgagccaagatcatgccattgcactccatcctggcagcctgggcaacaagaccaaaactccgcctcaaaaaaaaaaaaaaaaagaggccaggtgtggtggctcacacctataatcctataatcccagcacttaagggtggctgaggcacgtggatcacctaaggtcaggagttcgaggcgagcctggcaaacatagtgaaaccctgtctctactaaaaatacaaaaacgttagccaggcacggtggtgtgtgtctgtaatcccagctactagggaggctgaggcaggagactcgcttgaacctgggtggcggaggttgcagtgagctgagattgtgccattacactccagtctgggcaacaacagcaaaactccgtctcaaaaaaaaaaagacttttttttctcttttcaaatttgaggggaaaaaatgtaattgcctatttaaagcaaaaacaaaaacatcatattgtggggtttataccatgtttcacttggacatgacacagcaacactaccaaccaagaacatgtgagaagcaggaagctacagtcagagcactgccccgcggctcaggcagtgtaataccatttgagagtgggcagtgacaagtgaaagatgtaactgaaaacgccagagatgatagatttaaacccaagtagtctaaagattccaaataaaaaacagaggttgtcagggtgaataaagaagcaagacctaattaaatgatacctgaaagaaatctactttacacatacacaaagtttgaaagtgaaaaaagctaaacctggcaaacacaccacgcaaacaccaaatcagaagaaaggagagtagtcagaccaaggtgacttcacaacaaagaatgtcaccggagattaagggggtcaaatttatgaatatggcgtaaaaatcctaaaagtgcatgcaccttataacattctcaaatacatgaagcaaaacctgcagagctgaaagaaaataatccataattagcatgagagatttcaattctcctcagaagaaagaggaactaagcagtgaaattgctcttcatgcctccccagcacaatggagatactcctgggaaataaagccagtcactggggctgatctcccagaacactgagactggcttctctgtaaataaatgactggtatttgctaggagaagtgtccttatctatgaaatgtttttagcaagatgtggttagtttaggattgtgtttggtaaacatacctaaaatccatggacttatgggacatggctccctggaaaaggttccctaaggtgtataaactatctgactacaaaacgggaacactgcacatccttaatgctccttgtgcagtgagatgacgacacacctcagtgagaggaccacacgcctcagtgagaggtctcatctcgcaggccgggctcaaagaggatggacctgcgggggttgcacagactctcccacatctctccccactttgcctgagcacacaagtgaggatattacttgtatctttaaagttactaagtaatcagctacgggtaacatctctgagattcatgtcaaactaatgtggtaagccaaccttgtgtgttagttcaactcctctcctaacagtgactagaacaagcaggcagaaaactatttcaagtcaaggatacctgaacactatcaacttgatctcactaagctttacagagcagcaaaatacactttttttttttttttgagatgtagtcttgctttgtcacccagactaaagtgcaggggtgcaatcgagattacaggcacccaccaccacacccagctaatttttgtatgtttcgtagagacagggtttcactatgttggccaggctggtctcgaactcctgacctcaagtaatccacccacctcagcctcccaaagtgttgagattacaggcaggagccactgcacccagccacattcttattacatgtgcatgaaacattccacagaatgcaccatattctggggcttcagacaagcctcagcattgaaatcacagaatatgttctctgactacaactaatttagaaattgttaacaggagatatttgaaaatccccaaatatttggaaatgaaataacacatttccaaataataagtgagtaaaagaagaaattaaaagggaaattagaaaatattttcaactgaatgaagatgaaaatgaataaacatttccaaatttgtgaaatgtggctaaacaatgcttagagggaaatttatattatagtcttgaacacttgttagaaaagacaaaaaatctgaagtcaatgatctaagcctttaccttaagaaactagaagagacagaagaacaaatggaacccaaagccagcagaaaaaaggaaataataaagagtaaagcagaaatcaatgaaaaagaaaacaaacaaaatcaataaaaccaacaactggttctttgaaaaaactcaaactgatgacttctaggaagactgatcaaaatcgaaagagagaaaatacaaggcacatttcagcaaatttctggataacaggtagtatatgctggtacttactacatgcaaaataatagcatacgcactttgtctggcctactgtactgatcccataataacctatgaggtaggtactactactaaccccaaatacgaatttttttttaagagacagggtctcaccctgtcacccaggctggagtgtagaggcacaatcatagatcactgcagcttcaaactgatggcctcaagcaattctctcacctcagcgtcccaaagtgctgggattacaggcgtgagctaccatgcatggtgtcactaattatttttatatatgtacatttacatatgtatgtccatgccaggaaagaaaagcctgaatatccactctgaagggataatagtggctaactcttagaggaaaactgaaattggggtgggcagccaggtgaaatttctgcttttataatcgatacatttttataagaaaacatttatttgatgtatatttttaattggaacgaaaatgcatcagacattttaaaaaattcaattacacacaaaaaagtaagcaaagaataaatatatgggttttactgggttggagaaagggaagagattatgaaagtccatccatgataaggaactcctataacccaaaacaaaaaactcaattaaaaaatggaattagctgggtgtggtggtgcccgcctgtagtcccagctactcgggaggctgaggcaggagaatggcgtgaacccggaaggtggaggttgcagtaagccaagatcatgccactgtactccagcctgggtgacagaacaagactctgtctccaaaaaaaaaaaaaaaaaaaagaaagggcaaaagggccaggaacagtggctcatacctgtaatacagcactttaggaggccaaggtgggtggatcacctgaagtcaggagttcaagaccagcctggctaacatagtgaaacttcgtctctactaaaaatacaaaaaattagccaggcacggtggcggacacctgtaatcccagctactcgggaggatgaggcaggagaatcacttgaacctgggaggtggaggttgcaatgagccaagattgcaccactgcactccagcgtgggcaacaagagccaaactccatctccccaaaaaaaaaaaaaaacaaaaaacgggcaaaggatttgaatagacatttctccagtgaatgtatacaaatggccaataagcatgtaaaaagatgctcagcatgactaatcaacagggaaatataaatcaaaacaatgagatgctgtacctactcacacaaattaggatggctatcatcagaaaacaaaaagtgttggtgagggtgtggagaaattggaaccttagtatactgctgcaagaatgtaaaacaatgtagccactgtggaaaacagtttactgcttcctcaaaaagttacacatagtgccaggtgcgatggctcacatctgaaatctcagcaactcaggagtctgaggcaggaagatcccgtgaagccaggagtataagaccggcctgggcaacacagtgagattctgtctctaattagtcaagcgtgatggctgggcaacaatgtcaatatatttaatgccaatgaactgtacacataaaactggttaaaacggtaagttacatggtatgtatattttaccacaatatttaaattttttaattagtttttaaaaaattgttaccaaaaaaatactaagaatccattcaagttatttagaaagggagtgtcagatcaacctttccaaagtgccaaaattcgcaagatcacctggttgcttgccccatacccagctgtccagaattgacttggccctatatataggtgcaggagtttcttcttcatcttttttctctttgtcattcagatctttctttgtcccacttggttcgacactatcatctgcagaattaaaaattttttaatctgtcaccgcttttcagaatgtcataccgttagcctctgcaaatgtccctccccgaaaagttacaacacacatgattaactgaatgcttgacaacttaaaaataaaatacatcaatcatacctgtaacagatccagtataattttcataaagaaaccaatatattggccgggcgtggtggctcatgcctgtaatcccagcactttgggaagccatggcgggtggatcaggaggtcaggatatcgacaccatcctggctaacacggtgaaacctcgtctctactaaaaatacaaaaaattagctgagcatgatggcaggcgcctgtattcccagctactcgggaggctgaggcaggagaatggtgtgaacctgggaggcagagcttgcagtgtgctgagatcatgccactgcactccagcctgggtgacagagcgagactccatctcaaaaaaaaaaaaaaaagaaaccaatacaacaaattatttaaaggatgtcttccaaaatgatattccatctacttcctagtacatttcttaactgagaaacttaagtctttcatatttacctacttcaatttcacaccaattgcttttatccagtgagtcccagtgcttgtgtatccatgggaaaagggagggtgtagaacaagagtatgattcaaaaatcttttaactctttacaaggccctactccactgccaactgggaagcactgctatgcaggggcactgtcactgctggcataattcaagagcactgggacacaaaggaaaagctgagaaaaatcactttaggccactgacaatgtcaagtttcagtcaaaaacaactgtcataaaactccttacacagtaagcgaagagaagagagaactaaccttaaccttgaagtgtaaacacattccatcacagaaggctgtgactaaatgtctaacaacataattagaaaaatgtatctcaatcggggaaagacatgatatcccatccagattacaaataatgactatctaaaaatctcgaaggaaacagttcctctgtttataacacttctgacaccaaatgtatggacttttgcaccaagcaattctccagttctctgcgacacccagctttgtgtcccacagtgcaattcaattctgaaactaactacctagaattagcacagaccccacaggttaataacaagagagaaaaggtgaatgctgaaaaaaatatccaaagaactaatggctgaaaacttcctaggttcagcaaatgacataaacccaggcagactgaagaatctgcacaaagcccacacaagataaatccaaaggaagccatgacgaggcacatcataatcaactgctaaacactaaggacaaaaccttttgaaaagtgccacggaaagtagatacagaagaatttctcgtgtggcctgaaattaagactaaatattacgtgctgccttgacattggtaaaatcaagaaggcctcaaatagcctaaccacaaggtctcccctgagctctgctctcacggataagatcccaaagccaaacaacctccttatcgcggaaacccgaccccagcctgctcatccctgccggcccagagttattcaaacaagccagtcacatcttcccatggaagcaaggtcatctcaccctcctgttactacaaaatgtgcctcccacagcccctcgtggttcgctctgttcccaagtgcagcccccgtgtggcatgcggtgtcccccaccccagggctgtgagcatgcgtgactaataaactgctatttcatctgtccagtgtcggtgtcctacgttcagccatcccatatccctagggcaggaatcttctagggttataaacagaactttaatcaacctctccttggttattttactggttccatgatacagctttttctgtgcaaaagatctgaacagaaactcacagaggatacaagagtggcaaaaaagaacatgatattcagcattgttagccattacagaattgcaaattaaaaccacaatgagatcccactagacttgttagaatggctcaactaaaaatcactgataacaccaagtgctaacaaagacacagagcaacagaaacgtgacagattgtcagcgggaatgcaaactaaaacagcctccagtttaccaaggtagacacctcgagtcacagaatacagagtagaacccagccaggaacacggctcaggtgagaacacaggtgctggctctgaatgccagactctgccgtgtgtgtgtgtgtgtgtgtgtgtgtgtgtgtggtcactaaccacagcccacaggacaaacccagcccacagcctttttgtgtatggtctgaacacagagaaagtattttagttttgttgttcttttgagatggagtcttggctcaccacaacctctgcctcccaggctcaagcgattctcccaggttcaagtgattctcatgcctcaacctccgaggagctgggattacaggggtgcatcaccatgcccggctaattttttgttttcagtagagatggggtttcaccatgttggccaggctggtctcgaactcctgacctcaggtgatccgcctgcctcagcctccaaaagtgctgggattacaggtgtgagccaccacgcccagccaccgtattttatagtttttaataattgaaaaataatcaaaagaaaaacagtattttgtgacttgcaaacattctgtggacttcatcttttcgtgtccataaataaagtttacagaatgaacgtccccagcccgctgacgtagtattgtctgtggctactctggcactacagctgcaaggtcccatggctatgacagagaccatagggtccattgagagcttaaaatatttactatctggccctttacagaaagtaggccacccctaccctacatctggctataaattttacaaatttgacaaattctgagaccctgtctcagaaaataaaataaaatattcatagtcttaataatggaaaacaaaaacatttactgaatgccaaaacatctccctaacaatcccaatcagttgggatctacataaagaacaattatgctctgctttccaaccatgatttttaaaagaacaaaagacaaaaaaattcatcaaatgtgggctgggcatggtggctcacacctgtaaacccagcactttgggaggccgaggtgggttatgaggtcaggagttcaagaccagcctgaccaagatggtgaaactccgtctttactaaaaattcaacaattagctgggcatggtggagggcgcctgtaatcctagctgagtactcaggaggctgaggcagagaactgcttgaacccgagaggaaggggttgcagtgagccaaaatcatgccgctgcaccccagcctgagcgacagaacaagactccctctcgagaggaaaaaacaaaaaaaattcatcaaatgtaatgaataaaacatatactttggattttgccatgtacttagcttttcttagagcaccttttagaactattgtttcacagaaaacactttgggaaacgttttaatttataaacaaatactggagggctaggaagaagaggttaaaactttttaaaatatacagaatgaattactgatacagaaaaacaaaaaaaggttgctgattcctgtcttggaagacactgtcatatggacactcttagcctcagcatccagaggtccagaaagggaaaatttcaagtcagagagaattctatatataccacttacttggaacattcagccctcaaaatcccaacatcatgacctcagtttcaacacaattgtccttagtccttatgtcactgcttttggtgctgcctgctgtcaaggcagtggaagccagtgatgcaactgctctctcgttaaaaggtgtggttctcagtattacaggtgtttgtacttgcttgcgggtatacgcacgaaagataaaaatgaacagatgtgactttgaagggcctaatgaatgaaacctcaccctgaaaacctttgtgctactgaaactaaatgtaagctttggtgtctgaaagtttccaagaattagtaagtaggagagttttactttctgagttgattccatgaaatgggaacaaattggtacataaatggattttgcccagaatcctaggaaatcgccactgttcagtcgtaatcactgcctcctaaatcactgagtctgttctctgtatttttattagacttttgtcatctcccaaattcagatatccaatagtcagccaaaaagggaaacttttatctctggaaagaaaaaaaatcatttagaaaaatgtattcagtgtatctaatactgaaatggagaaaagacttaatgttaaagaaaaaaaaaacactatagacattgacatggaaaagagatttaatgttaataaaaactttatattaactgagtaacacctcctgatgagaagtgctatattaaatataaacccattatgttgtttaaaaaaaaaaaacatgaaaatcaaaagcactaaacagagtgaaagaagccaagacacagaagaacccgactacatgattccatgtatggagttctagaacaggcgcaatttgtcaatgctggagaaacatcaggccagctattgcctctgggaagaaggggcaggacaccagagaactttctgagcaagagtcatgataaagatgtgggttacacgggttacatttgtcaaaacttgtgaaatggtaaactcaaaatagatacatttcattatatataaattttacctgaaagtcaaaaacaaagttgaactagaatcaattacatacatgagtgtctaaggagctaggtgagacaaacggtggatggacagacagcaggatgtggagccaaatacggtggcagaacatggaggtgggtctgcagccactcactgtacacgtctgtcagttattgtgtgtgtgtgtgtgtgtgtgtgtgtgtgtgtgtgtgaatattttcaaacaaatataaaaaataaattaaaataaaaacacaggtaactctgcttgacactgaaactgaagagggagactaatactttttcccatggtttgttttgtgttttttgtttttttttttttgagatggagtctcactctgtcacccaggctggagtgcagtagcacaatatctgctcactgcaacctccacctcccggctccaagcaattctcctgccgtgccctcccaagtagctgggattacaggcgcccgccactatgcctggctaatttttgtattttttagtagagacggggtttcaccatgttggccaggctggtctcaaactcccaacctcaaatgatctgcccgcctcagcctcccaaagtgctggaattacaggcacgatccaccgcgcccggtccccaagtattttcaagtggacaccatcccaattcattccacaaaagaagaataaatacttgccaggcacggtggctcacgcctataatcccagcactttgggaggctgaggcgggcggatcacgaggtcaggagattgagaccatcctggctaacacggtgaaaccctgtctctactaaaaaatacaaaaaattagccgggcgtggtggtggacacctgtagtcccagctacttgggaggctgaggcaggagaatggcatgaacccaggaggtggagcttgcagtgagctgagatcgcgccactgcactccagcctcagcgacagagcaagactccttcccaaaaaaaaaaaaaaagaagaagaaatactttcttcagactaatgctctcccaactgagctatttcaacttagaataaatactttctaaagtggtagctttatccacgttgatgactctcaagcagggggaccaacgaacttcaacagtggttctcaaccaaggatcttttcagattcaacaagtttagggtgtatacaagcatccatttttttaaacctcaatggggactctgaaacacagccactgttatgaacaacctaatgatagtcctattgagcatgcaaaactacaacgctaaataagattgttcaatggcatttccttgcaggccaaaggcttccaataagtgtttaatacacccccaaagaacaccacaaatgcagcaagacggttttgcaataaaaatgccttcaattcacgtaaaacaataaaatccgggcagcttgtattaactaccattttagacaacaatctccaaagtaaaaagcaaaacttcaaagagttaagctcaaagctcctgttcctatagcacattacaaaatttctataaaatgcattttataatggtctttaccaaataaaaaacactagttaaaggcccttaccttttccaggagggagctatccgttctgggttgattctgttccagtgtatacaatttctccatctttaaccatttcattccacagaccacagagcccatctcttgtgaatgcaagctggcaatgataaacgagataagctcacactcacactgcaatttttaaagaatgatatgggaaaaaatctcaatcccccttatgtattcgatcattcggtaataaaatcaatgatttactgaattagtgacttaatcattttacatttcatgaaagtcatccaagaaatataaatgaaaaggtgcataatagtataaatactattctacctcttatgtaacatacaagaaaaatgacacgtggtcaggcgaggtggctcatgcttgtcatcccagcactttgggaggccgagcggggcacatcacgggggatcaggaatttgagaccagcctggccaacacggtgaaacgccgtcccaactaaaaatacaaaaaattagccaggcgtggtggcgggcgcctataatcccagctactcacgaagccgaggcaagagaattgcttgaacccaggaggcagaggttgcagtgagccaagatcgcgccacagcactcagcctgagttgataagagcgagactcggtgttaaaaaaaaaaaaaaagaaaaaaaagacacacacacaaacacacacacgtgcatatgctctgaaaagataaaccgaaagcaagtaccaatgactacctacggggaaatggggaggggacatggacaaaggcagcaggaccagaaaaagcaacaacattgtgagtatactttagatgtctttacttctgaaacatacatgactttcatcctcaaaaattaaaattaaatcataaaaaagcaaaacctacaactggcaacaagcaaattaacccatgcatatacaaagaaaagtatgtcaagggacttttgaactacatatcattaatagaatatactataatgaaaaataaaatatttatcggtattgataacactctcacaattttagaactacttcatgttgcacaataaagcagtgtaaatacaataaaacatgtttatgataaagtattaaatgttctcagaaattaaggttttaggccggccatggtggctcacacccgtaatcccagcatttggcaggccaaggcaggtaaatcacttgagatcaggagttcatgaccagcctggccaacatggtgaaaccccatctctactaaaaatatgaaaaattagccgggtgtgctggtgcatgcctgtaatcccagtcactcgggaggctgaagcagaagactagcatgaacccaggaggcagaggtttcagtgagccgagattatgtcactgtgctccagcctgggtaaacagaacgagactccatctcaaaaaaaaaaaaaaaaaaaaaaaaaaaaaaaaaaattaaggttttcagtggaaaagaggaaaaaaaatcaaagaaattttgaaaaacaacttaaattggaaatctatgaactttatttttgaatatatttgcttactctgttttttaaaggactagaatcaaaggcaatctgacagcggcacccagattttggtctcttagaaccatttcccgataaaagacgctagggctcttgggaaaataagtagattcaagggccagggcagacaaagatgagcctgtttcctcaaagaaaaagctgtttcctcaaacatggccaggtgcggtggctcacgcctataatcctagcattttgggaggctgaggcgggcagatcacttgaggtcaggagttcgagaccagcctagccaacatgccgaaaccccatcttttttaaaaatacaaaaattagctgggcatggtggcaggcgcccataatcccagctacttgggaggctgaggcaggagaatagcctgaacccaggaggcggaggttacagtgggccaagactgtgccactgcactccagcctgggtgacagagcaagactttttctcaaaaaaaaaaaaaaaaaaaaaaaaaaaaagcagctgttcaaagatgatagggactcctggccaaatttataataattataataactgtgagcatcaaaatcaaaaacgcctttgcttgtcaacatttgtgagtcagaaaaggcttcccagaacaggaaaagggagcatttcagacactgggggaaggcatccattctgaaaactgcgtatgtgacagaagctcccttgtctggcaaaacaaaagccatttttaattaaaagagacagatgtttgcccatcttttttttttttttaacttctgtggatacacactagttgtatgtatatatatatgggttatatattctatctaactcttttttttttttggagacggatctcgttctggcactaagctggagtgcagttgtgcgatctcagctcactgcaacctttgccttctgggttcaagggtttctcctgcctcagcctcccaagtagctgggactacaggctcacaccaccacacccagctaatttttgtatttttggtagagatggggtttcaccgtgttggccaggatggtctgggtctcttgacctcatgatccacctgacttggcctcccaaagagctgggattacaggcgtaagccactgtgcccagccctatctaactccatttttatacccattaaccatccgcacttcacccccactttatccttcccagtctctgataaccatcattctactctatctccatgagttcaattactttcatttgcttagcacctacaaataagtgagaacatgcaaagttcgattttctgggtctggctcatgacattctgttcctgacttaacataacgacctccagttctatccatgttgttgcaaacggcagtatcccattctttttcatggttgaatagtactccgttgagtatatataccacattttcttcatccattcatctgctgggaacacttaggttgcttccaaatcttggctattgagaatagtgctgcaataaacatgagagtgtacatatttcttcaacatactgatattctttcctctgggtatatacctaccagtgggattgctgaatcatatgatagtcctatttttagttttttgaggaacctccaagctaatctccataatggctgtgctaatttacattcccaccaacagtgcacaagggttcccttttctctatattcttgccagcatttgttcttgtcttttggatataagccattttaattagggtgagataatatctcattatagttttgatttgcatgtctctgatgaccaaccatgttgagcacctgttcgtactgcctgtttgtcatttgtatatcttcttttgagaaatgtctattcaaatcttttgcccattcttattggattattagatttttttcctatagagttgcttaagctaattatatattctggttattaatcctttgtcagatgggtagtttgcaaatattttctcccattctgtgggttgtctcttcattttgttgattgtttcctttgctgtgcagctttttaactcaatgtgatcccacttgtccattttagctttggttgcctgtgtttacgaagtattactcaagaaatcactacccagtgcaatgtcctggagagtctccccaatgttttcttttagcactttcatagtctgaagtcttaggtttaagtctttactccattttgatgtgattttcgtatatggtgagagatagtggtctagtttcatttttctgcatatgggtgccccattttcccagcaccatttatcaatgaggctatcctttccctcatgtatcctccgggcacctctgtcaaaggtgagttcactgtagatgtatagatctgtttctgggttctctattctgttccattggtctaggtgtctgtttttataccagtaccatgctgttttggtatacctttctagtaaactttgcacttgatctaagccaaaaaagaccaggaagtgactgtagtataattttaagtcaggtaatgcaatttctccagttttgttttttgctcaggatggctttggctattctgtctcttgtgattccatacaaatttcaggatttttttttctatttctgtgaagaatgtcattggtattttgatagggattacattgaacctgtagattgctttgggtagtacagacattttaacaatattgattcttccaatccatgaacacagagtatcttttccttttctgtgtgtcttcttcaattttctgcatcaatgttttacagttttcgtggtagagatcttttcacttcttgggttaggtttattcctacgtattttactttatttgtagctattataaatggaattatttttcttgatttatttttcatattgttcactgttgacatatagaaatgctactgatttggctgggcaaagtggctcatacctgtaatcccagcactttgggaggccgaggcaggcggatcacctgaggtcaggagttcgagaccagcctggccaatgtggtgaaaccctgtctctactaaaaatacaaaaattagccaggcctggtggcaggcgcctgtaatcccagctactcaggcggctaacacaggcggatcgcttgaacccaggaggcagaggttgcagtgagccgagattgcgccattgctttccagcctgggccacagagtgagactccatctcaaaaaaaaaaaaaaaaaaaaaaaagagagagagaaatgctactgatttttgtatgttaatttagtatcctgcaattttactgaatttatcagttctaatcattttttggtggagtttttaggtttttccaaatacaacaatcatctgcaaacaagagtaacttggcatcttcatttccaatttggatgccctttatttcttcttcttttttttttttttctgagatggagtcttgctccatagcccaggctggaatacagcggcacaatctcagctcactgcaatctccacctctggggttcaagtgatttccctgcctcagcctcccgagtagctgggacaacagacacccgccaccacgcctagctaatttttatatttttagtagagatagggtatcaccatgttggccaggcttcaaactcctgacctcaagtgatccactcacctcagcctcccaaagtgctgggattacaggtgtgagccactgcacccggcctttctctctcttatctgactcctctagcaagggcttccattattatattgaataacagtggtgacagtgggcatccgtgtcttgttccagatcttagaggaaaggctttcagtttttcacctttcagtatgatactagctgtgtgtcagttgtatatggcttttattgcgttgaggtgtgttccttctataaccagttttttggggtttttatcatgaaaggatgttgaattttatcaaatgccttttcagcatgaatttaaatgatcatatggttttttatccttcattctattgatatgatgtatcaaactgattgatttggatatggtgaaccatcctggcatccctgggataaaccccactttggtcatgatgaacgatgtttctaatgtgttgttgaattcggtttgctggtattttgttgggtatttctgcatcaatgttcatctgggatactggcctgttttgtttttttgattatgtctttgtctggttttggtatcagggtaatattggccttctacaataagtttggaagtattccctcctcctctatttttcagaatagtttcactaggattggtaatagttcttctttaaatgtttggtaaaattcagcagtgaagtcactgggtcctggggtttttctttgctggaagactttttattattacagtttcaatctcattacctgttattggtatgttcaggttctggatttcttcatggttcaaacttggaaggctgtatgtgcctgtgaaattatccatttctttttccttctttttttgaagacacagtctcactctttcacccagggtggagtgcagtaacatgatctcagcacactgcaacctccccctcccagggctcaagtgactctcgtgcctcagccttccaagtggctggaattacaggcacgcaaaaccacacctggttaatttttgtatttttagtagagatggagtttcaccatgttggccagactggtctcaaactcctgacctcaagcgatccacccgcctcagcctcccaaggtgctgggattacaggtatgagccaccacgcccagcctgcaaacttatctatttcttccacgtttcccaatttattgacatatagctgttcatagtctctaatgaccctttgaatttctgcaatatcagttgtaatgcctactttttcacctctgatttgggtcttctttttctcttagcctgcctgaaagcttgtcaatttatcttttagaaaaaccaacttttcatttcattgatcttttgtattattttcttcatttcaactccattttatttctgctctaatttttattatttctgtccttaaaattatgggtttggttagctccttcatttctagttctttaagatgtatcattaggttatttatttgaagtttttctacttttttgattttcctcttagtattgctttcactatatcccacaggtttcgtatgctgtgctgccattgccatttgcttcaagaaattgtttaatttcattcttaatttcttcactgacctgttggtcattcaggagcatattgtttaattcccatgtgttggtggagtttccaaaattcctcgttattgatttttagttatagtccattgtgatcagagaagatacttaacataatttttttaacttttatatggcaaaagaggaatctagcttcattcttctgcatatgaatatcaagttttcccaacaccatttattgaagagattgtcttttccccagtgtttgttcttggtacctttgtcgaaaatgagttcaccgtagatgtgcggatttgtttctggattctctattctgttctgttggtctgtgtctgttttatgctagtactatgctgttttggttactatagctctgtagtataatttgaagtcaggtaatctgattcctccagtttgtttctttttaattacgagagcttcggctattctgggtcttttgtggttcaacatgaattttaggattttttttttttctgtttctgtgaagaatgtcattggtattttgctagggattgcactcaatcggtagattgctttgggtagtatggacattttaacaatattgattcttccaatccatgaagatgaaatatttttccatcttttgtgtcctctttaatgtctttcatcagggttttagagttttcattacagagatctttgtaattatcttctttggttacttcccaggtacttaatttcatgtgtggctactataaatgggattagttttctaatttttttcatattgtttactgttggcacacagaaatgctactgatttttgtatgttgatttcgtatactgcaactgtactgaatttatcagctctaatcattttcttgtggagtctttaggtttttccacatataagatcatatcatctgcaaacaaggataatttgacttcttcctttccaatgtggaggccttttatttctttctcttgtctgattgctctagcaagaacttccagtactatgttgaataacggtggccacactgagcatccttgtcatgttccagatcttagaggaaagactttcagtttttcaccattcagtatgatactagctgtgggtctgtcatatacggcttttattatgttgaggtatgtttcttccataatcagttttaagagattttatcatgaaaggatgttgaattttatcaaatgccttttcagcatcgactgaaataatcacatggtttttatccttctgttgacatgatgtgtcacatcgattgatttgcatatgttgaaccatccttgtaccccagggataaaccccacttcatcacaatgaacgatctttctaacgtattgctgaatttggtttgctagtattttgttgaggatatttgcatcaatattcatcagagacattggcctgtagtattctttctttgacgtgtctttgtctgcttttagtatcaaggtttcaatttttaatgacttattttgtggcctaacatatggtctaaccttgaggacgatccatgtgctaaagagaacaatgtaaattctgcagccatcagatgaaatgttctagaaatatctattaaatccatttggtctacagtgcagattaagtttgatgtttcttcgttaattttgtctggatgatctgatctgtccaatgctgaagtggagtgttgaagcctccatctattaatgtattaacgcctctctctctctttagctgtaatatttgttttatgtatctgggtgctctagtgttgagtgcatatatacatatatttataatagttatagcctcttgctgaattggcccctttatcattacataatgacttttttggtctccttttatagttttggtcttgaaatttatttggtctgatataaccgctatgctcttttgtgatttccatttgcctctccctttttccatccctctgcactgtcctgaagagatggtctccaatctgaagaagcaagcagccaatgaactgcctgtggggaggggcagcctccaagagcccagggtttcagtcccacaaccacaatggattcaattctaccaatgaggacctgagctccagatgacagcgtgccctagccaacaccttgactacagcctgtgacacctgaagtagaggatagaactaagctatggccagactcctgacccacagaaactgtgagagtgtaaatgcttgttgttacaagctgccaaatttgtgtttggtaacttgttctgtagcgacagaaaccaagccagcatccttcagtttttgtagaaggaacagctttccctcagcactgttattttttctgttcacatcactaacaggataactgccataaacatacttggaaccaaaacatatgacttttggtaaaaatatcagctggtgggggagaggtaaactccttcctaaaaagtgagccctggccagatagagtgactcacatctctaatcccagcaccttggaagactgaggcaagagaatcacttgtgcccaggagttcaaaaccaatctaagcaacatagcaagaccctgtctctacaaaaaaattgtaaaattggccagaaagctgggcatggtggctcacacctgtaatcccagcacttgggaggccacggcgggtgaattgtttgagctcaggagtacaagaccagcctgaacaacatggcaaaaccgcatttctaccaaaaatacaaaaaattagccagaggtggtggcgcgcctgtactcccagctacttgggaggctgaggtgggagaactgcttgagaccaggaggtagaggctgcagtgagttgagatcactccactgtactccagcctgggcaatagagcaagaccctgtcaaaaaaaatttttaatttaaatttaaaaaattaaaataatataaaaaataaaattaaaaagtgagccaaaaacattcagggcccctgaagtttaacgagtgaatggaaagctttgactcttctagtcttcagtcagaggagagcagtgaatacgtgcactggggttcagtccaaaccctaccacaatgcacatgataagaggctaacagtggtcagaactcacagctccatgtgggccgtgctccaggagtttcagactatctttaggcactcaagggaatacgacatttgacccgtgtcttaaagtgtttcagaaaacagaaacagagaaggtgaactaagaagctattactggccaggcacggtggctgacgcctgtaatcccagcactttgggaggccgaagcgggtggatcatgaagtcaggagataaagaccatcctggctaacacagcgaaaacccatctctactaaaaatacaaaaaattagccagatgtggtggcaacgcacctatagtcccagctactcgggaggctgaggcaagggaattgcttgaacctgggaggcggacgttgcagtgagtggagatcgcaccactgcactccagcctgggtgacagagtgggactgcatctcaaaaaaaaaaaaaaaaaaaaaaaggctattaccaagtgtccaaaaaagaaaggatgacagcagaagtcaacacagggaagtacagtctttaagattatttcaggcagggcacggtggctcacatttgtaatcccagcagtttgggaggccaaggtgggcagactgcttgagcccaggagttcgagaccagccagagcaacatggtgaaacccggtctctacaaaaaatacaaaaattaaccaggcgtggtggtacgcacctgtagtcccactactcagggggctgaagtgggaggatcacctgagcccggggaggttaaggctgcagtgagccgtgacggtgccactgcattccagcctgggcaacagagtgagaccctgacttaaaaaacaaaaaaagaaactatttcaaatcacgtaagttaaatcaaatgtgaaagggaaaataagggagggaacagaagaggaatgagaattagttccgttttaaccactaagatttgcactaactactgaacataaacatggagctcctccccactccaccaaccctcagtaaatatagatccagatcttagcagagtgttcagggctagagactcaaatctgggagtagtcaacaaatggactgtaggtgatgtcctggagaagatgccaacacccaagcagagaggggagacccctgcccagccctgaaagcactctaagatcgccccagactggctgggctccacacatcagtgttctgcggtacagcctagattgagaaacattagtgttacagaggtaccatttaaaaaaaaaaagccaaaagatggaacatttaaagactaagccaaagaggaagcccagtttacatggaaacaagaataattaccaccacctttcgattattacctgggtagcactgggaaggaagaggataggccagaccttgtccttctgagtaacaaggaattcttttttggaaggtagacactggactcctggaaggacatgcactgtggaagcctcctaggaactgatgacccaaataaatggtaagcaccattcaaaaaactatttgggcaccttaaaggtggaacattactaaggcaataaagcaagcctcactggaggaggtctccagagagttagactctgaacaagcaaaagtgaagcccagaagagctctccagatcacaaacagtacaggatcctgactgaggaagcagcagcctgggaacaactggaagacagccgtggcactgagaagaatggagactacaggcagggcgtggtggcccacgccgtaatcccagagctttgggaggccaagacagaagaactgcttgaggccaagatttcaagatcagcctgggcaacatggtaagaccgtgtctctacagaaatgtaaaaattacccaagtgcatggcacgtgcctgtaatcccagctactcaggaggctacagcaggacggtcacctgcacccaggagtttgaggttacagtaagctctgatcacaccacagcattccaacctgggtgacagagaccctattcatttaaaaaaaaaaaaagaaagaaaaagaaaaaaatgaatgggactttccatttgtaaagtgagagtatttatttctacaactgtctccaattagctttttattagtagctgacttacctaaacgtgcccagtagcttttcaacttttgacttttttggttcagatcccagaagcttctaattaggttatttgggctaagaactcttttccaatcttttccaatctcacattcctatcttacacctctgaaatgacatggcaagtaaaggcactttcatcgtcaaaagaccccagcaaaagaggcagtaacaggctcactttttgtaagttactaaactgaagctcagaaggccaatgacttgaccaaaggccacacaacactgaggctgtgagaggcgggatttgggaagaggcccaactccaaggcttattcgcttcccaccaacaccataacatgcacccacacctgcagcacggcagccagggcaagccttcacgctcccatacataggccaccaatattttaataccaatcaggactaggcaagcaaacagttaaggcatttttttttttttttttttttgagacagagtcttgctctgtcgcccaggctcgagtgcagtggcgccatcttggctccccgggttcatgccattctcctgcctcagcctcccgagtagctgggactacaggcgcacgccaccacgcccggctaattttttgtgtatttttagtagagacagggtttcaccgtgttagcctggatggtctcgatctcctgaccttgtgatccacccgcctcggcctgggattacaggcgggagccaccgcacccagcccgttaaggcatttattaaagtgacttcagaactatagagtcaggcaataaaatccaaaactgaataatataacaaatgaatatctgattaatgtataggttagaaaatgtttctttttcatgtccttacaatttgacagaaaagtaatcttcaaatatttgcagatgagtaaaggtatacggctttttttcttaaacctacagaaaaatactaaacacctactgaacgtaggacaacatatgaaaaaatgttaagaacaggttcctagaacaattagaaaggtcagacaggaacattaagtacgtcgatttgaagacatcctagaagcagcaagggagtgaggtcttcctaaagtctaagacccacgagaggaagaaagaggcccagagaacctaagcacgcagggatgagactgagaagcaaaacggagcttctgagagactcccagggccctcatacaggagaaagaggcctggcagatcccatgctctgagctggaacctcaaagggccacacaccagaaatacaggtgagttagaagtagaccagccttcacggaaaaccagcccagtttcgcattctctcaatttccaaagggactgcagtgacctgggattgcctagaacatcctctctggaggaagatattgttacctagagcctcgatttattgctacaatattgcatatacaatatctgaaagtcaagcaaatataataatgacaaagatacaagaccacatcattgaaaaatgaaaaaaaaatagaagtcattagaacagactgagtagatcctgaaaacagaaacataaagacttctgtcatgaaagaagagcctgaggaatgaactgaagtgttgacactctgctcagcagatgtcagctcggggcaatggggtgagggaagtgggaaagcgagacaaggagatcaatgaagtaacgatatgcagtatatgacttcacagtcagctaagtgtgattttagcctactctgcctatgtaggagccattcttatttcctttaatttcctaaaaaaagaaaaatatatattaaaaaagagtgattttatatttttcaatggttgcaacataatcaaaagaatcatatgtcagccaagcacggtggctcacacctgtcatctcagactttgggaggccaaggcaggcggatcacgaggtaaggagttcacgaccagcctggccaacatgatgaaaccccatctctactaaaaatacaaaaaaaaaaattagtgaggcatgatggtacacgcctgtaatcccagctactccagagtctgaggcagaacaattgcttaaacccaggaggtggaggttgcagtgagccaagatcgcgccactgcactccagcctgggcaacagagcaagactccctctcagaaaaaaaaaaaaaaaaaatcatatgtcaacaaatgaaaattatatgacattcaaattctggtatccacgaagttttcctggaatatagccatacacatgtttggcagcttctcgcaggacaatggccaaggtgagctgttctaaaagagcacgtacggcccacataaacatttactatctggtgctttacagaaaaaatgtgctgacccctatgttagtgccacctcttctcaatgagctgcaaatacaaccaactgttcagccagcacattcactaggcatatgtggcttttccagaaggtttgcaagaagaaactacaccataaaatagtccaaagaggaaagaaaaaagggaggaataaaaacactgagttccctcatctctccttgtaaagtggtgaacgttcataccacaaggaattcacacccacacacactcgccacaccttccaggctgtgtcactggctccttggtaggcagtcaggaagccatactccaactctcttgcgtgacatcacagcggagactggagccgaagggcggctcacaggcatgagtcagccaagagggacagagagaggcggctaaggaatctatggggtcggacaaggtttataaacacacttttaaaataactacctttaatagagtcaagcaattaaaagatcctattaacagccgggcacggttcatgcttgtaatcccagcactttgggaggccaaggcaggcggatcacgaggtcacgagttcaagaccagcctggccaatctggtgaaaccccatctctattaaaaatacaaaaattagccaggtgtggtggcaggcacctgcagtcccagctactcgggaggctgaggcaggagaatcacttgaacccaggagatggaggttgcagtgagccgagattgtgccactgcactacagcctgagcgacagagcgagactccttgtcaaaaaaaaaaaaaaaaaaaaaaagatcacattaacaatttcaacacagaagttgaaactagaaaaaagtacctaaagtggcagttaaagaaactgtcaaacatttcaaactaaacattttaaagggatgtgtttaatataattatacctcaataaagttgatatgtttaaaaaatggaaattctggaatagaaaaatataatagtaaaatttaaaactcaatggatttgattaaaaacagattgggaaggcctgtgcttcctccacctataaaggatgaattctgtagaaatcacttccttgctataatcaactagaaaaccagacagaatataccgaaaagctgttaccaaaaactggacaacagacagcccagagctgggatccctgagagaagggaaacactgcccagaagcagcttccaggctgcagcacaggaaaggggaacccaaatagagcccaaagaacttgctgagctcaggagacagatcagctatacgtaggccaaatgacaagaatacagcaagctccagagatgagtggaggggccccttgagtatctgtctgagtactactctgagcataggttaagaaaactatggaatactggggaaagcagcactagaaagtaataagcagcactgccatgatgcacagtctgggaaaagcctgtgtttccacaaacaaggaaagaaagatcttctcatacaccaagcatcaggtggagtcctgagaacagtattgccttcgttgtatggataaatgagcccaagagtaaagcctgtgtggatcagcctaacaaacctcagaatcaagctttgaaaagatcaaactgaccccatgtaacttacatgtatggcagaagaaaactaaggctctttaaaaaaataaaacaaaatcctgcacagaagataaaattaatgcctagcattcaatcaaaaattagcaggcatacaaccatgcccccataactagggcaatcaatcaatagaaatgacagaatcaatcaacagagatggatctagaagtgatcagagattacagaattcacagacaaggacattaaaagctctcttacagaaatgctccctatactaatagaaggaaagcatgaatgttataaggagtgaaacagaagatataaaaaggactcaaatggaatctctagaaatgaaaatacaaaatggatggatgagattaacagaactgcataacagttacaaccataatctacaatgtctaagcacatggctatgccatgctctctcccttaacactcatgcagtctaggtttaacaaataactgtttcatgcccatcatcagttgcaggttgatctacagtcatccagttgtctaaagatctttctccactccattcctaaggaagggctcatgagaacaatacttcctaagttacagctcactgagaagtttgtgtgtttttcatctgaaaagtcggttttgctggaacaaaaaatgctttactcacattttcttttcttgagtgccttaaacaggatactcaatttcttcttcataaagaattgtcatctgctgggctcagtggctcactgctgtaatcccaccactctgggaggccaaggcaggtggactgcctgagctcaggagttcaagaccagcctgggcaacatggtgaaaccccatctctactaaaaatataaaaaattatctgggtgtggtggtgcacacttgtaattccagccacttaggaggctgaggcacgagaatggcttgaacctgggaggtggaggttgcagtgagctgagatagtgccactgtactccaacctgggcaacagagtgagactctgtctcaaaaaaaaaaaaaaaaaaaaaaggaattgtcatcaaagtcctacggctaaacccttttccttttttttataacaagtattgctagtcttttccaagaaccaaagttaaaagttagttctttaaaacaccaggccaggcacagtggctcacatatctaatcacagcactttgggaggccaaggcaggaggatcacttgaatgcagaagttctagaccagcctggacaacaaagcaagaccctgcctctacaaaaaacttttttttttgctgcaaaatgctcttaattaacctgacaaaatgccacatacagggttactgcatcttttttatcatggaattttgaaaacaaaaattgttctcttgaggcagcagtatttggatattagaggtaaaaaccacccttagaatccagtcctaaaaacatcaatgaatattcctatatttacaaattcttctatttctacatgtcatctatcaacaggattatgaacctgaaagcctgagaatagaatttatcaagatactcatgtttgtactttttttatctactgcccttttttattttttttgagacagattctcactctctcaccaggctgtagtgcagtggcgcgatctcagctcactacaacctccgccacctgggttcaagcgattctcctgcctcagcctcctaagtagctgggactacaggcacgtgccaccacacccagctaatttttgtatttttagtagagatggggtttcaccatgttggccaggatgatctcgatctcctgacctcagcctcccaaactgttaggattacaggctaagccaccacacccggccatctactgatatttctaagcatgaagtgacattttttttttttgagaaggagtcttgctgtgttggccaggctggagtgcaatggcatgatctcggctcactgcaacctccaccttctgggttcaagcagttctcctgcctcaacctcccaagtagctgggattacaagcgcacaccaccacacctggctcatttgtatttttagtagagacagggtttcaccatgggggccaggttggttttgaactcctgacctcaagtgatccgccctcctcggcctcccaaagtgctgtgattacaggcgtgagccaccgcgcccagccgaagtgacaatatttatatacaataagtttaactgtaaaagcttacatttatgcgtggtcatttttaattgatgattagatgaagagacaaataaatggtcccagtttagctactgatatactcaacaaaccttgacggacctgagggcattatgctgagtaaagaaaatcatttccgaaggtcacatatcacttggtaatctcacagtaacaaaattatagagatggagaacagatcagtggttggcaggagttagagatggtggcagaagagaggcaggagagagatctttctggtgatgaaacagttctgcataggaaattgtagtagtagttatatttacagacacttgatagaatggcacagaactacgcacacacattgtaccaacttcaatttctgggtttttatactctattatggttacataaaatgtaaccactggggcagtatgcgcaaatatacaatgacctctctagtttctttacaacttcctgagagtctattattatttcaaaataaaaagtttttttaaaaattgcttcatgcatatctagtttcatgtgccacttaaaaaagaacccaaaaatagaaactgtaggaaattcatctgagtgcagcttatgcaagaaggggcaggataactccattctggacctatgctcaaagacatgcacctttaccttacaacaaaactggcgaacaggcatgtgttttaagaataaaaagcttttaaggtctcatatattggtttttatgattcctttgcttaactgactttttggtttgctaaaaaactaccaatcacatcagattagaagtactttcacggtaaaaataaaaagtgatgtgactgacacctcttacctctgtaatgtattactcttcacgagagcagtgaaggaaaacatggtgattcaatcactccacacatcaagcagaaaagagtgttgaacaggccgggcgcggtggctcacgcctgtaatcccagcactttgggaggccgaggcgggtggatcacttgaggtcaggagttcaaaaccagcctggcccacatggtggaaccctgtctctactaaaagtacacaaaattagccaggcgtggtggtggacacccgtagtcccagctactcgggaggctgaggcaggagaatggcatgaacccaggaggcttgcagtgagccaagatggcaccactgcactccagcctgggagacagagtgagactccgtctcaaaaaaaaaaaaaaaaagtgttgaacaattaaactgtttatatgtaataaccagatatatatgcctggcataaaatgagccctgcattagaggttgctggatgtagggtcctaggcctgacgtatccaaataatgtctatgataaagaagtcaataagtgctctctataacacacaagcattataagttttcacactccaaaaactcttcctttctaaagttactaaaacttttaagggcatttcgaacaaaaacagctgtggaaaacagatcggttaaatcctatggctaagaaacatcttcctatcccatgtattattcattacccaggtgtcaattctgtttccaatacaaaagtctcaagcagtgaagcgcttcccactccagctgggagagccatcctcaacaagataagggtaaaacctgtgagcacaaggcttccatctgcaattcctgtctgcagggaagctccccaaagagggaaaccatgtcttattccttacggtaaaacaccaccattcattccttgtgtttaacaaccaatgctggtggaacataaaacaaaacttagcaatcacttttttcatgctacttagacctgtaacacatttttcctctggtgcacactatccaaaacctagtcgtttcccttactcctaggaggaatttagatgactttttttttttggccaggtgcagtggctcacgcctgtaatcccagcaatttgggaggccgaggcaggcagatcgctttgaggtcaggagaccagccaggccaacacagtgaaaccccatctctactaaaaatacaaaaattagtcgggcatgcatggtggcacacacttgtaatcccagctactcggaaggctgaggtgggagaatcacttgcattcgggaggcggaagttgcagtgagccaagattgcgccactgcacgccagcctgggcgacagagcaagactgcgtctcaaaaaaaagactttctaatcatattggaaatgtgtaacaaggaccaagtactgtgtattaaacttaataaatcaaaacaacaggccctctaagatataaatggtgcttcactgtatgtttatctgcccaacccatcataggaactcaattcagcattaaactggttttagatcaagacactagaactcatgtttagcagttattaaattacaattattaagaaaaaaacttcattacgtaaagtcctttactccaaaaagtttctcaaaatacataaacactaatataaaaacaactattaaaactttgcctgaatctcaggatttcagaaatatgaaagtactcatctctcacgtctcccatccacttaaaatgacaaaacagatcattatagctaaatcaaaggaaatgtttaaagagaaacaaacccaaagagtaactacaccaattcttgacccaattctctgtactctgtcttatgtaacattacactatgaataacaatcccatcatccacaacagctttttttttttttttgaaaaaaaagctctcattgtccaggctggagtgcaacggcacaatcttgacccactgcaacctccacctcccgggttcaagcgattctcctgcctcagcctcccgagtggctgggattacaggcatacaccaccacgcctggctaattttgtatttttagtagagacggggtttcaccatgttggtcaggctggtctccaactcctgacctcagggaatgagtgagtttctataggccataattactgcaacttacttctccaattttcccctccacagttaactcaacagctcaaaaacgatcagtaacaaacaacagtcaccatgatatggttaggagtgtggcagatttcttaaccagtaataataaataggaaaaaaattttctctattaatagatctcaagtttcgtgcacttgcaagaaactaattaaaaggcagccgcgcacgatctacaaaaacagccataagactgttacattttaagttacaggaaataaacctgctcctctaattcagcaagatacaactgacttccccttacataccctaaaaaaaagccttacacgagaaatttaaacatggaagcagaaacacaccaagaaaaagacatgtcaaaccccacctgtatatctgttttcaaccatttggagtcgaggcgagcctgggcagccaaacacaaagattcagagggcatcttttctccagcttcctcccaggtctcaggcctgcaagtaaacacatacgctgaagacctaatgctttttaatagtttacaaagacactcccgaaaggttcaatgcagaaaagaaaaaagagagagagaacagaaaggggggagagaagagctggtggaggggagagaaggggagagagggaaagagggaagagatggagagagagggaggtggggaagggaaagcctgcttccaaggtaggcagggtgtgccgagtttctgcaccacgctgacgagaccttgagaatggacggtcacaggaagccaagttacaatgtcatccccctgccctcaaatccaagaagtacacacacataacagggagcccatcgttttaacgacaaatgacagcagcatgaatctgccgctttaccccacagcagggcgcgtgcgtgaaacaaattactcaaaaggatcgcctgcagaaaaacccacagccaccaccacttaagagatggagagaggcccgaggctgccccgcgggtggtccgcgcaggccccggtgcggccgccgcgcccacgcccgcctcccgggctcggccgcccgccagccccgcgcccgtaccgcccccgccaccggccgcccaggtgccccaggccaggacctgacgcgcagggcccggccgcctcgccccgccggcgcgcggacgcagcctcccaagagccgctggctcagccggcgcccgcgatcccggcgcctctcgcggcccgaggggcgggccgacgcgggactgccgccccccgcgtacggccaatcgcaacgaggctgctccgtgggcgcagccaatggggaagaggagcccttcgccgctcctcccgactctcccgcttccagcaatcccgcttatcttcctacttggagcgccgtggctgcggccaaggccaacagcgggcgccggaaggctggatttccgccgcacgcacgcgctcccgcactcccacgggagactgcttggcccggagcgctcttgatcacgccgcggcgggaggtggcgctcacactaactatagctatccagggcgcgggtcgagtggcgagaccagctcccctgggtatgagaacgcatctttgtgcggtcggctggctggggcctgaagagcttcctcctgtgtgttcaactgaacgcagcaaaagtcttgggcagattccatggagcagctgtggaagcactgtgcagggaatcgaagaaggaaacacctccagcgaccacaaaacaaaattgaagaactataaaacaatataggccgggcgtggtggctcacgtatgtaattttcagcgctttgggaggccgaagcgggaggatccctcgaagccaggagttggaggatcccatgttgccagactgggcaacatagcaagaccccatctctaaaaaataaaaataaaaaaatttaacaattagccaggtgtggtggcacacacctgtgatcccagctgctcgggaggctgagacaggagaatcgcctgagcctgggagatcaatgctacagtgagcttagatcgtgccactgcactccagcctgggcgacagagtgagatcctgcctctaagaaagaaaaataacggccgggcgtggtggctcaggcctgtaatcccagcactttgggaggccagagcaggtggatcatttgaggtcaggagttcaaaaccagcctggccaacatgatgagaccccttctctactgaaaatacaaagattagccaggtgtggtggcacgtgactgtaatcccagctactcgggaggccgaggcaggagaatcgcttgaacccgggaggcggaggttgcagtgagccgacattgcaccactgcactccagcctgggggacagaggctgcaccactgcagccttgacttaccgggttcaggtggttctccacctcagccttgccactagctgggactgcaggcacatggaaccacacctggctaatttttgtagtttttgtagacgggattttgccatgttgcccaggctggtctcgaactcctgggctcaagtgatccgcccgcctcagtctcccaaagtgctaggattacaggtgtgagtcactgcactcggctaatagtaatgaactttgaacagaaggaaagttgttattattttcttggttatgttctatctatattttctaatttttctaaacatgtaaagataaaattctaaaaactcagacctcagaacaaaaaaattagagtataaatatttattttagttaacttgtacaaatttggtttctggaaaaagaatggaatagattttctgagaaaaaaaatccaccactttggccgggcgcagtggtttacgcgtgtaatgcctgcactttgggaggctgaggcggtggatcacctgaggtgaggagttcaagaccagcctgaccgacatgaagaaacccctgtctctactaaaaatacaaaaattagtcaggcctggtggcacgcacctgtaatcccagctactcaggaggctgaggctggagaatcgcttgaacccaggaggcagaggttgcagtgagctgagatcgcaccatagcgctccagcctgggtgacaaaaggaaaactctgtctcaaaaagaaagaaagaaaagcagactggctgaaaggattgaagaacaaaatatgatccaccaatgtgctatctacaagataaacattttaaatacagaaacagattgaaagtaaagggatacaaagatacaattaaaatagtaaccaaaaaagagctgaaggggctgtactaatatcaaatgtaatacactttaaattaaagcagggctgggcatggtagctcaggcctgcaatcccagcactttgggaggtggaggcagagagacacgtgagcccagaagttcgagatcagcctgagcaacatggcataatcccatctctacaaaaaatacaaaaattaggcgggcatggtggtacccacctgtggtcccagctatttgggaggctgaggtgggaggatcatgtgagctggggaagttgaggccgcagtgagctaagatcgggcccctgcactccaccctgggcaacagagcgagaccctgtctgaaaataaaaaaaaataaaaaacggggttgagagacaaaaaaggacatccttttttttattattgtattttgaaatggagtttcgctcgttgcccaggctggagtgcaatcgtgtgatcttggctcactgcaacctccgcctcccgggttcaagtgattgtcgtgcctcaggctcccgagtagctggcattacatgtgcctgccatcacgcccagctaatttttgtattttgatacagacggggtttcaccatgttggccagggtggtctccaactactgacctcaggtgatccacctgccttggcctcccaaaatgctgggactacagacatgagccaccgcgccagccgaaaccttcattttaaaaaaggctgggtcaggcatcatgcctcatgcctgtaatcccagcactttgagagggcaacgcaggcggatcacctgacgtcaggagttcgagaccagactgaccaacatggtgaaaccccgtctctaccaaaaatataaaaattagccgggtgtggtggcacacacctgtaatcccagctactcaggaggctgaggcaggagaattgcttgaatctgggaggtggaggatgcagtgagccgagattgtgctaccacactgcagccagggtgacagagtgagacgccatctcaaaaaataaataaaggctgggtgccagatgtggtgcataggcctagtttgttgactcctgtacttaacatataaaactctaaagaacagtgggaaggagcttccctctagaggcacaggagcggccaagttggtccctgagcagtgactttataataacatgttacactgtgttttttgtttttgttttgttttttgtttgtttgagacggagtttcgctcttgttgcccaggctggagtacaatggcgtgatctcagctcaaaacaacctctacctcccagattcaagcgattctcctgcctcagcctccaaagtaggtgggatttcagtcatgcaacaccatgcccggctaattttgtacttttagtagggatggggtttctccatgttggtcaggctggtctcgaactcctgacctcaagggatctgcccgcctcggcctcccaaagtgctgggattacaggcgtgagccaccacacccagcctttattttttttctttttttttagacacagtctgactccgttgcccaggctggagtgcagtagcacgatcttggttcactgtaacttctgcctcccaggttcaagcgattctcctgcctcagcctcccaagtagctgggattacaggcatgcaccaccacatctgactaatttttgtatttttagtagagatggggtttcaccatgttggccaggctggtctcaaactcctcacctcaagtaatccgtccgcctcggcctcccaaagtgctgggattacaaggcgtgacccaccgggcctggccctgtgtgttgttttatgtatgtttctatatgtgttatatttcacaataaactaaatattaaaacaaagaataactgatagctatgcacaaaggtatttaaatttcaccctcacaaataattttttttttttgagacaggatctcactctgttacccaggctggagtgcagtggcaccaccttggttcactgcagacttgacctcccaggcccaagcgatccttctacctcagcctcctgagtagctgggactacaggcacactccaccacacccacctaatttttgtatttttggtaaagatggggtttcaccatgttggccaggctggtctcgaacttctgggatcaaggaatcctccaaccttggctttccaaagtgctggtattacaggcgtgagccactgtacccggccaagaatagtttcttctccttacctaggtagagacctctgcagaaatgctgggagatctttggagaggggagattttttaaataaaaaatttaatacttggaggggcgtggtggcttacccctgtaatcccagcactttgggaggccaaggcggacagatcaggaagtcaggagattgagaccaccctggctaacacggtgaaaccccatctctactaaaaaaaatacaaaaaattagctgggcatcgtggcgggcgcctgtagtcccagctactcgggaggctgagtcaggagactggcgtgaacctgggaggcggagcttgcagtgagccgacatcgggccactgcactccagcctgggcgacacagcaagacttcgtctcaaaaaaaaaaaaaaaaaattaatgctttgggatgccaaggcaggtggatcacgaggtcaggagttcaagaactgcctggccaagatggtgaaaccccgtaaaaatacaaaaatttgccgggcttggtggcaggtgcctgtaatcccagctattcaggaggctgaggcaggagaattgcttgaacctgggtggcagaggttgcagggagccaagatagcaccactgcactccagcctgggcaataagagtcagactctgtctaaaaaaaaaaaaaaaaaaactgatctagttcaaaacctcactttgaatccacccacattgctctaaaatactttcatctttcctgtggctaaaaccttaaagccttgccagtaactcccattgcacttaaggaaatccaatctcccttgttgtggcccctgaacaggctgctgctggcccaccacggtgcctctagtttgtgtaaaatgcatatgttaatttataatatatgaggcttttttagctctaaaaggctattattcactagttgctgtgtgaatcagtatttctgggtgcagttagaaattattagagttgatgcccaagactcatctccatcagcacgggggaggcatctgctcgttttatggtcagtgactctgggcctcctgctgggctaagtcctgaggtgggtctgactcaggtcagagctgtgcaccccggccctcctccccaacgtgcatgagtgctctttaggatggagctgaacactggcttctcaaaaccacttggccccatcacaggccctgagaactgattgggtcactctggtgggctccccagccctagccaagaagggtttctctagggagcctggccccccacttatgagacctggagccccaaagatcctgaccaggggcctgcctcctccagggaggggccactcgcccccaccaagctcccttcacagagacccatccaacagagctgaggaaaaccatgcctcataaatgaataaatacataaataaggatgccggggacctgtggattttgtaattcctgaaagaaggcagagtggctggctcacagcaagcgcagtaggagatactgctccccggccaggctgttctctgtctctttggagggagccctagggtacaagaaaagccagaggagaccagctggcccagaaggtgcctctccaccccttccccagagtttctgggaaacaaagcccacccgagggacacatgccttcttgggagttgtaccaggcctccttcctcatccggccatgcagtggttttcagtgcccgaaacagatgaataaaataggccctttactggatgttcttcaggaacatgcacacttctttggatcttaccatcgttttatctctatttaaagttaaatgctgtgttatacagagtattggtaaagatgtagagctacaagaactgtcaagctggcagtagcataaaattgtataagcacattggaaacctgtttggcagcttctactaaagctatatctatgcctacgttcagaaattccatcctaagcatgtacacaagagaaacgagtgcatatgtccacaaaaagacttatataagaatgttcactgccatttttattcataagagccccaaatgaaaacaacctaaatgtccatcaacaggagagtgaataaatggtgatacagtcacatcatggaatactacacagccaaaaaagaaaaatgaagtggtaggaacactcaacgacatgggtgaatagagggagccaggtatgagagacagtgcacagtaccagcccacctagatgaagcgcaggaaggcagaactgacgatgattgaagtcagaagagtagtttcctttgtgggaaagtgtaggtcaggaaggagccttctggggtactacaaatctgccgtattttggctgggtgcaacagctcacaccagcacttcgggaggcataggcgagagggtcacttgagcccaggagttagagaccagcttgggcaacacagcgagatcccatctctacaaaaaaattaaaaattagcgtggcatgctggtgtgcacctgtagtctcagctactcaggaggctgaggcaggaggattgcttgagcttaagagtttgaggttgcagtgagctcccaaagtgctgggattacaggtgtgagacactataccagcctgatttttaaatactgaccaagccttgtgttactgggataggcatcacttggccacgatttactactctctttctttctttttttttttttttttgagacagaatctcactctgtcacccaggctggagtgcattggtgcaatctcagctctctgcaacctctgcctcctgggttcaagcaattctcctgcctcagcttcctgagtagctgggattagaggtgtgcaccaccacacctggctaattttgtttgtttgttgtttgtttttagtagagatggggtttcaccatgttggccagcctggtctccaactcctgacctcaagtgatccaccctccttggcatcccaatattcctatgattacaggcgtgagccactgcgcccggccctattctgtttctatattgctaaatttgacttgctaacacgtttttgaggatttttctgttgatgctcatcagggatgttggtttgcagttttctttctttgtattacactatctcgtctggctttctgtcaggggaaagctgaccttatacaaagtattggcatgtgttccctccttttccattttctctaagggattgtgtagaattagtgttatttcttctttaaatgtttttgaatccatctgaacctggagatttctttctaaaagattttacgccgggcacggtggctcgtgcctataatcccagcacgttgggaggccgaggcaggtggatcacctgaggtcaggagtttgagaccagcctggctaacatggtgaaaccccgtttctactaaaaatacaaaaaattagtcgagcttggtggcgtgcgcctgtaatcccagctactcaggaggctaaggcaggagaatcacttgaacctgggaggcagagattgcagagagctgagattgcaccaatgcactccagcctgggtgacagagtgagactccggctcaaaaaaaaaaaaaaatttttacaaattcaatttatttaacagatacagaactattcaggtaacctgtttgtttctaggaggattttcctggtttgtggcactcggacattgctttatttcatctaagttgtctgatttttaagtgtcaagttttccttagtgttctcttgctaaccgtctgaagtctgtggggcctgcagtgatgtcccttcattcattcctgatactgataatttgtatcttttctgtttttttctttgtcagttttcctagagtttttcaattttgttgatcttttcaaagaatgatctttaagtttcattaatttttcccttctttttttgctttcaatctcattagtttctgcttttatcttggcatttgttcctttggcttgttttgcgttcactttgctctttttctggtttcttaaggtggaaacttggattgctgatttagacctatcttttttgtaatatataatgatttgatgctataaattttcctctaagcagtactttaattaaccccacaaattttggtgcattttcatttatgttcaaaatattttctaatttcttttgagaattgttctttgacccatggatgatgatgatgatgatgattattattattatttttcttcaatacggagtttcactgttgttgcccaggctggagtgcaatgacatgatctcggctcactgcaacctctgtctcctgggttcaagcgattctcctgcctcagcctcctgattagctgggactacgggcacccgccaccatgcccggctaattgttttgtatttacagtagagatggggtttctccatgttggccaggctgatcttcaactcctggcctcaggtgatccccccaacttggcctcccacagtgttgggattacacgcgtgagccagtgcgcccggcctgacccatggattattaagtatgttgttttattttgaagtgtttgcagattgttttgttaatgatttctagtttaataccattgtgattggagaacaaactgcatatgatttcatttcttttaaatttgttaagatttatgtgtcaggttatgttctcagtgaacattctgtatgtgcttaaaaagtatatgtatggtctgtatatgtatggtctgtatatacatatatgtatacatatatgtgtaaaaagtatatgtatggtctgtatgtgcttaaaaagtatatgtatggtccagcactttgggaggccgaggcaggcagatcacaaggtcaggagatcgagaccatcctggctaacagggtgaaactcagtctctactaaaaatacaaaaaaaattacccgggcatgatggcgggcgcctgtagtcccagctacttgggaggctgaggcaggagactggcttgagcctgggaagcagagcttgcagtgaactgagatcatgcgactgcactccagcctgggcgacagagctagactccatctcaaaaaaaataaaatttaaaaaaagtatatgtaaagtgtatgtatggccgggcacggtggctcacgcctgtaatcccagcactttgggaggccaaggcaggtggatcacgaggtcaggaaatcaagaccatcctggctgacatggtgaaaccccatctctactaaaaataaaaattaaaaaaataataataattagccaggcgtggtggtgagcacctgtagtcccagctactcaggaggctgaggtaggagaatggcgtgaacccaggaggcagagcttgcagtgggctgagatcccgccactgcactctagcctgggcgacagagcgagactctgtctcaaaaaaaaaaaaaagtatatgtattttgctgttgttgggtgaagtgttctataaattagatccagtttattgaaggtgttctacagttctcctagatttttgccgattacttgttctctcactatgaaagatattgtgtgtgttatatgtgtctaacaattcattgtctagttagagttgctattataccacttcaagtggatggagagcctcactgccatccattaatgtgcattaatcattttgagagtgaaaagattttttaaaatgtttttacttttttaggtatggccaagtgagatggggctagtgaaatgggtgggagaattggaagctgatagtgtgtgagctagacacccatgaatgcttttccactgggcagttagagggatgataggtaataatataaggcagctccatcacacaagctggtgactcctgtgcgacagaccaagaactgcatttggagattcatttccgattgttgcgtttcctcttagagcattgcttggtcatcgtgttctgagtggtccattggcctccatgtcccttttggggtggatatttgctcagtgacttttgagcagctggatctcctgcttcggcaggtgagtgaggggatggatggctccacggactggcccccgccccaggagaaagagtgcgtggccgtggcaacgctgaatcttccccgacttcaggtattcgtgatttcccttcctcttgctccttttataagtgtcttagcgatttgtaagaaggtttatgtattttgaaggacataggttttagcctgctgggggaagtattttaaagtaagattgtaatgcactaataatggacgcaaggcttaaaaaacttgatctgtttattttatgtttgtcctggaagtcagcctcggcatgcaggaagagtgtatatggattgtgttatttttgctataatcattagtttgttggtattcttactgttttactgttgttgcgtgtggagaaatgactgggtgagatcacaggtgatggagagagacagcgctcagctgagagaccagtgctggcctgtctctcctctgtcctgtgaaaaccctgctccaggagggtccagtcttttggtttccctgggccacactggaagaagaattgtcttgggctacacataaaatacacttatgatagctgatgagcttaaaaaaagaatcccaaaaatatctcatgatgttttaagaaattttactttgggccacattcaaagctgccctgggccacatgctgccctcgggccgtgggttgaacaagcttgatctactcagtaagcttggctcccaaagcaataccttcctttcctcaccatgaaggctgtggttagggtcaaaataaaagctacaaaagccttcctccctagcaaaactaaagctgaagtgtttgatcatcatcttttgtctttgtaataaaaccctctaacttaatgacaagaaccacggttttctcgacatagtaatttttcccttttattacagtggtttcttgtaacaacccgtcatgtccctcttccagcccctcccctttttgccctgcttctagaatgtacagaactgagtgtagtgtttagttgcagtaatgaactgagcagaggtctggagcatgcttctcctctagtcctctgtagcactcatttatcaccatatctgtggcatcctggcgtttgcgtggttgcgccccaggtgtttgctgcccctcctggtttgcggtgatgtgtctgttctggtcagtgctgtggggcgtggccttgtgtatgtcttaggctgtcgaggtgtcccagcgtatggttttgcatttgcctctccagggtcctgagggttctgtaggtttcacagactccaggtgagtttcggtggtcatttcctgacctgtgatatctatacctagatgagtggtgtgcttttgatttcacttctactcacagggcaaggccgggtctctgatttctcatggggcctcttgctacccaaagcctgggacgggcagtgtgttgccccctggctgcggttggctggcaggcaggtgatcctgagtggctcccagccttctgcaggaagctcgagttcagtgggtccttgtgtgcattcccgtgtgggaggttgtgctgaagcctggcggcttggctctgctttcagagcccggaacctcttgactcctgctgtgtgtgcccacgtgaattttggttttgcacttgaggagtttccctgtgtactctcagctccacagtctaatttttagcagctcttttttttttttagacagggtgtcactttgtcacccaggctggaatgcagtggtacggtcttggcctgccaggttcaagtgattctcctgcctcagcctcccaagtagctgggactacaggtgtgtaccatcacacccggctgatttttttatagagatggggtttcatcatgttggccaggctgatcttgaactcctgatctcaagtgagctttcccgtcggcctcccaaagtgctgggattacaggcatgagccaccgcctatggcagcttttgtggttacattgtagccattatttctgtgtttggtgcagattgttggggcggggtggaggttgctgttgctagttgtttagctcttctgctcatcttgagcttttccatatatgtgttcatagtggggttaaaaaaaattcctctagaaaatacttcaactattgtgggtaagagtttttttagtccagtttttaaaaatacgtaaactgagaagttattttgtctatttagatgatacttcaaattgacttttattcagtgtttaataagactttgaaattcactcatttttaggggttctaagtgaaaattgtttttctcctttcagttgcatgctgccattagtcaccaggttgacctggaattccttggtttaggtctgggcagcgtcttcctgaacagcctgaagcagaaggtggtgaccctggcaagcagcgcagacgtgctgagcaccgtgcagtcggcctcccaggccatgctgcagagcggctggtccatgctgttgcccaccgctgagaagcaggcccgggcactctgctctcctgtcctgcggaggtgggctcggggaaggaacaggagagggcatgggtcagggtgctgggaggggatggcgtttcactcaaattggcacacactttctatttcagtttcaggcaatgaagtgagcataagtccaggtcatcgattggtgattgatcttctggtgggcagcttgatggctgatggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttatgtgctaattttaaaaattattgagatgatttgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcgcagcaatataactgtatagtatgcactctttcctgctttgccttggagaatgattttcagattcactcactgttgtgtgtattgcgacttcgtttttattattgggaagttttccattttataggtgtagtactgtttgttagttcattctcctattgaaggacatgtaattgtttttggtttttgttttcttttttttttttttttttttgagacagggtcttgctctgtcacccaggctgtatacagtgacctgatgttggctcactgcagccttgtactcctaggttcaaatgatcctcccacctcagcctcctgtgttgcagggaccacatacatgtcaccatgcccggctagttttttgatttttttgtagagacaaggtttcactgtgttgcaaggctggtcttcaactcctgggctccagtgatccccccaccttggcctcccaaagtgttgggattacaagcgtgagccaccgcgcccaggctttctggtttttggccgtgtagagctgccacaattgtgctgtgaacaagtactttagtgaacatatgttctccctttggataaacacttggagtggaatttgttaggtcctggggttagtgtgtgttcatagtttcccaaagtggctttgccatttgcatttgaaccaggacttttgtgtgtgagaattctagctccttcttgtccttacagagcagctggatgctgtgtgtgtggagccgatcacattgggttttgtgtgagccattagcagggttaaggattttagggacttcacagaaggaggctggagagcatcagcagaggcagcctagaccttggatctgtaaaaagaagacactgtttgaaactgcacagatgagttggggtttccaacagggcaggtgggggcctgtgggtggatgggtgtggcagccacagaggctgggatagcttggcactggggtcagggctcagccagcctgtgtgccttcacacctggtaatgagatcacttgtaaacaatttctgtttgtcaattacaggatacaaaaaaagaagcacggaaggaaaaagaaatttatgaacaggaagcaaatgcctcaacatttcatagaaggaggactccattggataaagaccttattaatacggggatctgtgagtcttctggcaaacagtgtttgcctctggttcagctcatacaacagcttcttaggtaaatcatattagctgtattgtattgtgttttatttatttacttttttgttttttgagacagagtttcgctcttgttgcccaggcccgagtgcagtggtgcgatcttgactcactgcaacctccgcctcccaggttcaagtaattcctctgcctcagcctctcgagcagctgggattacaggcatgcgccaccatgccccactaattttgtaattttattagagacagggtttcttcatgttggtcaggccggtcttgaactcccaacctcaggtggtccatccactttggcctatcaaaatgttgggattacaggcattagccaccacgcctggcctatttatttacttattaatggtgttttttttttttttttttttttgagatggagtcttgctctatcgtccaggctggagtgcagtgtcacgatcttggctcactgcaacccccgcctcctgggttcaagctattctcctgcctcagcctcccgagtagctgggactacaggcgtctgcaaccacacctggctgatttttgtatttttagtagagatggggttttaccatattggtcaggctggtctcaaattcctgacgtcaggtgacccacctgccttggcctctcaaaatgttgggattacaggtgttagccactgtgcctggcctgtattgtattttaataggtgattattggttttcatattaagatagtgaaatctagcgcaaggatctcaaaaatttgtttgatgattgaaggaatattctgaaaattacctagtatagatgttaggataaagagcagacccttttcaatataggtgagaggagaagttggagggtgtgatgatactcaaaagtttttcactgaagagaaattggggcgtgcagtaaacatgtaaaaagattcttactaataagcaggtggatgcaaatgaaaatcatcatggaaggttatttttaaaactgattgtatcattgcctcactttatatattacagagttatacatactactttgtaagataacttttcttttcaaaactgaagtcaatgtgatagaatggtgagcattattttggaaggccagactaggaggaggtgggaggaagaagtcagactcagcctgtgaacagacgctaaccttggcagaagccaaaacagtcagacagtgttgtgtaaaaatgatcattcaagaagagcgaaacagcaaggtgatttgtgaaagagatttattagaaaatgaaacacatttatacctctgttcaataaaaatctgcttttcgtcaactgatgctcctggtttttgtttctacacatagagaaagcagagccctggcagctggggtcaggcagccgagtacagaccagggagccctgggcagtggctgcagctctcagctggcctgttcatggggccatggtgggtctgtggcgtggggtgggcctgtggcgtggggtgggcctgcggcgtggggtgggcccgcggcatggggtgggcctgctgtccacagccagaaaaactaacttagtgcacacacagtgaaattttgaaacaggaagttttagagctagtttctgtcatagattttagtaaatgctactttgcaaaacctttttctgatgtttgttttgtttttctaatctgataatgcatatttcacacattctggtctttaacaaatggaaataaagagaactaaacaatatagtttgtgtcgatggaaagagcttgggatttgttctcagaaaatttcagttacaacagtttgttcatataggtggacttccaacacagtaactataggagtaagaataaaagctgtgtttactttcacagagttaattaagaatacatgagaaaatggatgttaaaaaccttgtaattaaaatgtacagttacatgcaaagttttaaagtgagcattttccagaggtgcttttctaagttcttgaatgcctctcccttttctgaagtggctgcttcgtggggctgttggtctttggcagggggtgagtgcagggttcctgttgtgggtcctttgttctcacgagggcagtgcccgttttccccgtctcctgcttgcccagactgttcccgtgcgcagagagactggcctgtttgacctgcagctgtgctgtttgagctgcagctgtgtagcctgcgctggcccatctggctacactcaacaccgtttgctgatcagcacttgaagtctgtccgtcatagctgagacactgaatattttatctgtttaatttttattcattaaaatgcaggtttgaaaatttgattctgttattagaaagcacttaagtatgtttagaatcacttggccttgggagtctactttgtcaactgtgtattttatgagtctaaatggagatcagatgttttcaatgcaaatttcacggtccaaattgaaatgtgttacatatgtaagctactcagatggtttttgaggacttaatatgaaataacctatgtaaaatatctcaataatttttcttagattgatttcatgttgaaatggtcatatttttgatctgttggaataactatgatacattattaaaattatttttattttttaagatggaatcttactctgttgaccagaccggagtgcagtggtgcaatcttggctcactgcaacctccgcctcttgtgttcaagtgattctcctgcctcagcctcctgagcagctgggactacaggactacagactcccgagcagctgggactaccaccacgcctggctgatttttgtatttttgtagagacagagtttcaccatgttggccaggctggtctcgaactcctgacctcaagtaatctgcccgctttggcttcccagagtgctgggattacaggcatgagccactgcaaccagccattattacaattaattttatgtgttgttgtttttcttgttggtgtgttttttttttttttttttacttttgttaatgtgactaagaacaattttttttccccacccggagatggatcctcactctgttgcctggactggagtgcagtagcacgatctcagctcactgcagcctctgcctcctgggttcaaatgattctcctgcctcaacctcctgagtggctgggactaacagaagcatgccaccatacctggctaatttttgtatttttagtagagatggggtttcaccatgttggccaggatggtcttgaactcccaacctcaggtaatctgcccacctcagcctcccaaagtgttgggattacaggcgtgagccaccgcacctggccatgtttattaatacgactaagaacattttgaattgcacctgtggctccattggtgtcctgggcaggtggctctgtgctgtctacacaggttgtctcctgtgtcttcgtcttcgctgcgtgtgactttttggttcctgtggcacgtggggtcctgtatgggacattggttctacagcagatttatagtaaggatgtacctactaaaaaatacaaaataaaaagaatagacacaaacatagaaataagtatcacctcacaaaacttttggaaagtagaaaaagaaaaatgcattcgcagctttccagtagccgatatccaggctgtcttcataagcatggatcatgtttccctctcctgcatgggtagacactgttttctcaccttaagtgtttgtgagtgaaggattcttgatgtgttgacttggcagatgcagttgttgaacagtagtttatctaaagatcgtaagagacttttggagacatttcatgtccttttttcccttggaaaacgtgggttggagaaatcgctgcttgccaaaaataagccgtgaaacgtatttcagagtagatcgttatttacatgctggcgaggagccacagaataccatttacatttgaaaatagagtgctgcgaagtttttataagtagtgaatcccatcagaattacacattttgattatggctctaaattttatattaaataaactaaaaatttcattgtattgtattaccgtctcttgctccttcaggtgtagcatacatgttagattctagacctgtttcttgtgttacagtggtgttatccaggcagggtatcatgtagtgaaggtgatgtctagtggtggtggtgagcccagtgaaggcgcatccttgccgtgtgtgatgagggcctgtgggttgctatgggattccccaaccctggctcctctgtctcctgcttctgtccttactcacactgctggtagttttctggtgtgagccacgggggcaagtgggattgacaagcctgctgtcacattaggaacctgagttaaagtggagctgaaagcatgtcctcactcttgatgttgtgcagagagccacctgtgctcctggctcaacggggcgtgtgtggtgggtctggaaccaggccctggtttggctctcctcccctccatgttcccctgtcctgtctgatttgcttcacactgacataagagttactttccctcggcctcccaaagtgctggtattacaggcattagccaccgcgcccagctagcatcctttcaagtactggggtacacccaagctcccagcttctagctaggagtcattttgtccctctttatcccaaaggacttgccaccatctttggttcccaaagcccaggagggtccaggctcttcagcctccaaccactttgcatttcttgtctgcttttcgttcatggagataattaacttatttttcagcctgggcatgtcttttttatttactttattttttatttttattttttgagatggagtctcactctgtcgcccaggctggaatgcagtggcgggatctcatttcactgcagcctctgcctcccgggttcaagtgattctcctgcctcagcctcctgagtagctgggactacaggtgtgcaccactatgcccagctaatttttacatttttagtagagacagggtgtcgccatattggccaggctggtctcgaactcctggcttcaagtgatcctcctgcctcagcctcccagagtgctgggattacaggcacgaccaccgcacccagcctttatttactttgtatatctcatctattactgctgcagtttgcagaagagaggatgccctcaaacctaacttctccaaaccatcccaaatgggaagtctgctccacgtcaacagcattgttgcttttaaagactatacgtcaacatggcagattatagcaaaaggatgtcgagggagcaataggaaagcaagcctgagagtcctggagagaaggtggcagagctgccttttgaaggtggttccttcctcagaccctgcccttcctgccttgttcctccagttgccagatttgctgttggagctcctccacgggcgaagaggtgaggctggactgagagggagatggagaagctgccagagattcttttggatctagaattgagacagcagttccagccaggtccagaggtgggggctgtcacccagcccccaggggaatggtactgattgcagaatgtggcgagaactccctggctgggagagggaggtgcttgctcccttgaatcacctgagcccaggctggaaggcccaagggggaggacgaggccagctcactccagctccatcccctccctttaaccctaagctagttaaccctcccagactccagtcctttttcctaagtgccctccctgcaaagtctgcaccgagcagcgctccctcgcaccagctcaccctgcactgtcttgtctttcagcaaccccatgggtttgaacttgagacgattcatgttcctaaaagcctctttgggctgagggaaggcatgggtggctctgccagttttggagtgggggccgactcttctcagagccgctgcaagggccagggccaccctcccaggcgggtgtctccgggctgggcagcagctttgtaggcagcctgggtcatccccactggtctgggaagctgggggtgcaccggctcctgctcctgatagggccaaggcaccttccttacctaagagctgactttcttgaagagtgggcacagaggagccggcaacctgggctgtgtaggcacccaggagaaaatctgcagctcagtatcagaagtctccaccagcacggctgttgcagagatggggaaactgggctgagagggaagggggcttgcccaaatcaccagccctggaatgtttggagctttgggggtggatctcccaggaaacgtgtttttatggcaccaccgcctctggtcacccaccccgaggtgtggcgggcctggacagccagcttgactgagggccaggctggtgaagtcaaaactaccactcaggaagaagacctagcccttctccagacagagttcaaatgtgaggactgccttctttgggcctcaaattccccacgtgaattccaaggacccctctagctcctacactctgggccaaggtttcctctgagccgcagtcagcctagaggacctaggatacatcttccttggacagagacccaccataggggcagcaggaggtaggggtgggggtaggcaagattcctgtggggaggtggagctgtcatcagagatggtgtctgcaggcagtgggtgtatcgtggctctgctactacttgctgggtggccccatgacgtttctttccccactctgacctcagtttccctatctgttctgtggagataagatgcctgcctacatatttgtggactgggatgtgtgtgggccagttgcagtgtttcttggtgtggtcctggggcaggctgcaccaccccatagagatttctgggccccaccctaggctcacaggaccagaatctctgggaatgaagcctgggaatttgcatttccacaggcatctggctgattctgacatgactgaaaagcactaatagtatatagcaagttctttataaaaggtaaattcatagctgccttttactaaacataaatctcaccttcccttcctcagttaaggacacacaccgcagttgaaaatcactgtgcctttccagatgcagaatctgacctttccgataagattctgttaactgctgctttctgcagtttgtattccaaaacaaggggaatatgtttccattttttcaatacaaatgtttaagtcggatatgctttctcaaactggacacgcactcacacagcttagggtttcagctatggcttcctctcaaattattagcctctttctgccagggagcagtttttcccagacaagaccctggacagaggttggtggggccctcctcatcagaatcactagattatgactgacccctagaggtggcttttctgcttaagtgtcagcccatgggctgggttgtgacccccaaagctgcggcagaagcttccacccatcctgggccccccctgccatctatggggaaaggcctgtcccttgtcttctgggcccagccggcctcacaggcattcagcagattggaaagtcgaagcatgtgctgtgcttggctgggctctcctgcgcccctttttggggtgaggtggagtgcatccagcccccagcatccctgccgtttattcccacccctcatccccacccccatacacactcacaagtacaaacacaagcacagtcactggcacacaccactctggacagcaccatttccagcctcagcggggcagtttccttacagggaagttaatgaggcactaacgaaggctcaggggacagggggaacctctatcgagaagaggctcctagacctggttctgcctctgaattgctgggggtccttgagaaagttgctatccctctctggtctcagtttcctcaggtgagaaatggggggccggccaaatggtctaaggttctgggaacctctaaatcagagcccgtagctggtggtcaagatgagggagaggccctcagggtcagccgaatgcctgagaggccggacaggcccaaaggtgagcaacgtgagcacatcaggtgggctcagagctggcgcatgagccccacagcctgcagagcagccctgtactcgggagcccgctcgcaccaacccagtgggacttcagagatgtggggtccagcctttcctactattgctgggctgagggctgggagctgcagattctgaccccacagctgccttagacatgccagatggtctggggcaagacacacccctctctatgaaatgagcagccagtccaaataggtacgttagagaagggctgtgggatggacccagctgtagcctggggctacagactggcttccggggtactcaagcagctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggcggctgctccccacagccaggagtccggcccagcacccacctgagtccgcctcagtcctgctcaattgggttatccgtgctcttggccctctggtcccacccacagagggaggtctttggggcgaccaggtgagctggcccttgtgggaggatgtaactgactcctgagcctggcgagccaggcagcccctcgccaacgtccccacccctacctctccagcccccccgcattccctgatcctcccatccgctcccctgacccagcagttgcctctgctcactctcttttcctgctcccaggctcgcctggtcatgtgtccttcactctcctctgagtctccctctttccaagccgcctccactctacttgacacactctcccttaagacaccagagtacacaagcgcaagtctctgcacctcacctttactcccagacatgggagggagatgacatgaagacccaaacgccacttagcaggagatctggggtatgcagaggggcagaacggaggctgtggaagctccaggggctccctgcaggaggccacatgtaagctggctattgaatgtggctctgagctgagacctctccttgaagctccagaccaggagccagctgctagctggacccctccatttggtgcctcagagaaactttgcactctctaggtctaactttgaacccagaaaattcccccatgtcggccctgtctcttcatagggaaagcaccacctcagacccagttctgcaccaaacccacatttgagtcacgaggctcctgccctgcactgtgagcactctggataagccagtgctgagggggaaagagctctgaatgccaagccaaaacatgagcttcaactccacctccagctctgagagctgtgggtagggaagggccctcgtccagtttgctgtagaaagatcagtctgccactgtatggcacatggatggcaggggcagagtgcaggtggagagaacagaaggtgggcagggcgggggaggcagggacatggctgtagccgtggagatgggaggacagacaggacttggtggccacttgggtgaaccaagggaggagtcaggaagagacacccagttttgtatcagatgtgtagagcgtgggatgctgttcattgacggagggaggaggaggaggaagaggtatggcatggggaggaggtagctgagctctgtcgtgaatgtcatttgaagtccccagggaaagccaggccggccagcaccttcactgcttcagccagctctcagggtgtctgtgctccctggccctctcagctcctgcttcatagctgtcatctgcagtgggagacagctgcacaagggcccagcatgtctgtgtgtttacccaggggactgccgcatggcccatgccgagcagaaactgatggacgaccttctgaacaaaacctgttacaacaacctgatccgcccagccaccagctcctcacagctcatctccatccagacggcgctctccctggcccagtgcatcagcgtggtaggtgcagagggtacctgtggctcaggctcaggtgaagaggcagctcatgcccaagccctaagcagtcaatgtccagaggaatgaaatgactagagttgacttagactcaccggtacacggtggggaggctggaggagggtccatgaggtttataggtgtccagtatttaatgaggccatggttttgttaacaaagaagaaatgagggtgggagcgagatcaccactggctaggagactcagctgagtctccagcacgaccatgagcttctcatcctgatcctcccagccccaccctacttttctcccccagcttgctcaacaggtgaccttacaggctccctactctttgcagggaataagaaccagactgggggaactgacgggtacagaggcccaggtgtaggcgcaggaccacaggcagtgaagcgtctactgacccaggcgggtgagggtctggagagtgggcatggctgctgcaggcatggaaagcaggcacagatggcggcactcccagggcccattgtcagggtctccacatgtggacgtgtgcagaggtgggggtgctgagggaggaggggcagggaatttctcatcttctctctactgcctctgagttggagatgtcagagggagccatggcccactgtaaagtaacacaatgtccccacccacaggattagaacccctcccctggaagcagctctgaggggaacagtcacatgtagagagtgcagggcactgtgtccagccgggggaaggaggtcaccaagggggttgacccccctctggccaggtggctgccttctgacacaccagcctctgtctctagcacggtggcccccacacacccagcctgtgaaacctacagccctcaagaagactttggccaaattaatgagcggctccctctcccaggaggaagcacaggtgaaggatgtggagggcagtagagttgtgtgtgctccgccccctttctccgcagtcggatggaaagaagggggctttcagccaggctcgcccaggctggggtctgagtgtcactgtccagctattggcttcttgcttaatgggtgagcccagctgctcccgtgcagctgccgccctagtgagggtgaaccggcaggcgagttacatttctgaaagcctgggaatacagtaaatattaggctgtgggctgctgggccaggaagagttgtttatttttcagggtttgtttatctattgacttgatgagggagggttataggtacaaccagtttaaagatggaaattttgagagagcaggcagggatttagtgctgggtaagcctggtcaaagtggctcttttggggcggccagaatccagtaccaatgtcctcagcatgttcatcagctggctgggggagtgcgggacagcatgaaagcacaggagaactttctggatgatagaaatactctgtatcttcaaaggaggtgggttccatagtaatgttaaatgagttaaaactcatcaaaatgtaaaccagacctgtgcatttcactaatagaaattatacctccaattaaaaacatgttttaaaagacagatgggccggatgcagtggctcatacttgtaatcccagcactttgggaggctgaggcaggtagatcacctgagtcaggagctcgagaccagcctggaaaacatggtgaaatcctgcctctattaaaggtataaaaaaaaattagccaggcatggtggcacacgctactcgggaagctgaggcaggagaattgcttgaacccaggaggcagaggttacagtgagcagagatcgtgccattgcactagagcctgggcaacagcgcaagactccatctcaacaacaacaaaaaaaggacagatgaaggttttcaactttcaataaaggcagaggagcttgttacagattcgcctccccacaagagcagttagaaaaactggataaaaatgtgccccgcccccaatcaaaaacaattgttggaaggtaattggagacctcagtcaggacttgagtgaccaggcctaggaggtgatcctgacagtctgtagtgctttcccacatttggtgattggtcaacagtagagggctaagaggctaagaaactgagtatgaagtggtagttaagaggctggagagcctagctgaatgtttggcactctcacagggctgaaatgacctaatgagaatttgggtcccaggaaggagatgggaccttggtggggaccctggaagggccacccctgggagtccagatgaataaaacatagaccagccatcagaaaacctaaaacctgctttgaaccagcttagtcccaaagtagatgaaggcgatctgcccttactccaattgtgtgccataaactcaaagtcaatactctctggaggcagataaaagtttactatgaatgtcaaaagacaacacaagactaaatgagaaagaccaagaagaaaactaatagaaacatacatgtaaggaagaaacttttttttttgagacggagtttcgctctgtcacccaggcttgagtgcagtggcacgatctcagctcactgcaacctctgcctcccaggttcaagcgattctcctgcctcagcctcccaagtagctgggattacaggcatgcgccaccatgcccggctaatttttgtattggccaggctggtcttgaactcttgacctcaggtcatccatttacctcggcctcccaaattgctaggattacaggcgtgagctaccatgcctggccagtattttgccacaatttaaaataaataaaatttttttttcaggtttgtgctcagactatattctaaacagtcacatggcggcttactcttctccaggccttgctgccggcttttacatgtttattgtctttgccttcttgtcatgtgctcattagatggcagcttccaggtgctcctaaggggccaggaaagagagtgagaaggcacggaggttgccagatcatcccccttggggccccgccctcatcaactccctcaaccgggtctcctgcaactattggtgggccatctcggccaccgcttcgccctgagcttcctgctgctgcagctgggcagtgcctccttctcagaggccagctgctgataggcggccacgtactgctgcaggtgacccaggtaatggtctcgctgctgctgcagactcagcctcttggctcttcagctccacctgcaggataggcgtcagggtaggtagtggctggcttccagattctgggcccataaacagggtagtgagggcactgcggggctctgtcgcctacccaggcccctggccctggccccttcctccaggcctaaatgactgcctcccttgcctagaggcccatgcctccctccccagcctcaaatctcacacccttcttcccaccatttaaactgtaggccacagactggtggaaaagcagagggagccaaccaccatctgctaagttgtggtgaggtcgttctgtatgatctccagggtttgcacacacctccgcctgctccccccaagagctcggccttctgccccagcttccccagcctctcctccagctcctgcagcctcacctagtgttcctgcatcttctcctcctgctgccgcagcctcacttcctgctcccacatcttctcctcctgcctccgcatcttctcctcctgttcttgcatcttctcttcctgctcacacatcttctcctcctgctcccacatcttctcttcctgttcctgcatcatctcctcctgctctcgtatcttctcctcctgctcccgtatcttcttctcctgctcccttatcttctcctcctgcctccgcatcttctcctcctgttcttgcatcttctcttcctgctcccccatcttctcttcctgttcctgcatcatctcctcctgctctcgtatcttctcctcctgctcccgtatcttcttctcctgctcccttatcttctcctcctgcctccgcatcttctcctcctgttcttgcatcttctcttcctgctcccaaatcttctcctcctgctcccccatcttctcttcctgttcctgcatcatctcctcctgctctcgtatcttctcctcctgctcccatatcttctcctcctgctctcgtatcttctccttctgctcccgtatcttctcctcctgctcccttatcttctcctcctgcctccgcatcttctcctgttcttgcatcttctcttcctgctcccccatcttctcttcctgttcctgcatcatctcctcctgctctcgtatcttctcctcctgctcccgtatcttctcctcctgctcccgtatcttctcctcctgctcccttatcttctcctcctgcttccacatcttctcctcctgctcctgcctcttttcctcctgctcccgtatcttctcctcctgcctccacaccttctcctcctgctcccgtatcttctcctcctgcctccacatcttatcctcctgctcctgcctcttctcctcctcccatatcttctcctgctcatgcatcttctcttcctccctccacatctcctcctgctcccgtatcttctcctcctgctcccgtatcttctcctcctgcctccacatcttctcctcctgctcccgtttcttctcctgctcccgtatcttctcctcctgcctccacaccttctcctcctgctcccgtatcttctcctcctggtcgtgcatcttctcctcctgcctccacaccttctcctcctgcttccgtatcttctcctcctgctcgtgcatcttctccttttgcctccatatctcctcctgctcccttatcttctcctcctgcctccacatctcctcctgctcctgcctcttctcctcctcccgtatcttctcctgctcgtgaatcttctcctcctgcctccacatctttttctcctgctcccgtatcttctcttcctgctcccgtatcttctcctcctgcctccacatcttcgcctcctgctcctgcctcttctcctgctcgcgtatcttctcctcctcctgcctcttctcttcctgctcccgtatcttctcctgctcgtgcatcttctcttccagctcccgtatcttctcctccttctcccacatcatctcctcctgcctccgcatcttctcctccttctcccacatcatctcctcctgcctccgcatcttctcctcctgctcccgtatcttctcctcctgctcccgtatcttctcctcctgctcctgtatcttctcctcccactcctgtatcttctcctcctgcctccacatcttctcctcctgttgctggttcaggcggttccacaactcgttctcttccacctgggcttggagctttgctgacacactctgcagctccttacccaggtggtcagcctccgcctgcagctgctgctggaatagtgaaagtgtttttttgaacctcagaaggaagcagaatcatgagctagccacataaatgtaatctataggctgggcgcggtggctcacgcctgtaatcccagcactttgggaggccgaggtgggcggatcacgaggtcaggagatcgagaccatcctggttaacacagtgaaaccccgtctctactaaaaatacaaaaaattagctgggtgtggtggtgggcacctgtagtcccagctacttgggaggctgaggcaggagaatggcgtgaagccggggttggagcttgcagtgagccgagattgcgccactgcactctggcctgggtgacagagtgagactacttctcaaataaataaataaataaataaataaataaataaatgtaatctataaaataatggttttcatccatgatcctttaaaaaaatatttttaagccctaactcttgagattctgattccccaggcagggccccaatttgtacatttttagcacactctagaggattctatggcgggaccagaacaaggacccaaattttccagctcttggctggagcctccccataccctgcatgatccctagaccatggtcccagctggatgggtctcccacaacccccggggctgcagctgctcacctgtggcagcaggagcttggccctctccagtttcctttttagctcctttacgttgagctggatctcagacttttcagattctacaagttgaagtttttcttgtagtttggcatttttctccttcagctcctcatcagttatgctatggccagaggcagtagagaaaggaatgaatgaagaacataaaagaccactttggtgattgaccccctaccctcgccccacaaccacagaaccgtggcgctggaagggaccccaggaattaaaagtcccaggtggcaggccagagagaagacatgagttgcctgaggctaccccatgagtcagtggcacagccagcactagagcttccgtgtgcacacatgaaaacatgtatgagcctctccgcacactcacctggaccccccacctcccagcacaccacccatgctaagggcccccagacctcccattccaccttcccccatcctacgtgttcctgtacagttccagactcagggcgtccctctcctttgttaactcctcaatgtactgcaaatagagaaaggttaagtcaggatagagcaggcacagcagtagctggacgaccaggaacaactgctacagtgactactccacagtaacacttcctcactctcaatcacacctgacgtgttctcaaggcatttccaagcccatggtctcatttgtttttctttctttctttctttctttttttttttggcagagtttcattcttgttgccctcactggagtgcaatggcacaatctcagctcaccacaacctacacctcctgggttcaagcaattctcctgcctcagcttcccgagtagttgggattacaggcatgtgccaccacaccgggctaattttgtatttttagtagagacggggtttcttcgtgttggtcagtctagtcttgaactcctgaccgcaggtgatccgcccacctcagcctcccaaagtgctggcattacaggcgtgagcgagagcacctggccctcatttgtttttcaaagaactcagtggatgtggaagggacagggaaagagattgaatttagagctggctaacaggggcccagagcgatcagataatattgttattgctattactgttagtactaccactgttcgaacctttcttgagtgcttcaccaggcactatgctaacaatcccatttaatcctcacaacctccataggagacggttaccattattacctctattgtgtagatgaaaaacatgtggtattaaaggttaagtgctgcctaagatcacttggagctgggatttcaacacccaggtatatctgattctctaagcccattctttcgctggaggtaggggcacagttaagaaggaggaaattaatcctttgttgaatttttgaaaggatgatacgttcgcatagtccaaaactcagaaagtccagaagggaaatatctccccccaacactgtgcctctatcctgagttttttaatgaatccttacaaacgtgttttatgtatgttaccataatacgtacacacacacacatatacacctgccccctctctccacacaaataataacatactcaagatactcttctgtacctttatggtacaagtaccctaaccgccacttaggacttggccaaggccacagccaagtatgggcagggcgggcacttggcctctgagatctatgtccagtgctcgctcctcacagtgctccccaactcacccacaacagccgactcagccccagtctgcctctaacaaccacacacaaaagcagcaagaaatggccatgctgccttctgggcaggacactccatcctacagaagggacctttaggctcactcctccatctgcgaagctgggctcccaagggacggggccgtgtttggactcaccctatccgccttcttcttctgtgtagtgacagcagagagagcctgctctaactctcctgcaaacttccatgaatcatgcaggcggctgatcagatccctggcctctcctggaatgagagacattcagatgtggcccaaaggactccccctaaaggcctgtcaaagtgccaggttgaaggatgatggggtgccagattcccaccttccaactgcttgacagcatgctggctgtagtagagtgccatctgaagctcagttttctgacatgtaaggattcgtatggtatgaacctgggcctttgggagaaaagacaagcaaatgctgaaagagaagcaaagaaacattctccagagggcaggagggaacttcacaccctccactcacctctagctccctccttagggcttcctgatgttggtggcttgccttctgttcctatagaaagaggaaaacagagctcttactaggggtaggcagagatccacagcaagagacatgcccccagaatggcaccactgtcccagaacaggcccacccatgggaccagtttatcagggaccctgtggggatggggtggaatcttgggggtgagccttcttccccaggctgggagtgggtgaaatgagcctggggcctctacatctgagtgcccccaaacccagcggtcatgtcgtgagcaaagaaatcacactacttcttccagctgagctcggttctattgtttctgtggggagagtcaaaggaaggtgactgagggtggcccccttgactctattccccaggccaggaagcgataggcaggggccaggaatggatttaaaaggcacagttctcagacccaatgggaacatgaactggtcaactctcctcaactcccaaagaagaaggatttgggtctttttggtttttgcccacagccacagaactcaaagtctgaaactagattctcttgaaaagacagtaacagaaaccttcagaggtggagtgcgagaaaagcccacccttccgccagcttgtgatttagaaaggtgcattcactcagcaaacgttgagcacatacgggccagggacggttcttcacagcgggaatagaggtcagaaaaggcagacaggagcccttggccccgaggtttccattctagtgggcctttaactctcgggctctcagagctaacagaaacctctgatactctctaactctacctcaggaaacgcaagcccaagaaggagagtttacagcaggtcctggacgagggattaacataaaaacacaatgacaaatctcatttaaacttcacaaacgtaaggaaaacaatatcactcgtattttacggatgtgaaaagagaggcccaaagagctcaagcaatttgcgctaaatcatgtccctagcagatggaggggtaggattcaaacccagaattcttagccagtacctggcagttcttccacaatcttaacaattaccctccaccaccccttgggccctctgtccccaggagcccggccagccaagactcacatcctcaggcgagtggcaaccaccagaagtggttgtctcagggctagtgccattatttattttcttctttttggtgtcgcttgctgctgtaccaacactagggttggtctggggatgatggtctgtcaactgtggaaaggaagagcagtgatactcatgagaactacaagctcctacagtcacatcctgctttacagtttatactaaatactcttatagaccatctgatttaatgccaccaactgtaggaaatgttgtcacaatcacttagtgactgagagagattgataccatggctgaaaaaaaaggcagtaatggaacttaaacttagtcttctgactctgagctctgggattttgccctaaatcagcagctgccagggaccaaaaccagaggcagaggtagaaaagcaaatattaagtaggcaggaactgtgcactatgtggtttagggttattcaccctcacacgtctgttagtgttaaaaagtacaccagtacctctcaaacctttacatcaatgtctcctcatggcagaaggcagcctttctgctaaatctgggaatttaacagaaagaggacaacccaagcctcatttcagagagaagtcttgtatacgcttataaatctatgtgactttcatccctaagtacattaatgttttgcctctcaatagaatcaagggaaactgatgcttcagaaagatgccccatatttatcctgtggcactcaaagtaccccaggttgagatgagatgaggaagactcaagctaagttcagtttcccaagatctgttccacagaagataagcagatctcactccagaaccagtgactgaggggcactctggtcccagaacaatggagaattcaaatctgaggtgcagaactgagaaaaaatgttaaagtctctctggagagtagaagcctgggagaaaaccaaaccaaacccattctcccattgccacccagagacactgtcaacgtgttgagctcatgggggaggtgtaggcttttcacactgtcaaggtctgtggtaaggaagtcaggcagcctgaaacctctctcttctaggtcccacagtccccattccccttccagctggaaacctgtgctgcaaccagaggaaacagaagtgggcaagaacacttaggggactgggtcctaagaccaaaggccggtcttgtggtagtaatgacagtttgtagcgggactgtgacatcactacattctactcctcggtggagttgttgggggggacacatgagtgcaatgcccaagttgccgctttgagactggggagggggtcacaaaattgggagccaggtccttggagacgtgaccccaaagagccccgggaggtcaggcttggggcggcaggaggtgagggccaattaaggagcaaggagctccaggagtcacatccccaaagtcaccctgtggcaactggtgagggcaggttctggggcacccaggtccttggagatgtgagctcaaggagcccagggaggtcgggtttggggtagcaggaggtaagggcggagtatggagttggaagccccaggagtcacctgctcaaagtcaccctggtgtgccgggcagagcaggggcaggacttatgagggggttgggctggctgacaagattttggtgtggggagcccagaggcactggggtggggggcccagcctggtgtccctcaggagtggcacagactctggcagcagttcggctgtcagagggggcctcgggttgggttggggtgttggtgcgtttacctgttccttggcctcggccaatttgctctgtctggtttctttggacatcataggatgggtagggaggtggggatgggtagggaggtggggatgggtagggaggtggggatgggtagggaggtggggatgggtagggaggtggggatgggtagggaggtggggttggggccacatcagcatgatccaggtgaggacaagtatatacctccagtcacctctacgtcgctgtgtgactgagccagaggaggcgtaaccagggctgcactagaatgcagaataggggtgtggccttcatgcttgaagcccattggtcaatgagaaagatgaaaggaaaaggaggtgtggccagacagcagcgtgtcatcaaggacctgtgttgtcacaaggaaagctgcctatgcaaccgctgtccccgcccactccaggagaggggcggggctggctttcactttaaaaactttaaaactttattacctcaattgaggtacaagtcctattaaaatggaaattttatagtgtgcttgatgattgataaagcagactttattatccaacattccaataagataatcacaatgttttctcttttttggaaaaactttctcttattctcctacattagcgtttagtttttttaaaaaaaacaaacaaacaagaaacatgtctaatatctttaaaaatacaaagctttgagccaggcgtgatggctcatgcctgtaatcccagcactttgggaggctggggcgggtggatcacccgaattcaggagttcaagaccagcctggccaacatgatgaaatcctgtctctactaaaaatacaaaagtagctgggcatggtggcaggtgcctgtaatcctagctacttgggaggctgaggcaggagaatcccttgaacctgtgaggcagaggttgcagtgagccaaaatcatgccactgcacttcagcctgggctgctacagaatgtgactctgtctctaaatacacacacacacacacacacacgcacagacacacacacacacgcacacacacacacacacacacacacaaggctttccatttaataagcactcaaagttctttacaaggttaaagcaaatacaggacccttctaaagtaaggctaaatgctaagtgatgggggagagaaaaaggacataaataactcctactctcatgagttaatcactaaatccgatttttctagaatcacctggcctctaagccctgaaaatgaaactgaatttctcactcgatacttggctatgacttgcaatcatgaaaaccaagaattgtgttatgtcactgtgtattgcttgttacctgggatcaagggttgactttttcatgatttgctccattacctgtgtgcttcttctcccagtccaaactacgcttttttctagagttctacaatttacagttagtatgtaagggtggctctcaaacatgtagtctccggaccaggagcacctgggaacttcttataaatgtaaattctcaggccccaccctagacatgaatgaatcagaaactctgcagtagggcccagcaatccgtgctgcaataatccctccaggtgctcaggaacctctgccatacagcaggtagaaaaatgtgtttccttctgtaggtccaaagccagggatactatatgttctgtctcaatatgaaacaatgacatgcaattaaaagacataaatctccttcctacttccaccctccagccagtgtgttttatttttatgagttcaataagaaaacgtgtggcaatcagagatttcatctaaaaaatatatctacaggtatcagttctcatccagcctgatctcatccaatatcatttctatcctcttacatctaaagttttagaaaaggattttcacaacgtaagactcaggcgcactaggagttctatgataaaagaccaagtagatctgaatgtccaaacttactagagaagaaaagtggactcattggctatattttcaaattgcattcaacaggaaattaaagttttgaattttttccaccttcatccttccaagttaatagaattaaaccagaatactccattcttccaaagcctgtagccaggcaaacttttactgtattacttcttgcttttcaatggatataaagcagagtcctggtaggcacattttgtatacctgcaaagatgcaaaactaaacagttccctcggttcaatattaaaacaaaagtcctgtaaacctcagatggtgagtgtaatacttcagcactagcacgaaagcctcaaatataaaaagataccaagaaccttgctagcaaaccaaagtaagctcttggccgggagcagtagttcacgcccgtactcccagcatattggcaagctaaggtggggtaagtcaggagttaaagaccagcctgggcagcatagcgaattcatatctctacaaagaaaatttaaaaattagctgggcttggcggcacacacctgtagtcctagagctacttgggaggctgaggtgggaaaatcacttgagcccagaagtttgaggctgcagtagctatgatcatgccactgcactccagttggggtgacagagcgagatctaattattacattctgtcctgctcctgtttccactaaaatcactaacttaaaatgtgttcattcagcaggataaaaattaagtgaaatttgactttggtgctttgctagcaaaaaataaataaataaagtgaagtgacaaattacttactgggagaagatctttgtaacctcaatgacagattaaaggtttgtatccttagcctataaagaaatctttaaaattactcagaaaaaaaaatgaatgatttgcagcagaaaatgggcaatggagaaaccagcacttcccacaagaataaaaatggccaatgagcaaatgaaaaagattcaaaagcactagaaatcaaagaaaggtaatgaaaacaatgagattttctgcttaaagaccagcgaagacgacaaatggaaggcggaacctggagctctgtccctgttggtgggagcgtaaactcaaccaattttcctataggatgatttgaacatttgttttaaaaatcctaaaactgttttatattattttcttctagaaattctacttctatgaattcagtgcaaaaatcctcactcgagtccattaaaatatatatagaaggaaatccacctctggggtggcaatgattcacttaacatacatccagctgttgaaagtgatgatgccaggatatatttctcccatagaaacatgcttaaaatatagtaagtgacaaaagaccatgtattgtgattctactttttaaaatgtttacagcataaaaagtgtgaaaagcaacaaactggaatgttttgagtggcaaaattaaagatttttctttacattttgtcatccaaattattacaaaaacaatgtgatttcctttataatcatggaaaagtgttattttcatttatttatatttacatttcttttctttttcttcttttttctcctgtatgtatcccacataggctacagagcttaaatccctgcctcttgagagaaatcagcccattttcaggacatgcaatacacaaagctgccccatcttccctttatttttatttttatcttatttatttatttatttatttatttattatttatttatttatttatgttgagatggagtctcactctgttgcccaggctggagtgcggtggcgcatctcagctcactgcaacctccatatcccgagatcaagcgattcccctgcctcagcctcccgagtacctgggactataggcatgcaccaccatgcccagctaatttttgtatttttagtagagaggaagttttaccatcttggacaggctggtctcgaactcctgacctcaagtgatccgtctgccttggcctcccaaagtgctgggattacaggcatgagccactgtgcctggcctgtcatattatttctaaacatttgagtgacatttcaattaagtgaaatttaattcttactgatctgatctcttatcctctgtttaatgataccttccagttgaaaggtgtttcctctgtaatcacgggtgccaaaggaaatacaacatgtattcattaggtggatatccactaaaccacggattcatgcattgtagtccttagaccctcagcatcagaaacacgtgggaacttgttagacatgcaaattcctgggccagccccacacctcctgaatcagaaagtggggaaggacagctatctgtgctttaataagccttgagatgctccctgaagtttgaaaactacagaactagaatacatatggtagtaagtgctcatactttatccaaggtactagggactcttcccctcttttccattctcttttctgttgaaataaaatgagagctccttttgacttaatgggtataagaaagaaggcaatgagatgaccagggtttcaagttagagttcaaaatttaatcagtggacagtgacaggatgcaagccttctaaacagattgctgcaaggaagctgattataatctatacagtaggtatcattagtgtattgatgttaaattttgggggtggattaatggtattgtgattatataggagaagtcctggttcctagaagatatctgcgaaagtacttaacagtgaaatgctctgatactgccaacttactttgaaatgattcagagggaaaaagggcacatatacaatcttccatacgcagaagacagaaaacaagtgtgacaaaacattaactagtgaatccagttgaatagcatacagatgttcactgtatgattttatcaacttttctgtgtttgcaagttttcaaaataaaagttgagggaaagaaacatcaccccaaatctttctatgaaatgggaccacagaaaaagcagagaagtgaacactttgcagaaaagagcactgcacccatccggacagcatggtcaaagtgcaggctctcctccaggaggctcttctctggtctcttctgtgctgtcacttcccccacatgcagccaaggcttttttctaacaactctttttctaaagatgtaatttttgtcattcatctaagaaagagaagaaaagaattagtatacatttagaaaataaaattacacttacatttgtgaaaaagcaaaaaatactttgaaaagtggggaagcaagaaatgtactgttctacaattctgttctgttcttaccatctttttattctgccaatgacttcctattcctgctgtgtatggtggggtgagctgcaaatgatttcttttcctcattgatttaaaatgtcatgtttataatgtaccaaactcccccagaagcatttgggtttatttctgggctctattctattcaagtaatctatctgttcacaagccactatcaattttgattattggagcatcctaaagttaagtaattgttgtttttgtttttgagatgcagtctctcactctgccgcccagctggactgcagtggcgtgatctaggctcactgcaagctccacctcccgggttcatggcattctcctgcctcagtctcccgagtagctgggactacaggcacctgccaccacgcctggctaattttttgtatgtttagtagagatggggtttcaccttgttagccaggatggtctcgatctcctgacctcgtgatccgcctgcctcggcctcccaaagtgctgggattacaggcgtgagccaccgcgcctggccctgaatttgcttgagtttttagctctctcacccatttcaggattgtcaccacccatatctgacacatcctcctccttctctaaatcttctaggtcctcctggccatcagcctctgtttctgaaccagcctcttcatgctcctgttcttcactctctgggagaagactgatatcttcatctttctttcactaaccgcattctggaagcactgtaaaattgcttcattttgcaattccagttgttgcaaagtctgctcatcatcaaaactttctatcacaagtttttgtaaagagctgccatggattctaccattctctactgttttattaaagtcataaagcacttttgttaaagaagtgaactttggttccaatccatcttgaaacctattgggaggaattaaatgagatttagaattatagataataatttcacagccctcttaattaaaagaaaaataaaaacctcaactcttctgtaaaatcaaatttgaataaagtgtaagtatagattctggccccaataatatataagctgatgagccacaatgatatataaaacctgtcaaccaagtatttgtgaatcatctgtatagattgttggcaggaaaagcattacaaatctatttgcttggagatatatagagaattagccttaaattttctactctgctacattatataccactccattcattcattcccttattcactcaatgatcaacatttgctttggctacagtggtcaaggaaaacctctcctagatgtgacatctgagatgaaacttacagacaagtatagtcttataaagattgggaaacatgtattccaggcggaagaaacagcaagaacaaattctctaagatgcaattgagcttggtaagcctgaggaataaaaaagtgagcatggctatagcgtgaaggaggcagaaggtgaagttggagagactgatgggagccaaattctgcagggctcaagggtaagagtttgccgttttaagtgtaataagaaaatgtgagaagattttaagcagaaggatgaaatgatgatttatacgaaggaagaagaaagggaggaaggaggaggaggaaagtagagtgattagaaggttgatgcagcattccaggcaaaggatgatggtgatttaagctggagttagagcagtgaatatgctgagtacagtttggaggtagaactgacaggattgctaaggaattagatacagaatagagaaaagtgaagacatcaaaatagcagcctagttttatgtgcgagcaactggagagacagaactgccatttactgcgataggcaaggcttgagtggtggagcaaggggaaaggacttcagcggatggcagagtgtaggtgggtagaaacaacattctactgtattttggacacagtgaatttgtgatgctgagaggatcaaaatttaaaaaattgttaaaagccgtacggtgcggatatcccagttgtgcgctactgaattccaactaagctcagtctggagttgcttgtgagcaaggaactcaagggagaggttggagtttgaaacataaatgagtcataattttataggtcatatttgaagttcttcaacaaaatacacataaaacgtttgtgttgggaagagacatgaaagttctaattctcaagaagcttagtggggtagacagacaagtgacaagtttgtgctttcaataaagtatgatggcaggtaaacactgagtgctttaggagcacaggcggaaggagaaaccaacacagttgtgtgtagggggatgggggccgtaataagcctcaaggggagcttataggcgtgaataactgaggttaggttgatttcaataacattcatctgagagatccatactgtaaaagttttaacaatttttaaaattttgatagcctaggtcctctgaaatgtggggaaaagtgatttacatttccccttaccttcccccagctccacaatttgccaggggtctgcaacccgtgtccacgtgcgaccgcagtcgcacccgagcccgggatctgtgcacttacgtgaggatgcactcgggccagccagtggctttgcccacctccctcagacaccgctccagggtccgtcagcgccaggcccatgggccatggctgtctgcaactcccgacacaagctgcaaggcaagagagccgctgggaaaccgcaccgcaaggatgctggcattggaacaggaattaaaagaaatgaaaaaatgtgtaagcaaaaactcagctgtatgtaaaaaaaacccaattccccctgagaatgagaaagagccttagtcctttaaaaaaactacctgttttcctatggctagtgagccttatcgctcccttcccaggcattatcaaaaccctaattccctaactgtgcaactgcaaggtcactaaacaaacaaatgcaagtcacaaaacatatttttcctaaaaacgtaaaaaaaaaaaacataatgcgtgcttcaattaaataactctctgtttctcgcttctgtaatatgcttccccctgcacagatctacccgggctccacaaaatgctaaaagataactctttattcagctcaacgctttgatctgcctggcgtggtggctcactcttgtgatcccaggactttggacggccaagtagggtggatcgcttgtgccttggagttccagacaggcctgggcaacatggtgaaacctggtctttttgttttgtgttgttttgagacggagtttcgctcttgttgcccaggctggaatgcagtggctgggtctctgcttgccgcgacttccgcctcccgggtttcggtcgttgtcctgcatcagcctccagagtggctgggattgcaggcataagccaccaagcccggctaattttgtattttttttttatttttattttggtacagatggggtttctccctgttggtcaggctggtctcaaactcccgacctcaggtgatccacctgcctaggcctcccgaggtgctaggattgcaggcttgagccaccgctcccggcccaacttattaatcagaaaggaatagatcgtcctggtgtggtggctcacgcttgtgatcccagtacttcggatggcccagcgcggggtatcccttgagcctaggagttccagacctgcctgggcaacatggtgaaacccggtctctctctctctctctttttttttttgaggcggagtttcgctcttgttgcccagggtggagtgcagtggctgggtctccgctcgcagcgacttctgcctccagggttttagtagttctcctgcctcagtctccggagtggctgggattgcaggcctgaccaacattgctctgctaatttttttttatttgtttttggtagagacggggtttctccatgctgggcaagctgatctcaaactccagacctcaggttatccgcccacctcggcctccggggatgctggaattgcaggcgtgagccagcgcacacacccaatttatttttatttcattttttatttttatatatatatacttttgagacggagtctcactttgtcacccaggctggagtgcagtggtgcgctgtctcggctcactgcaacctctgcctcccaggttcaagcgattctcctgcctcagccgcctgagtagctgagattacaggcgcccgctagcacacccatctaattttttttttttttttgtatttttagtagagatgggttttcatcatgttggccaggctggtctcgaactccggacctcaggtaaacccacctcggcctcccaaagtgctgggatgacaggaaggatcggcctggcgtggtggctcacgcttttgatcccaggagtttggacgggccgagcgtggcggatcccttgatcctaggagttctagaccagcctgggcaacgtggtgaaaaccggtctctctctctctctcctttttttttttgaggcgtagtttccctcttgttgcagggctggagtgcagtggtgcggtgtcggctccccgcggcctctgcctctgggtttgggtggttctcctgcctcagcctccgagtgactgggattgcaggcgggagccaccatgcccggctctttttttttttttttttttttttttttttttctggtagagacaggtctctccatgttggtcaggctggtctcaaactcccgacctcaggtgatccgcccgccacggcctcccggggtgctgggactgcaggcgtgagccaccgctcccggcccaatttattaatcagaaagaaatagatcggcctggcgtggtggctcacgcttttgatcccaggactttggacaaccgagcgtggggaattgcttgagcctaagagttccagacctgcctgggcaacatggtgaaaatctgtctcttattattattttttttttttttgaggcggagtttccctcttgttgcccaggctggagtgcagtggctgggtctccgctcgcggcaaattctgcatcccgggttttggtggttctcctgcctcagcctcctgagtagctgggattacaggcgcctgccgccacacccggctaatttttttttttgtatttttagtagagacgggttttcatcatgttggccaggctggtctcaaattcctgacctccggtgatccacccacctccgcctccccaagtgctgggatgacaggcgtgatcggcctggcgtggtggctcacgcttttgattccaggactttggactggccaagcgtgggggattgcttgagcctaggagttccagaccggcctgggcaacatggttaaacccagtctttttttaaattcctttattattattattattatttttttttgagacggagtctctctgtcgcccaggctggagtgcagtggcgctatctcggctcactgcagcctctgcctcccagggtcaagggattctcctgcctcagcctcctgagtagctgggattacaggcgcccaccaccacacccggctaatttttttttattttttagtagatcgtggtaactgccttaaaatgatgattgttcagaaagtcagtttaatttagatactaaggatattgaggttatgtaacatttgagcaagttctaaaaaaaagagaaatagtatatttaattgctaataaagtattgtcaactcacaaatatattcacatagcatacatttcaagagcagaataaccatgaatataaaaggaattagcaaaaacgaaacaaaaaagacatgaagaaataaaaacagatggaacaaatagcacaaaatacgatgaaagttataaaagaaactatgccaacaatcacaataaatgtaaatagactgaataattaagagaaaatgactataaaacagaattagggcacgcgtggtggctcatgcctgtaatcccagcactttgggaggatgaggcaggcggagggatcacaaggtcaggagttcgagagcagcctgaccaacatggtgaaaccccatctctgctaatacaaaaattagccggcgtggtggtgaacatctgtaatcccagttactcaggaggctgaggcaggagaatcgcttgaatccaggaggcagaggttgcagtgccgagatcacaccattacactccagcctgggcaacagagcaagactccgtatcaaaaaaaaaaaaaaacacacaaaaaaacacaaaaaacagaaaataaacagtatgaaaagacatctaaaacataaagtcacagaaagactgagagagattgaaaaaagatacacctgtcatatgtacctaacccaaagaagggttggaagctatattattatcagataaaataggctttgggcaaaaagcaatatgggagattttttaaggccacaatataatgataaaaattctaataaaccaagggagaaggtaatctaaaatgttaatgtatctaataactagcactcaaaatacatgaaagcaaaatatgacaaaattgcaaccctcagagggcaatttaaatacatatctcagtatctgataaaagagacaaaaaacaatcagcatagacatagaagatttacatctctctagaaaattaacaagcttgacttaatgtacagaaaaaacatctctccaaagtgacagcattcacccccccaagtacatatgtactgagccataaggaaaatctcaacaaattccaaagaagcggaatcatgcacccatctttctctctaaccataatctcattaaactaaaaacaataataaaaagataaagtaaaaagccagaaaggcagatgctaaatgagaaagtgacagaaaagttacagattttgttaagcatacaaagcttctatggggtaaagcagtcaaagggatatgcaaatttacacagaaatccaaccgatataaatccttgaaagatactacatacagatatttcatcagttctcacatgccaaacccagcaaagccaaactttggagcctcccctgcgagcagacctgccacaggaggagaggcagcacaaacctccctttgcagtgaaaatgccacattgtgtgtgcttcttaccccatcacctctttggaagtggccccactcagcgctagctgagaatcgcttccctcataccactctcagtagttcaccccaagacacacgggacaactctgtacctggtaagtcattgtgaatccaattaataatggcattcagaaagttaggaatctttgaattattagattcatagtgatattcaaaagaaagaaaacgacatcatttctgttccacgcatgttgcccacattcactgcgtaaaaggcaaagggaactgtgagtacccacaaagaacctgatattgacggcacatacatttcttcattaggaagaataaatttagactgtaacaatttaaaaaaccagaaaatacaactgtacattttagttcttattaaaatccaagagttttaacttatttgctccttgtttaggtaattagtgtctaaaacatttcaaagataacatatatagtggctacgatttctagtactttttaaaaattcaagcccagtctcttctaattaaatgtataaatgatttatctctgtctttcttaaaaagaaccaagagccccaattaaaaagtaaaacttaaatttcctcttaaaaaattgttacgtcggccgggcgcggtggctcacgcctgtaatcccagcactttgggaggccgaggcgggcggatcacgaggtcaggagatcgagaccatcctggctaacacggtgaaaccccgtctctactaaaaaaatacaaaaaaaaattagccgggcgtggtagcgggcgcctgtagtcccagctactcgggaggctgaggcaggggaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaattgttacgtcaaaattatctaataaaccatagttcagaaaataatttctgaattaagaaaatatgaagaataaaaccaacagtttatgtgctgaatttcacatttttattttttattatttttaaaattttgttttaagttctagggtacatgtgcaggagtgttacgtagggaaacgtgtgccatggtggtttggtccacctatcaactcatcacctcagtgttaagcccagcacgcattagctatttttcctgatgctcctcccccacccgccctgacaggccccagtatgtgttgtttcccttcctgtgtccatgtgttctcactgaacctcacatttttaaatacagcatatgccaggtgtcatttcagtacccataattatacatagtatatgtatatgtgtaaatatatgtatatgtgtacatatatgtatgtaatatgtgtatgtaaatattatgtaaatatgtatgtatgtaaatatatatgtaaatatgtatgtgaatgtatgtaaatatatacacatgtaaatatgtatgtaaaaatatgtacgtaaatatatgtatgtaaatatatgtatatataaatgtaaaatatgtaaatatttgtaaatgtaaaatatgtaaatgtaaaataaatgtagaatgtcaaatgtaaatgtaaaatgtaaaataaatgtaaaatgtaaaataaatgtaaaatgtaaatgtaaaatatgtaaatatatgtatatgtgtaaatatatatgtgtaaatatatatgtatatgtgtaaatatatatgtgtaaatatatatgtatatgtgtaatatatatgtatatgtgtaaatatatatgtatatataacacagcatacagcatatgccaggagtcatttcagtacccataattatacatagtataattatacatagtataattagactactatgttagctaaaaaatgttgattagatacaaatgtataaatttatcttctctaaacgtggaaattctctagaggctatttccagcttctgtgtggattgtagagcaggctgctacctgtaccccaaaaatgaacaccttaaaaaaaagacaactttctcagcctccctattgcacacacatatgaaaaatatgttaaattcaacgccaaatattcctgagatcaacacagcagtgatcccaaagagaaaatttctctttgctaatgggcacaaacttgaagggcaaagcagtggaagggtaagtctgcagactcgcgtggggctcaagtcagaatcacgtggaagatcattgccacatgtttttgtttttttaaatagcaaccaccaccaagtggagcccgccgggtttagtagatattaaacctctaaggagtggcacatccgagactgaaattcccatcttttgattcccagctcaaggtctctgaaatgccagcaccagctgtgaaattgttcttctgcattttcatggagaccttttcttctatactgccatactcttttttttggaacagttatacctgatcttcctatttttgtgtgtgttccaccgaaactttttcactctaaatacttccctctttccaactgagcatttacatctgtaacaaggacaaaaacatctaacatctctctcacccttggtttgtgttttgttttgtttgtttttgagacagggtcttgctctgtcacccaggctggagtgcagtggcgtgatcactgttcactgcagcctcgagctcctgagctggagcaattttcccacctcaacctctgagtagctgagactataggtgtgtgccaccacgcctggctaatatgtgtattttttgtagagatgagtttttgccatgttgcccaggctggtattgaactcctggcttaagtgatcctcctgcctaggcttcccaaagtgctggaaggaattacaggtatgagccaccgtgcctggcctcaccattgttaaaattatggaaatcgtgtttgcaaagcaggttggcctgtttggaaaagggtgtcataatttctcaggtagctccaaaaagagaaagctacgaaaattaccttaatacattcattacagtctcagtataagattatagcttcctctcccaaagcgtaaccacaacctgacgcaggatgagttggtttgaaaataccgcatacaatatcctcttgagtagaatcataatttagaactctaaaaatgaccggaaacaaaactgtccaagtttgtttaacgtaatgtgtttcaacttatttgactagaaaacccttcattcgtgcaacacttataaatatcccatggcaaatctagttttctatgaataatgaacgaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatagcccatgtctggccaggctccatggctcaatcacacctgtaatcccagcaatttcagaagctgaggcgggaggatcactggcctttagtgatccttgaatgaaactccatctctaaaaaattaaaaatattagcttagagaatcatttgggcccaggagtttgaggctgtattgaactatgactatgctactgcattccagcctgggcaacaggctgcttaaacctggaggggcagagcttgcagtgagccgagatcgcgccactgcactccagcctgggcaaaggagccagactccgtggcaaaaaaagaaaaaaaaaaaaaaaaagagattctattcacaatagcaacaaaaccctgagaatatatctagcaaagtatacacaggcctttcatgaagagtattgccatagcctgaatgtgtctcccaaaattcatgtattaaaacttaattcccaagatgatagtactaagaagtggggcctttaagaagtgattaagacataagggtgagccctcatgcatgagattagtgccttccttataaaagggcttgtgggtggtggtaaatctgtcccttctgcctcatgagaacatagcatttgcctgctccagaggaagcagcattcaacgtaccatcttggaagcagagaccaggccctcactagacactgtgtctgctggagtcttgatcttgttcttcccaacctccagaactgagaaaataaacttctgctctgtgtaaattacccagtctcaggtgttttgttatagcactatgaagggactaagacaaatataaaaattacccagggacttaaaggaagaactgactaaactgaaatatatgccatatatattatgaatcgtaggactcaatgctataaacatactacttctcaacaaattaatctataaattcaagaaattcctacacaaatcccaatagaatttttttgtggaactcgagaggctgatcctaaaattcatacagtcacttgaggggccaagaatagtgtaacagggctggcggggctggtggctcacacctgtagtcccagtactttgggaagtcaagactggaggatggtttgaacccaggagttcaagaccagcctaggcaacatagcaagatgttgtctcaaaatattaaaaataaataaataaataaataaaaagaaggttaagtatgcacattttgttgtgaatttcaattttatagtgatttttttttttttttttgagacagggtcttgctctgtcacccaggctggagtgcagtggtgccatcttggttcactgcaacctctgcgtgggctcaagcaatcctcccgcctcactctctggagtagctgggaccacagttatgtgccaccacacctgactaatttttatatattttttttgtagagacggggtttttccatgttgcccaggttgttctcaaactcatccacctgccttggcctccgcaagtgagatcacagacatgggccactgtgcccggtctagtgcgcttttttttttttttttttaaccaaacaaacgatgaagtctcaggagtaaaagttgatacacaagtaaattttattggtaatgtttttgtgtggtctttaagcagagggaaaattagtctgcattatggtgtatccagactaaataactgatattaaaatgaaattatccttaggatttacaatcttagagaaaactttttcattttttttgagttacaaattatcttcacttacatttgagaacagtgagtcacagagggattaagtatcttactcaagatcttgcaagtgtttggtttgaacccaatcttttcactctgcagaactcagagtcactcttatttggaaactttttaactgatgtggatcctctaatatgggcttcctattattcattccgtattagtcagaagttttgcaagcaggcagaattcattttgccaattacgggattttccctcagttgcagtcaaggttcataaaactataactatttatctttaattataaattttgtttttgagacaaagtcttgctctgttgctcagactgggatccagtggcacagtaacagcccattgcagctttgaactcctgggctcaagggatcctccgcctcagcctcccaagtatctgggactacaagtgcatgccatcatccctggctaattttgttaaaaaaaaaaaaattgtagagatagggtcttgcttcgttgcccaggctggtctcaaactcctggcctcaagcaagccttcagccttggtctcccaaagtgctgagattacaggtgtcagccattgcacctggccaaaactgtaactatatatacacacacacataactacatatatatgtgtgtgtgtatgtatgtgtgtgtgtatatatatttttatatataaatagatatatctgaaaggcatcaaaagaaaaaagctgtaacttttagtcttgatcttgatagtgacttgattaggctatctgtttaacatcaaagatgcaaattaatgctttctttgggtgagcatattaaaaatgcagaaaatattggagtagttttttatgttaaataaattgtattctgtgtatttaaggtatacaacatgattttgtgggatgcatatagatggttaaaaaaattactacagtgaagcaaattaacgtatccttcaactcagatagttacccgttttctttttgtttggtggcaagaggagcttaaaatctcatttagcgtgaatcccaatacagcacaattttattacctatatttcttgcgttgtacattatatttctaggcttgttcatcctacatatctgctactgtgtaacctctgagctatgtccacccattttctctcttgccccccaagtaatttcctaaagtgtctcatataaaaaggcagtagctttcagcttaaactttttctctgtatatatttaagtcaatttctttgaggtatgtttttctctccagaatagttagatgtaggcataccactttaatgttgacactagttcacctagaacttatcttctgcaaatctgtctctatgtccatctctgtctccatctttgtctctatctttatctctgtctatctatctatccatccatccatccatccatctatctatctatccatctatctgtctatctaactaaagcaaattcatgcccttctcctatttatggaatcgagaccataaacagaggtgagggaaagaatttggcaggaattgcgatgtgtattacctgtggcataaggaaactttacagaactagggtcaaaagtatactttctagttctttcccatggcttttcactttgatgtagtccttatcaggcaactgaggttttatataagtcccctgattcttagaacatgaaggtgtagtattcaagtttggtcccttgaaagcacaatttttgttaaaaaaaattaagaaaattgtatgatttcctcagcaaatacatattgatcatctgttatacagccatgagaagtggttctgttgaacacgtttattttatcagatcccaattctaaaccaggcatagaatggaaaccatgaaggtaggatgaaataacttctgaatgtttgaaaatagtgtacttaaaaataaatatcaggtgtttttgttttgttttttgttttttgtttttgagacagggtctcactctgtcacccaggctggagtgtggtggtgccatctcacctcattgcagccttgacctcccaggctcgggtgatctcccacctcagcctcccaagtagctgggactacaggcacatgccaccatgcccagctaattttttgtattttttgtagagacagggtttcaccatgttgcccaggctggtctagaactcctgggcttaagcgatcttcccacctcagcctcccaaagtgccaggattacaggcatgagccaccatgcctggctgaaaataccaggtttttaagtatcagcactgcctcttcaatcttttctattactatgttgtgctcagtggtattttttattgaattagagcagtgctgttcaatggaaccttctttgaggatggaaatcttttatgtctctgctgtgtgggtatggtattagctgggtatggggcacctgcctatagtcccagctactcaagaggctgaggtgggaggatcacttgagcccaggaggccgagtctgcaggttcgtaccactgcaattcagcctgtgtgacagaatgagactcagtctcagaataaaatgaaataaggaaataaaaatgtaattgttgaaataagaaactagtggatggattagacacgagaagaaagaattaattgtttagacgattctctccaaaaagtaagtcagcatgtcacacagagagacatgaggatagatgatagggcagaagttggtgggcttggaggggagaggaagatcagaatgaggtccaaaatgtgtcttagtgaaatcccaggaggagatattaaaattatattagaaagtgaaagaaatagaagttttatttatttatttatttatttattttgagaaggagtctcgctctgtagcccaggctcgagtgcagtggcacgatctgagctcactgcaagctccacctcctgggttcacgccattctcctgcctcagcttcccaagtagctgggactacaggcacccaccaccacgcctggctaattttttgtatttttagtagagatgtggtttcacctttttagtcaggatggtctcaatctcctgacctcatgatccaccagcctcaggctcctaaagtgctggaattatacgcataagccactgcacccggcccaaaagctttgtgtttttacaaatattacacgtttcttgtttaagaaaaaaagtcttcacaataacgtaggagaataagagaaacatttttccaaaaaagagaagtcattgtgattattttatcttattggaatgttggataatatagtctgcttcagtaatcatcaagcatgctatggattttccattttcataggatctgtatctcggttaaggtaatactggtaatttttgtactctatgaaaaatataggccaaaatcatagaccttgcatagaagctggatcatgaagacagctctggaggaacacacaggtacacacacacagacacacatatatataaagtatacacatatatattttttaaaagcttttaaagcaaaagccggccctgcccctctcccagagttggcggcctctcccctctcttagggtgggtggggacagtggttgcatgggcagctttccttgtgagccaaaggtccctctggacacatgatgcctggccacgccccctttccctttcatctttctcattaaccaatgggcttggagcattaaggccacgcccctattctgccttctactgcatccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccaatcccgaggttcaccggactgggacccccacaccggtgcctctgggctacccccaccaaagttttgccagtcagccccaccccttcagcaagcagcccagtctctgccctcaccaatcaccccagggtgactttgggcaggtgaatcctggggctccccgctcctttactgggccctcatctcctgccaccccaagcttgacctcccagggctttttgggctcacatctccaaggacctgggtcccacagccccagaccccaccctcaccagtcatccctgggtgactttaggctggtgaatcctggggctccctgctgctgactcttcccttccctcctgctgcctcaaggtggacctccctaggctgtgtgcactggcgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcaagactggcctttgatcttatgacccagtcccctaagcattgccaccccatttctggttcctcttgtcacagcacaaatttccagctggaaggggaatggagattgggacctaggagcaagaggtttcaggctgcctcactcccttaacataaacattgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagtcagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaagagtataccagacctctctctgaaatgaggcttgggttgtcctctttctgataaattcccagatttaacagaaaggctgccttctgccatgaggatacattgatataagagtttgagaggtactggtgcacttcttcacactaacagacgtgtgaggatgtatgactctaaaccacatggcatacagttcctgccaacttaatgtttacttttctagctctgcctctggttttggtccctggcagctgatgattcttggtaataccccagagtttggagtcagaagactgagtttcaaagttcgtctgtcgcctttttcttttcttctttttttttctagccatgatatcaatctctttgagtcactaaatgattgtgacaacaccttgtacagttgttggtatcattaaatcagatggcgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagattgtggatggactgttgggtacctgtgaagaattctgggtttgaatcctgcctctttgtctgctagggatatgaattagggcaagttgcttgacctcatcgggcctctcttttcacatctgtataatagaggtggtattgtttcacttccatttgtgaagtttaaatgagatctgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccgcagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcagggcagccctccaacctcctcctccaggtgggacggggtgcccctctgccagctgagacagtccacacacaccccagccctaatgattgctctctctacctctccccccactcctcctccacctcctcctctctgcatgcgcctcagagcccgtgccaagaactagcagtagtcccagactcgaggtctgtaaaagtcagtcaactgaagaacaccatcaaatctttggtaagagtccactggggtcccctgattccacgctgccaatcctgggctctagtttctccttggggccctgaagaaaggggacaggggcccctggtgccaagggcgaatagggagctggggcacccaggcctcacctggagggaccccggagcatgcagcatggctctttttttgctgccctgtttgctgactctcccctctccagacgcccctgctcgagtccttgctacacacgccctgggattgttgcctcttggggaagtgctagcctgactggttgtcaggggccctgtatttctgccatgactcagtccctaatttgctctttgattctggacaagccacctctcctttttgggctcgtgtttccagaggaagtagtgagtatcataggtctctgttagctctgagagtctgagatttaaaggcctcctagaatggaaacctcagggccaaaggctcctgtctgtccttttccgccctaaatctgctgtgaagaaccgtacttggcccgtacgtgctcagtaaatgtttattgaatgaatgcacttttctaaatcacaagctggcagaagggggggcctttctcaaactccatctctagaggtttatgttactgtcctgtcaagagattccagattcagaccttgagttctgtggctgtgggcaaaagccaacaaagacccaaatcctctgtccttgggagcttgaggagagtttaccagttcgagttcccactgggtctgagaactttgcctttaaaatccattcctggtccctgcctaccacttcctgctctggggaatagagttgagggggccaccctccatcaccttaatgtgactctccccacagaaacaacagaagaaacaagtggtacatcagctggaagaagtaacatgatttctttgtttgctcgcgacatgactgctcggtttgggggacactcagatgtagaggccccgagtctcgtctcacccactcccagcctggggaagaaggctaaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacggtgtgcagttttctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctgggactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccccgtcccctgggagcctggcttcgcagacagaggagtgagcctaaaggtcccttctgcaggatggagtgtcctgcccagaaggcagcatggccatttctcactgcttttttgtatggttgttagcggcagcttgggactgagtcagctgctgtgggtgagttggggggcactctggggagagaacacaggacgtagagcttggaggccaagtgcctgccatgcctttacctggctgtggtcttggccaagtcctaagtggggtattggctacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtttgggactatgtgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtggttgcgaggattaaatgggattgctagcatggtatctggtgaagcactccataaaagttcaaacagtggtaataataacagtaataacaatagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctccccagattgaaacttctcactcttcagcagttctccagccgcagtaaagcacgtatggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtagagccagaggtggtcctgggactgggctttgtggaggtgggggcagagagggagatggtagcatgtccagcctccagcccctctctccagggccctttccccctgtgctttgggcaggtttgctcgttgaagaaggagaagaagcatgataaatatcgggtagagacgctggagaggagcttgtccaaactcaaacaccagatgggtaagatggggctggcgtgacctgacagcaggactggcatcagagggctgtgagggtggcttggagtgccccagcgaggtgggtggatgggaagggctttgaggcagagggaaagaggtctgttccaggagacggcaagtcttgtcatctcaatgagcctcagtgtccccatcagcaaagagggcccgttgtcagccacccgcagtgctctttctctgaaagtggtttggaagactggctaccatctgggtgcgaggaatcattagcagtgaggccaagtttgaggagcctgagaggagctgtgcgccaagaggagggtttttcttttccgagaatccagaggcccttattatctgcttcctttctcagctgaacccttgcccccggagcccccagcagtgccctctgaggtggagctgcagcacctgaggaaggaactagagagagtggcaggagcgctccaggcccaggtggagtacaatcagcgcataagtctcctgaatgaggggcaaaaggagagacttcgggagcaggaggagaggcttcaggagcagcaggagaggcttcgggagcaggaggagaggcttcagcagctggccgagccacagaacagcttcaaggagctggtgcgttgccccagctggggagcctgccctcctccctagccctccaggcctttgtttccccacctataaaatgtggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggcaccagcctctggggaggggaggtgccaggccagaggcagctccagcccgggggcaggtgaccccagcaccctccagggcagtcctgtggctgtttcttgcttcctgccctctgattttagaggtgggtagccctgggctcctcccaggtctggacatcatcattccagctagagacatggagcaccgccaatcacaggggaagagacagagtggtataacagtcttcttatgccagacgcggtggcttacgcctatagtgccaacactttgggaggctgaggcaggagaatcacttgaggtttggagtttgagatcagcctggccaacatggtaaaacctcatctctactaaaattacaaaaacaaaaaacaaaaaaaggaagaaaaattagtggggcatggtggtggcgcatgcctgtaatcccacctactcaggaggctgaggcacgagaattgcttgagcccaggaggtggaggttgcagtgagctgagattgcaccactgcactccggcctgggccacagagtgacactctgtctcaaaacaaaacaaaaagactccttagattaaaactggattccagcctcagttccactggtcaccattcaagtacttcacatctctaagtctctgtttctttaacttcaaaaggaagttagcattttccttacagaggtgctgaggattaaatgagataatacatgggaagcattaggcctgtagcacatttagcagatggtggttggctcccactacttttctaccattctgtggcctacagttgaaatggtgggaagaggacatgagatttgaggctggggaaggaggcatggggttctaggaaagggaggcagtcacttaggcctggagtaaggggccaggggcctgggcaggcgacagagccccacagtgccctcgctaccctattaatgggcccagaatctggaaaccagccaccacgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtgactgcagcagacccagctaatgaaccagctgcagcagcaggaagcttggggcaaagcggtggccgagatggcctgccaaaagttgcaggaggcccaggggagggagctgccgaggatggggccgtgagggggacgacctgacaaactctgtgccttctcactctttcctggccccttaggagcgcctggaagctgccagccagcagaaacagcagctaacggcccagctgagcctcatggctctccctggggaaggtacgggagaccgcttagaggaagaggagagagccccaggaggaaggggggactgctagcagcataggattgaggagttggaagagacctttagaacagctggtcattatactaaccgggtgcctgcactaagttcagcatcaatatggtgacctcctgggagcggggggccaccaagttgcctaaggatggctgaactggccgaggtcagaaagggagcaggtcagaactcccacaccgaccagtagtgggaatgtgcctgggcagtatagcaagatcttggttcttcaaagtaaaaataaataacagcagctcattcctctctggggagggcctggctcagggttacacaatgagggtggaggcagaggtgggcccacaatacttcccttgttgagttgtctgaagacccctctggccacccccaacaggacacggaggagaacatctggacagtgagggggaggaggcacctcggcccatgccgagtgtcccagaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtggccaacaggtgcactctctgaggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagcggtcccagccccagggcctgggggcgagtctgtgagtggggagacccaccgggccctgcaggaagtcatggagaagctggcccatgccggaactcacctccgccttctccatgacttgaaaatgccacctgagggcaggtcgctgccgagatgtgaccccattattttggctccagagcggctttatggaccacctggaggagaaggcagacctgagtgagctggtggagaaagaagaacttggattcttccagtactacagagagagatgccatcagtgagtgggaggccagggcgtggcagggggagctgcagggctgttggaggggccccagcgtctgagccctgtcctcccgcaggaaagtttatcaccctataacaaagccagggggcagtgccaaagatgcagcaccgggaggaggacaccatcaggctggccctggacagggaggagatgaaggtagagtgtgcaacatctctgcgggggtgggggtggctgtgacggtgagcgctggcagcagcgtgacagctgagcacccctccctccaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtggtgagtagagccctcaggcggggtgggcaggcaggagcaggggggctctcactgagctcagatccccgcctccctctctccaaagatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatgaccatcgtcaaagacctgctcaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggtcattagcatgcatattgagtttgcccttacgtggtgggagttcaaacacacaaagacccactatttgcacaaaactattcttgctggtttggaataggctgccatgtgtttttaatgttattgaagcatgtatattcattacagaattcagataaaatttgcctatgttctgctattgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctatggattaaatcacatactggcatatttaagctgaatgtcaatctggaaaataaattgactgtattaacagaaataccactctttgtgtagatatttgtcatatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagaaggcaacattggaaggttagagttcatcagaaacagaattctaaaatgtgagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgcaaagtgctgtttttgccttaaaattttattctgtgtgtcttgaaaaatatagtattaaaggtattgatactgtgcaaatgctgagcatgcttggcatgagataatgtttcatttttacaaaattgtaatataactatgcaagagtttattaaaagaacacaaaataaaaaagttatgggattaacaaaagttatggggtgaaaaagttatgggataaaaaatgtaaaaaagttgtggcaaaaaaatcttgtgaccaaaaagtagaaaaaagttttatgaaaagttaccaaaaatagttatgaaaaagaagttatgggatttaaaaaaaaaggcatgggataaaaataaaaattaaaattaaaagcaggcccctgtcagcaaagcctggagaagtggggctggggtctctccaccaccacactgtccctatctccccttcccagtcacccctttacaattagggtagcaagacaagaccactgtctaacgaggaaagacaaacagaccctttgccaccttgaccagagctgagtccttaaatttctggatgatattgttatttaagagccagaggctggtggagttggtttgtttggaggaggcctcatggcctccttactctcaccatagcaacttttccctcagtgggggctcgaatcttcttattcagagaggtagctgaggcaggacagtggggctaactgtggaccaggcgaaggcatgggctgctggggtggccccccttccccggtgtatatattgtgtctgtgtaaggttttgtatattccagagggtagggccacccctgtatcatacctagcggtggttggaggtggcacatggggaggaggttctaataattatttgtggctgggaaacttacttattgctagcataggacagaggaagaaggcagggatggggtcatggcttcccagtggtgtgatcacagttcactgcaacctccaactctcatgctcaagtgatcctcccacctcagccgcccaggtagctgggagtataagcatgcactactatgcctggctaatttttaaattttttgtagagaaaaggtcttgctatgttgcccatgctggtcttgaactcctgggctcaagcgattctcccatcttggcctcccaaagcactggggttacaggcatgagacattgctcctgtccataagattttctctttattactgttttgttgttggtggtggtgttttgttttgtttttattttttgacagagtctcggtctgttgcctaagctggagtgcagtggtgcaatctctgctcactgcaacctctgcctcctggttcaagcaattcttatgcctcagcctcccgagtacctggggttataggcataagccactgcgcctggctaatttttggatttttagtagagacagagttttgccatgttggccagattggtcttcaactcctggccttaagcaatccgccctcctcagcctcccaaagtgctgggattacaggtgtgagccactgctcctggctaagatcccatctctatttaaataaaaaaagaaaattcagaatctatggaacacagaacaccaaaggccagttatttacctctctgaggtaatctgtgtaaacaatttgatatatatcctttcaagttcatacttgctatgcatacatatatatacacacatacattgacatattcccccttccctgctgtcatgctattagtcttcttttttttgtagaaattggaccaactctatgttctttgctggcccgtatttctcctattcagtgatgtgttatgaatatctgtttaagtcaatgtatgcaactctttaatatcattttaaaaggttacgacatacgatcatatgaaggcattagaatttattccaacagttcccttttgcacatttaataatttccattgatttgccaggaagaacattctcgtgtcatggctaaatccttttgtatggacatccttaattattcccttaagataaacttttaaataaagttgctagattagtctcgtttcttaagttcctttttggtagtttatatgtaacactgtagttttatatgtacttacaaatacctatagtgccagtagaaaatgggataaaattaaactctttcacatatgccaaatatattttgatttagcgctttattaagtgcatgattacagtctctgtatcttttgatttacctttctatctttacaattttcagccgagacacttagcggtcacataataaattaaggttttctttttttaataatctccatctttctaaatatggtgagtcacagtcagctatttttggattgttgaaagctgtgactgttctaaatcggagcccagaaatcatgccacttaccaaatatgctttgtcttccaacatcagagtgtctggtagaaggtgactgttcttggaatttaaaaaatctgaacaggacaagacaagaatctggacactttttctgtttctgataatatgattgagtaggtagacatgctggataatccttgcaaagacatacttgaacttccccaaaaaaaaaataaaatccagaatctctaagaatgaagatggagtgaaaatcagaagggctgctgagagaataatggggaagcagccccagttatcaagggacatgtccatgtgttcaatagaaagtttcagatgtaaaaaaaagttgagaaaaataatatatatattatatataataaatgatataattgccctacatatacacatcatcaacaatttttcattcatggtatggacagtttttttttttttggttgttttttgtttgtttgtttgtttttaaaggtgggattttgctgtggttgcccaggctggagtgcagtggcatgatcttggctcactgcaacttccacctcccaggttcaagcgattctcctgcctcagcttcccgagtagctgggattacaggcacccggcaccacatccggctaattgttgtatttttagtagagatggtgtttcaccacgttggccaggctggtcttgaactcctgacctcaggtgatccacctgcctcggtctcccaaagtgctgagactacaggcgtgagccaccacacctggccacagccagttttgtttcatttacattcccacttcatttatatacattccttcttcctctgaattattttgaagtaaaacctatacatcctatcatttttaattaccttatatgtatctgtagaagacaaggaattcttaaaaataaatatattcacaatgccattaaatatcaaaaaattaatattctgaaaatagccacaaatccagagttgacattttgttgactttctcataggtgattttttttctagtttatctatttcaatcagataactgtttgctcatatttacattccttactgaacaatgtctaaacttaaactgacataaaatggagatgatcttctaaccagatgcttagtgtaagaaaaaacttcaaactgcaagaggagtccctccaaatacagaaaggatcagtattttaagaggtatgttaactaaaatgtggcaatgtaaggagcaaagcaggaagaacctttaagtcctcaacttacaagtcaatttcatagtcagtttccctggtccttccacaacaacctcccccatctgttttctctacaatggaggtaacaatagtagctattccagagcaggaaaaggcttagagcagtgctagaagagggtcgtggctatataaagtttagctatttgtatattgtaacaaacctacaacttttttttttttgtcaataatacatttcttttggaaaagtggcaccctcctgtgggggacacctgcagttccactaagcgaacatcggtgtctgctaacctttgcctctttgtctctcaataatatactgtcaagctgttccttgatttagcacttttgtatacttttttttttcctctcccgtttcctgagacacagtccctctctgttgctctgtctggactgcagcagcgccatcatggctcactgccacctccacccccgggctcaagcaatcctcctaggtcagccttgggagcagctgggactacctgtggggcggctaatctttgtggtttttgttttgtttttccgttatgggaccgggtttcgggccaggctcagtgactcacgcctgcaatcccagcaccccgggaggccgaggccggcggattacctgagggaggagctccagaccaccccgaccaacatggagaaaccctgtctctaccaaaaaaaataaaaactaaacaactaatggggtatggtggcacatgcctgcaatcccagccactcaggaggcaccatttattaatctttttgacatcagatgctcagtggctcacacctgtaatcccagcactttgggaggccaaggcaggtgaatcgcttgagccgaggagttcaagaccagcctggccaacgaggtgaaaccacgtctctgttgaaaatacaaaaattagccgggcatggtggcacacacctgtaatcccagctactcaggaggctgagacaggagaatcgcttgaacccaggaggtggaggttgcagtgagccgagatcacagcattccactccagcctggacaacagagtgagactctgtctcaaaattaaaaaaaaaaaaaaaaaattaaccagccatggtaccacacacctgtagtcccagctactctggggctggtgggggaggactatttgagcccaggaggtcgaggctttagtgagtttgatcatgccactacactctagcctgggcggcagagtgagttcgtgtctcaaaacaaaacaaaaatagtttccagccaggcgcggtggttcacgcctgaaatctcaacactttgggagtccaaggtggcgcatcatctgaggtcaggagttccagaccagcctggccaacgtggtgaaaccccatctctactaaaaatacaaaaattagctgggcatggtggctcatgcctgtaatcccagctactcaggaggctgagacaggagaaccgcttgaacccaggaggcggaggttgcagtgagccaagatcgcaccattgcattgcagcctggggcaacacagtgagactctgtctcaaaaaagaaaaaaaaaaagctaggcgtgagaagtgccttgattttgtattttcaatctgccaatacttgcacaggctctggctgcaaaacttttgccggtcaaacattcgcatttgagaaaccacgtccctgctgagagatagatctagacacagccttaactacatcatcagtagacacatgactggttttctttgtttgtttgtttgtttgtttgttttgagacggagtctcgctctgtcgcccaggctggagtgcagtggcgtgatctcagctcactgcaacctccacctcctggattcacgccattctcctgcctcagcctcccgagtagctgggactacaggcgcccgccaccacggccggctaattttttgtattttttagcagagacggagtttcaccgtattagccaggatggtctggatctcctgacctcgtgatccgcctgcctcggcctcccagagtgctgggattacaggcgtgagccaccgcgcccagcgacatatgactgtttttaaccagagggaggaaaatggctttcagatggttgtgtagctggttttaacagccttcagcagcgacactggcagcctccgacctctcagaccgagtaagccaagcgaagcctgtaggcgcacgcttgcagctcagcgcccgcggggactccggaagcctctcccaagtggcgcggtccgcaaggggcggctacagcttgggcgcaggcgccgctggctcaccggttctcttgggctcccctgggacgccgtaggatcgcaggcgcgcagccctcccggccgctctggccgccctgctcctcctttgaagaaagatagggccgctggcaggggccctccgcagccaccggggatggggctgaggccagtttttgtttttagtgcagccgccgccaggccgaccgccgggcttggctgcagccacggcgacactggcccgagttctgcgaggctgggggtgctggcgggcttggaggttgcctggcagctgctgcctgcaaaaagaaaaacaaacaaaaaagcagctgcagcttgggcgcccagggctagcggggcatggcctgggcagtcttgggattgcgagcgcgcgcggcctgagagtccgtacccttcgccgtgcctcctgccctcctcctctgccggacctcagaactgctggccaggccgtccgagggagtccggaccccactccgcagcctacagagatggggttgagcggcaggttctcagttctcgcccctctgcagccgccgccgggcagaccgcctggcttggccgcagccacggtgacatttggccctggttctgcgatgctgggagcgcgagcgagcttgggagttgccaggcagctactgcttgcaggcggagggcggctacagcttgggtgtccaggcagtggaacatggcctgggcggcctctggatcgcgagtacaccgagcctgagagcccgccaggccctgcccccgcctctgccagagctcaggaccgctggccaggggccctccgcagccaccggggatgggattaagtggcaggttctcgcccctgtgtagccgccatcgggcagaccatctggcttggctctagccaccgggacatctgtccccggttctgagatgttacgagtgcaggcgggcttagaggttccccagaggctgctgcctgcacacagagggtggctgcagcttgggtgcccaggcgggctggaggggcctggcccgggaggcctgcggatcgccagggcgcccaggctgagaagccccaagccgcgcatcccgcccggctcttccaccacagggagacaggagctgctggcatggggactccgcagtcacctgtgatggctttgagcggcaggttctcagttctcactcctgtgcagccgccgggacatctgaccccggttctgcgacgctggcagcgcgaccgggctcgggagttgacaggcggctgctacctgcacacacagggcagagggcagctgcaccttggcctgggcagcctccgaaatgcgtgcgcgccaggcctgagggcccccctggtggtgccacccgccccgctcctcctctgcaggagcctggagcagctggaatggccactctgcagggttatggttaagtattcttatcccatgcatgcacacaaaaaaggtaactattatgcgaggtaattaatatgttaattgacttcattttggtaatcatttcaaaatgcgcatgtagatagaaacatcacattgtaaactttgaatatgtacaatatttatttctcaaatatacctcagtaaagctgaaaaaaaatgaacaggattgaaaggataagcacacagttctataatagtagttggacacttcaatacctcattttaattaatggatagaaaaaccagacagaagcttcatgagaaatagaagacttgaacaacagtataagccatttagagctaatacacatatacagaacagtccaccccaaaacagcagaatatacattccttttaagtggatatggaactttctctaggataggtcatatcttcgtccacaaaaatatgtcctaatcatttacaaaagttttaaatcatacaaaatataatttacaaccacaatggaggaaacataaataaaaaatgaaacctgaaaaattcacaaatatgtagaaattaaacactacactcttaaactaccagtgaaagaataaatcataagtgaaattataaagtatcttaagacaaataaaaacaaaacataccaaaacttagtgactgcagtgaaagtagagtttgaaggaaaatgtatggacataaacaactacatttaaaaaaagctcaaatcagtaacctcactctacacctaaaaggcagtataaaaaccagagaaaactaaatctgaagctagcagaagtaaagaaataataaagattagagcataaatcaataaaatagaaggttggaaagcagtagaagaaataaacgtagctaaaagttggttctttgaaaagagtaatctcacctcagtagcctaagattcttctttaggaacgtagagaaagaacaacaacttaaatctaaggaactaaagaaaggagctaataacaattagggcagaaataagtgaaattcaaaaccaaagagagaaaaagggaaagagaagagagactacagattactaacagcaggactgaaagacaagctatcaatacacactataccataaataagtaaagctaaaaataattttatgcacacaaatctaatagatgagatgaaaaaaataaattcctctagagacacaacacatactaccaagtctcactgaagaagaaacaggtaacaaatagtcctgtattaattaagaaattgcatttgtaaataaaacctaccaaaaaatctagtcacatgttctttcactactgatttctatcaaatatttgaaggataaataattttgactgtacacaatcttttagagaaaatagatgagatgggagcactcccaactcattttataaggccagcattacaataacaccaaaaccaaaaaatgatatggagagaaaagaagactatagacaaatatcagtcatggacatatatgaaaaaatatcaacaaaatattgtgacatcaaattgaacatctccccatgtaggatgattcattatgtccaataaaaacaaggctgattcactattaaaatccaatccaagtaatctgctatagaatatttttaaaatattcttctcaagagatgcaggaagagcattcgatgaaatccaacatctatttctgaccaaaactcataaaattaggaataaaagaacttaggatatatgtttatatctgtatactatatggtgatgactgaatgatttttccttaagactggggacaggtcctattcgatattgtattagaaaatttgcaaagtgcaataagacaggaataagaaataaataacatacatattgcaaaggaagaagtaaaactgcctctatttgctgataaaactaatctttatatacacagtctacagtatttatgaaaagcttctaaaataaatacgtgaaattaagtgttttattatcaaaggtcaatatagaatgtcaataattttcctatgtgtgagtaattaacagttgaaaaaattaaattactatttaaaatagaagcaaaaattaagtgcttaggtattaatgtaacaatagaagtgcaggatctgtatgctgaaaactacaaaatataaatgcaataaatagaaaatttaaaaagaggggaatgaaatatttatgaattcagagtctcaatatagttaagatgccagtcttttccatttctgcttgtagagttccttcattaacaatgaaaattcctgtaagtttttttttttttgtagatatcaccaaggagattctaaaatttacatggaaaacaaaataactagaattgtcaaaacacttctgaaaaaaagttagaggacataaactactgattacaaggcttactattatgctacagttctcaaaatattgtggttttgttaaaatattgttaaaacactagatacgtagaccaatggaatgaatacagaccccagaaatagacccacacaaatatattcaactgcattttgaaaaagatgcagaggaaaaggggaaagtataatctattctgtaaatggggatgtaataatgggatctccccatgtaaaaaaaaaacgaaacttaatgcgtattttacaccttttacaaaagtggactgaaatagaccatataaaagtgtaaagtatacagcaataaaatactatcataaaacaggggaaattaggtatgactttggggtcattgatgagtttttagataaaacaccatacacatgatccataaaagaaaaaatgaaaaagcagactttgttatatctaaaaatgctcattctgtgaaagaaccattacaagagcaaaaagctaaaacaatcagggaaaaatattaagtcactgtattagtctgttctgctgctgctataaagaactgcttgaggctgggtaatttaccaggaaagaggtttaattgactcacagttccatgaggctggcaaagcctcaggaaacttacaatcatggcagaaggcaaacaaacatgttgttcttcacatggtggcaggagagagaagtgcttagcaaaggaagaaaagccctatataaaaccatcagattttatgagaactcactcactatctgagaacagcagcatgggggtaacctgcctccatgattctactaccttctgccaggtccctcccacaacacatagggattatgagaactacaattcaaaatgagatttgggtggggacacagtcagaccatatcagtcacgtatcttatacaagcttttatccaaaatgaataaagaacccttaaaactcaacaatacaaaacaaacaatccaatttaaaacaagcaaaaatcttgagcacgtacatctcaaaagaagacagacatatggcaaataagcatatgaaaacatggttattgttattaataagggaatgcaaaacataactacaatgggatactactacatgccattagaatagaaataaaaaattaaaatatcaagtgctcctgaagatgtgtagcaacaaagattctctttcattactgttgggaatgtaaaatgacatggtcactttaggagataatttggcagctttttataaagtaaaacatatgtccagtgtgaggttcagccattccactcctatatatttatcaatgtgtaatgaaaacaaattcacataaaagcccgtagtctaggcaaatgttttagcagctttacttataatctccaaaacctggaaacaaccaagacatctttctttttttttttttcttttttgagacggagtctcgcactgtcacccaggctggagtgcaatgtcacgatcttggctcactgcaacctccgcctcccaggttcaaggaattcttctgcctcagcttcccaagtagctgggaatacaggcacccaccaccatgcctggctaattttttgtatttttaatagagacagggtttcactatgttggccaggctggtctcgaactcctgacctcatgatctgcccgccttggcctcccaaagtgctgggattataggcatgagccaccacacccagcctaaccaacacatcttacaacaggtgaacagatagactattgcatcaataccatcaactgctattcagcaatacaaaggaacagactattcacttacacaacagtacagatgaacttacatgtgttttgctgtgtgaaagaagtcagccccaaatgtctacatattgtatgatttcattcgtataacattccggagaaggcaaaattataggtcaagaaaacagatcagagtttgcccacaattgggagaaagggaagggttgatcacaaaggcatcacacacagaattttagggtgatgcggctgttctgtgcagtgctggagggtggacacgtgtctctatggtttctcaaaccctaccaaatgctacactacaaaacctctttcttattttttgcaaaataaaaataataataaaaaaatccaccaggaagtcagaggattccaagaggaaaaagaaactgatcaaagacactttggaaaatggtattttgattggatactctaaggttaagaccaaacaagctgcatagaaacactccactttggttggtaattttgtttatcacaggggcaaatgataattttgacaccaggctagaaaaaataagtaagtaagttgcagataatgtgagctagagtttttactgttatgaaatgactttttcttgtagtgttgagaatgtttctttttttttcccaatcatgtgttaattctccccaggattctcaccaacctattcaagtatattttaaaatacttatgattttaagacaaaaacacatgtgttttcagcccagttggagaagcctcattactatcacatcctttgtgttctaaatgaaagtctgcacgtaaaacaacaaaggagcatgggaagtgttggaaaaatataataaggaagacagactccctggggaatgacacagtggtatgttccttgggtctcctgttcttctcatctgccctggagagagtgctgcagaagcctccaaccagaaaccacacccaacaaaaccaaacctaataaaaccccagctgtctcagccaaagaacctggaaaataatggcctagcaaggaatacccacctgagtgtagccaaacatcaatggaaaccccctctgcgaacaccatagttcagtgaaatcaagtgtggagctgatgatccacttcacttacacagagtggaaggaatcagcagtgctctgattcccttgccggatggtgtcagtggggccaagaagggagataaatcttctgtctcccacattgcaaaagaaggtggcattctggtatttccattttttttttttttttttttgagacggagtctcgctctgtcgcccagcctggagtgcagtggcgcgatctcagctcactgcaagttccacctcccgggttcacgccattctcctgcctcagtgtcccgagtatctgggaccacaggcgcccgccaccacacccggctaatgtttttgtatttttagtagagacggggtttcaccgtgttagccaggatggtctcgatctcctgacctcgtgatccacctgcctcagcctcccaaagtgctgggattacaggcctgagccactgcgcccggcctacagttatcttaaatataaattgtgtacatgtgtcaattaaaacacaaggaatatcaacctgaacacggaaacacgatacaaaaatacgtacgttacttatctcaattgatgcagaaagagcatttgccaaaatatagcacagttttatgataaaaactttcagaaacctagaaatacaaggaaacttcctgaactttatcaagagtatttatcaaaaacaaacagctatgtcatgcttaatgatgaaagaatgaatggttttcccctcagggtggaaacaaggcagagacacctgctctcaacaatgctatttgacagagcaccgaaagttctagtcggcacaattgggcaagaaacaaggcatactgattgaaaaaaaagagaaagaaggaaagtggcctctattgcagattacacgattgtctttgtaaagtctcagagaaactaaaaaaagtcttgtagaaataatatttagcaagttcacaggataaatgatccatcctccaaaattcatcatatttctatgaactaaaaatgaatgtgtggaaactgaatatacctttacaattgctctaaagaaaatacttaggcataaatctgacaagacatgcagaatcaagatggcaaaaattacaaaatgtgcatgaattgagagaagaactaaaattcaaacataccttattaatggtttggaagactcacgatagcaaatatgtcaactctcttcaaattgatgggtagacttaatgacagtcatatcaaaacaccagctacatatttttatgcatatagataaacctattttaagtttatatgaaaaggcacatgatactggtggagagatggacacataggtcagcagaacagaatgaagaactcagaaattgacacaagtaaatatgcccaactcatttctcatttttgacaatggtacaaaagtaattgaaagagaaagaatagtctttttaacaaatgttactggagaaaataaacacaggctcaaaatctcagtgtaaaccttgcactttatacactaattaactagaaatggtttgcaaacttaaatataaaaggttgtactataaaccttttaggaaaagagttctaaagaagttattgggatctagggctagataaaagtcctttgttcttatttacatgtatcttttaatttttttttattttcagtaaaagatcaatgtgtacgtgtacttattctaaaaaagaaaaaatgttcaatgtgctcttccaggttaatagacaaatcaaatagactcacctttctttatgaacccatagtgtatcagtgatccagccattattgttttcctgagaggaaaattctctttatgctcatcacacttttggagcattgaaccagagggcctaacgtgaggtgaacacgctgccagtggaggtgagcaggaaggaaatttccaaacccaagaactgacagaaactgctggagagagaaagttacttgggcaagtctagagaccaattgcgttgtgcccttctctgtagaataataaaaacggagtattcaagaaaaaaaataggacaagtgatactaaccaaatgatgttacaacacacccatgtctgtatgtgtatacagacctatgcacatatacacacatagatatgtgtaatatgtgtgtatttataactgaggttaaactgttaggcaataagaatgcagtcctatttttctaccctctcttttctaacatctttcaaacagatgatgttttgtaagattttcaattattttcaataattaaaaaaatttcaaacagaacaaatatgcatgctgaattatttctcaatcccctgttttacatgtggctttaagtacgtgacctgttatatagatatttcagcatcttagatgttaaagtaaacacatagctgctcctcatttttggaagggtgtatttacaatatatgtgtctgatgcaagttgtatatttaaattacttaaaaatacatcttctttggtaagagtttttaaaaataaatttgtggcacattagaatgtttttaagaaaaattgctttttaatttgtattatctaaacttcagaattttactctgaagtatttcaaaacttacaagaatattcatatttgatctataaaataagtaacttagatggaataatttgaatttggaaatttctttataccactaaatttgaagtatcaatgccacatttatttttacaaattttccttgaaacattatattggctactggaaagagctaataccctttatgaaaatatgattttagtgatgcaacttatatatgaggtagattaggaagctttacttcctgtgcccattaactaagaagattttatgaaacaatttttaacaggggccacagtcagtaccgggagtgtggtcaggtggtgaggcacgcctccctcctcattgggcccaccagaagatttcagggttctaggagaaacatacccaggcatgcagagattgtcacaagggaggaagggccagggtggggaacccagcacagggggcctgccctcacaggggagtcggacaaggttttctgaggaagctgtgtccaagccgagatccttcccgctccatgtgctccagcacaaggcctgcaggaggagccctgtgagcaaggccaacctagaccagccgggtggattcccttggcattgagggggagcatggcctgaggagctgagcgcggtctccgaaggacggcatcagaggaactctcaccgtttctatcatgaacacttacagtttgacatcagcatgggagttgtgattgggtgatcttgggaagggtctgtcagcgggtcggggggtcgctctaagttggacgctgtctgatagaggaggcttttctattgttcggcatctcatatctcaaggaatcttatctagaagagggcagagggccgccaggagaaagccgctgctggtaatgaggaagatgctgctcattttcaccaagtgcagtgctagggattttagcgggtggcaaagtgaccttgatatcttttctctgtgcaggtctctgttagagtcactgtgagtgtctctgtggggatctctgtgttggttttgaagggtctccgtgtgcgtctctgtcagaggtttctgtgggggggtccctctggggggtcttcatgggggggggtctcagtgttggggtctctgggggtcactgtggggaatctctgaaatctcaatgaatgtggggtctttgtgggaatctttgcgtgttggggtctaccgggggtccctgtggggttcctctgctgcaggtcacaggatcctgggtcccatagatgttgggcccacactggagctgcccaggtcaccaccccagacaggacttggctccaacagtagcctggacacccaaagtgacaccagggcgtgttcgaaacaggtccccggtgtgggtcccgccaggcctgggtacagacctgacaccttgtcctcagcctctgcagcccctgcaggtgcagagctctccctgggcagaaggcccctgggcagagccctctgaggaactggctcctgcctgccctgcccttgctcctgccttccctggggatggccaggaaggacccagtaccaggacgaagggagtgcaggactgggccctgtggggactgtccctgccaaccatgtgaccagattctctgagccccaatgtgtcccttgccagcacctgggcctggaaccatagatgtgctttgtaacccaggccagcccttgccttctgggtccccctcccctggcagtggcactgaccacttttgcttgtaatggtcaccagactgcaaggaccctggttacagctgtgggcagcttgtggatcctgcacttgcaaacttatgctcgtcttccctgattcttctcccacctctcaccctgggccccaaggtctcctcctgtgattcctgaccacagagtcctgccagaggggcaggcagcagccctaggtgcctcctgaaacagacaccccacactagtgggctgggagactgccctggagagtgaggcaggggacaccagacatgaacccaggggtgttatcaagcctgagccaagtgctggaggggcccaggtccatcccagatccggaactcagcagtcaggaaagggtctggggagggtgtcatctcttccccaccaggagatcccagaaagagcagtcccccctctgacccagggccagcacaagacaccccctacattcccaggctactgtgaggcagggaggctgctgggatccatcactcctccagcctgaggggagcctaccaccccccagtccgtgacgcccctgtagacccatcccctacagcagcacagaagtcgccttagaacagggaatgcagtgagccagagcccgggtgggatctccgtaagtttgctgtccttacatatcctgaaggctctgggtcatgatccagtttggaaaccagacacagtgtggggacagggagaaaagggggtcctccaggtccctgtcagcttcctctaggcccagccattctggaagccgcactcaggaggagctgacactgagcccttgcctgcagcctagcatggaacagacagaagccaccacctctgcagggaaaacaggtatattgggaacttctccgtggaagtcaggaacacatggggactgttgtcacccacgcaggacaggtttgttgtgtaggcgtccagtgttatttggatagaaccccctgtctcctccaggagaggtgtgggaagcctggtctggttcaggaggcaagacacctctgtgtagacctcagttcctgcagctgtggatggggctgcccgaggtgcttgccactcatggcctgtggtggtggggaccagctggggacacaagctccctgggaggtgggggcccaactgctgtctctgtctctgatgcccttgtttttgacaggacatttgtggcccttgggggtggctttggggctgcagaccagccccatctctctgctatgttcctggtagtagtgactcctgtggcagcaggaaggcacattctcctgggcgtggaggtcgcctttgtggcgactgacctctgagggaccacgtccctgctgaatccccagtttgtccaccaggatttgccccataactctgatgatggtctgggcttcatcagccatgctgtccataaacaaccttgctgggccagacccccagctctggacagcatctgcccaggcttgcctttctgcaggacgtcttcctgccctgagcccctcttcctgggatgtagaccctgtggacggtgactgatctttctctggaagttgctttctggtggtgcctgtcccttctctggctgaggctgattgtatttcctttcttgtttgtctcctatttccctcgtgtgggcagggtggctcctcccactggcttgggaggtcctgggtcctttggacctgtgtccctgctcccctggtctgggcctcctgtgggccttgcccttgtccaaagagcccagcatcttctgactcttctgtggggccttcacttttgggctcccaggttcctgctgccccagtctgtcccctcccttccataggagggcacatggcccctgggaagctgtcgtgttcctcctactgagcacactctgggaggtggacagaggggcctaagtgggtggcctgtatgtggctgggagcatgtccacatggcggcctggaaggcacaggcctgtggcgccctcctggaggaggatgctggaaacacggcctggcagctgctcctctgagtccacctgcactatgagcgcaatctcactgacaacctgtgctttcaggcacagctgccctggatcctgagcaacacagattgtagacactgaggggttactagtggtccccagagtccctgtgctcctcagatccacctgaacacttcctgatcttgccctcacactggctcccaaggtgactttccaatcagggggcttttcctccttggcctccagtgcctccagggcatctctggcccttgcccactgggaccccatgctgagctcttgcagggctctgctatgacaggggtctcctggggacatgctctcagtctcaagccatgcctcattcccagccatttctgaacccacactcccctcgagtctgggtttcccggaccccaggacagtccctctctgccaggttctgcctacaaggttgcatatgggggactgagaagatgccctgccctcctgtccagtcagagaggcctctgattgctcatgggtgtcagctgactgggaccctcttgggaccctctggacttcctcctgctcagttggtggggcagggacagggccactcatggtgggggctgacttgcttgttgttctattgtctcctggaccattctggggaggttttcccgacaaaatggcaaccttggctacagattcagccagagattcccaggaggcccaggggagaatggtggagtgtgggaggggtggaggctgagcctcccctgactagacatttatgggctctaaggactgaagttctggaccccacctgtgcctcacacagaacttgaaaagatgtgcttccagcatctgctgggtgcagggatggaggaaggacagctcctgggaggtgttcacgtgggctttcccacccctccaggatgtcacctttctcgatttcctgtgggtgtcagacttgggaatggcatgtttggccatgaattaggagcgatgcacagacacagggatccagccctccttgatctcccccaccttcctgtccagatggacctgtggcttgttttccagatgctgcttttctgggtccctgggtgcagaacttactgattggtacttccagggcctcctgaaatcaccttctgcttcctccttgtctttctccagaaccttcactgaagtccttcctgagccttgatcctggttctggctctagtttggaccctaagcaccccttcccagagaaccttccagagctcctgagccctgctttctgcacatccttcgtgccctttcctacaaattcagaatcccgggagggcaagagggccccctgcgtggcttctgcctgactctggggcctccctgggaattcccccttaggctgcagcaggtctccaggtgccttgaatctgctgggaggccacgggactgctcctggtggatggcactccttccttgccaccggtgctctgggagctcagggctggtggcaatcccgggaaggatgggggctgacttagggttcagggaggctggcctctcctggggaaggtgggaagtgggctggctcaggacagcctgagactttttgaggagagagggcaaaaccctcttccactttggtcatttctgcaagggccactcaagatacttttttccagtggggatgacagactgtgccctcttctgggatgtagggcaagatgctccacagaccctaatctggggtggagaagaggttgggacaggggttgagatttgccccactgtgtctggatcccagctagaggcgggggctgggactggggccaggttggagtgaaaggttggggctgggccacgtggtggggctggggccgtgcctgggaaagctgtgagggtgtctcaacctcagtttcacctggaagggaagtggaggctttatccgatggtacagagtgctcattctgtgaggaaatgttcctagaaacccaggccatggtcaccagggactcgctattgaaagaggggagatcccagaagagatggctgcatttctgctctaagtggtcccacatggccatggcgtcagagacctgctgaggatggggcagcttctgtggtaggtttgccacgttccagaagggatttagagtcgtgatgtcccactccttccccagtgatgtcatctgcgggtagtctgcccacccccattctttctcctgccacatcttcatcactgctctcttggagatgagtctccagcagcttctgcacgttgggatggaagaatgtgcggccacctgcctccatctgcctgggtgtggggtctccccagaaggaagcctctggggggtggttgggaagatgctgttgctgggatttgccctgtgagcaggtggagaggccccaggtggtggcagcctccctccagcgggagaggtcccggatgggaccgctggagcacccaaggccagagatcaccctggttggagaaggtggcccctggttgtgtagaggggagctctgggggacagggcgtattgtggagccacactgaagtccagccaggctgtgttcgggtggaggtggagaggaggccacgggaacatggggctgtggtgaagaaggaaaagcatatgtggccggactgcagggcattttaggggaagcaagggctctggaggcctggaggcactcagggttgagcgtggtccaaaaggctctgagaaggtcattgtgtctggtgacaggttggaggccagaggaactgggggagtccttggggacaagctgtcaggagatggatcttgcatgcatttcctatgcggctggtgggccttagcaggagctggtttgtacatatcacccagggctctccacctaagggcagatgggagccaccctccccagtgagctttctcaggtggctgcacaaggcacaagctgcagccaggggcaggtggggttgggaggtcgggagggctgggcacctggtgcccacagctcctccacctccgccactgctggcttcacagagctctgtctgtgcctgcccagggcttcagtccactcccgcctcttcccaggacctccccctcccaggtcaacactggaccctggggctgcctcagaggccctggtagaaaggacgacatggagagaaggggaatctcatctttccagaaggttggtcaggtcctgagtctcctccagctccctcaggaggattctgcaagctggaagtaaggagacagagttatggcggggagggcggtgccagcgaacctcatgggaggctgagtggtggatgtctctttaggggacaccatggggaactagaccctgaagcccatgcatctgtgtccaaggccacatggccccaatggtgacagcaaggtgtgcattgtgcagaactttgtcatttgcaaaaagtgcttccatgtacaacccctcatgggtgtcacaaccatcttgtggggagagtggatggggtggtctctaagaagagtcagccatggccgaggagaacagctgtccacgtggacctggggtctccctgacctccccccatatcctggcaggccttggtcccttccccacagcgcccccttatgggcaataccggttcccgggcccatggcttcattcccacagggaatatgaggaggccccgggttctgatttccctcccaggagcttccctctcaggcctctgcaaatgattccctcagggacagacgatgctcagtcacctctggggagtctcagggattagtagggcctcacaattcagagctgggatcttcttcctgctcctgggcctcccctatctcttcctttgatgccgagaggcaagcaagggtgaggggctgggaccagttctcagtctcctcttcccagaccagctgcacacacgcagtgctcttgaaggacacggctttctgcctgtagctcagggagctctgcgtgcgtttcttttactcatgtttaccattgatgaaatgttttctgttttccttcttagggaaatgcaagcaggggttttctgtgtgactccaccctggatatccccagtccctgctcctccgctgaaggcatacccaggctcaggcctacaggcacctctgagctgccagtaggattctgcttcagaggaggccagacgtgaatccaggctctagcgggaggctctcaggggttcagcacagctcccagatcaccccacacagaggagcctggacccccaggcacctgccttggaaaggggctgatgagccagagctggggcctgtcctcccacagagacctcacccctctcctgatctggtcctcgccactgagtccagtgttgggttttgccctgatgcctcccgcgcatgtcacagatagtctgggagctgaggatggaatcctctgcccactcccacccctgcctgctctgcccttccctagagggatgatgagatttcccatcgcaggagagtctctcattacttaggaaaagtggaaatgaggggaggaaaagaagagagaatctttctctgtggggctgggctgagggctccttaccttcctgctgctcctcttcctcccatgcgggggtgagggtgggacactggggaggtagggggctaataggaagaggaagcccaggctccacactgaggtgaggatgaaatccacaatccagggagtggagctggggcccagccacgtggcactagggctcttcagaggaaagagcattttttccatctgaagtgcaatgttgccctcaagcaactgagccctgggcatcgcttttgggactagggactggagcccaggcctgcatcacagagctggggcctcctcctcaccaagggctcctgggggcaggggaggggcagtgggaggaggaggctgaagcgcagcccctccttcaggtcccagttccagtccctccaccctcctgggtcccccagatctttccttcccactccagttgctcaccctgtcagagacagccctgggtccattttctattctgttccctggaacacagatgttacctggttttgtggagatctctgtgccagtccctcaatctcctgcatctttaaatctagacttctccctggagtttctgttatttctccagtttcttgctcttaggaactcatttgtttgcagttctaactttcccccttaatatgttcttgccctgcatcaactcagacatagaatttacattttttgtacttattgatcgttgtgaattttgattacaattttcatagttttttaaaagtttaatatttatttttgtgggcacacagtaggtgtatatgttaatggggcacatgagatactttcatacaggcatgcagtgtgtaataatcacagcatggtaaatggggtgtccatcacctcaagcctttttcctttgtgttacaaaccatccaattatactccttattttttaaatgaacaattaaattattattgactataggcattctattgctgtcaaatactacaaatacccagttttattcattctttctaattaccttctttatccattaaccatccccgtctctctccccctgtgccttcccagcctctagtaaccatccttctactctgtatctccatgagtttgactgtttaatttttagctctcacaagagagaacatgtgatgtttgttagtctttctttgcctgatttcacttaatgacctccagttctatccatgctattgcaaatgataggctctcattgtttttttatggctgaagagcactccactgcttatatgtaccaccttttctttatcctttcatctgttgatggacactcactaggttgattcctaatcttggctattgtgaacagtgctagaaggaacatgggagtgcaagtatcccttcaatatactgatttcctttcttctgggtgtgtacccagcagtgggattgctggatcatgaggtagctctagttttagtttttgaggaacctcctaactgttctccatagaagttgtactgactcacatttccaccaacagtgtatgagggttcccttcacatcctcgccagcatttgccattgtctgtcttttggatgaaagccattttaactggggcgagatgagatctccttgtagttttgattacctttctctgatatcattgatgttgagcaccttttcatatacctgtttgccattcatatgtcttcttttgagaaatgtctgttcacatcttttgtgtattttttattattttattttaacttccggggtacatgtgcaggatgtgcaggtttgttacataggtaaatgtgtgccatggtggtttgctgtacctatcaacccatcacataggtattaagccccgtatgcattagttatttttcctgatgctctctcctgcttctgacaggccccacagtgtgttgttcccctacctgtgtgcatgtgttccctttggtcagctcccacttataagtgagaacgtgtggtgtttggttttctgttcctgtgttagtttgctgaggataatggcttccagcttcattcatgtccctgcaaaggacataatctcattcttttttatggctgcataatattccatgttgtctatgcaccacattttctttatccagtctatcaccgatgggcatttgggttgattccatgtctttgcttctgtgaatagtgctgcaatgaatatataagtgcattcatctttataacagaataatttatattctttgggtacatacccagtaatgggattgctgggtcaaatagtatttcccattctaaatctttgaggaatcgccacaatgtctgccacaatggttgaactaatttacattcctgccaacagtgtaaaattgtttctatttctccccaacctcaccagcatcagttgtttcttgactttttaataattgccattttgactggcatgtgatggtatctcattgtggttttgatttccatttgtctaacaatcagtgatgttgagcttttttccttatgtttgttggctgcatctatgtcttcttttgagaagtgtttgttcatgtcctttgcccactttttaatggggtcttttgttttcttcttgtaaatttccttaaattccctgtagattctggatattggacctttgtcagatggatacattgcaaaaattttctcccattctgtaggttgtctgttcactctgatgatagtttctttgctgcgtgaaactctttagtttaattagttcccatttgtcaatttttgcttttattacaattgcttttggcgatttcaacataaaatatatgcccatgactatgacctgaatggtattgcctacatttttttctagggtttttatagttttggcttttacatttaagactttactttatcttgagttagtttttgtatagggtgtaaggaaaagatccagtttcagttttctgtgtatagctagccagttttcacaccatttattaaataggaaatcctttccccattgcttgtttttgtcaggtttgttgtcttgcctagaggttacacactgaattaccatttggagatcatccattcccacctggtgtggatcaaagataacaggggccaacaggagaaagtttgagccttgccaggtcaacactggtgctgaacaaagtgacttgcgtctgttttgctacatgtattttgctttggctgggatggaaaatattaatttgattccccatgcagcctgttgagcagcatcttgcaaaattgggaagcttatgcctatggttccatcaaacagaaaagcataattttattttgtaatggaacttggctcccatagctatgttacactgagcaaggtcatcaaagctgctctgttcttctgaaagctgcagagaaagggaacccagaaacctggtatgctggcgaaaaaagggtaagaaattcttaccaaccaagtttctcatatttctctctctctccctgtctctctccctccctctccctctgtgtgtttgtgtgtgtgcgtgtgaatgcaaatggtaaatatcactgtttgtcttctctcctctgttttctcttttctacaaatagaaaaaaggatttgtgagactagtcttaggctgtagcaaatctggagcactttgtgctaagaatttatctttctgctttgttctttaatggagagagaggtatcacaggagagaaggtgggcttaggacccctataagcctgcctttcaagccagcctggcagctggtcatttacaaactttgctgggggtccccaagaccagtgccatataaagtttccatcttttcgttttatgcccttgagagcttaaccttgtgaccatgtggggatactttctcttggtgtctgccattcagcggacaggaatttggggattcatgtcatagcactaaaaattatcttgagcaggtagaagcttttgcaaggtcaaaattggcacctctaggctccttctgggaagagcaacagaacctgctgaatgatgtagctcaataaccaaggcttttgtcttttgacagtggctgccccaggttcaattcttggctttgggaatgattcccttcttgtttgttatttgtgtaactgccattttttgagggattcccccctttctatggataatttctgatttcctgtcttgaattttcctttctgtgaactaccctggggaaattctaactcttgtttaaaaaaaactacttaccatctctttgaaacacatcatgagttcatggttaagttataaccttagttaaaacttattaatttcatgtgagaggttacctggtatagaattcaaaagccagaaatgtggggtgtcctcactagagcctggtaataagggattttgaaagtttttttttttttttaaacagcagagctctatggttaaaagtggcttaattaaaaatagacatccagggttgggtggggtaaccctagatatctattttcatgcctgtaatcccagtacttcagaaggccaaagcaggaggattgcttcagcaggagtttgagacaagcctggaaaacatagaccacatcttaaaattaaataaataaataaataaaagtacccaaactatatctatttaaaaggcctttatcttttcctcttctagattcatgtctttctggaataagttcttttcttctgaattgattttctccattttttcttcttgccatgcttaaagcacacctgagagaacctagataaattctaacagcctgggactcatagggaaaaacagaggaggcatcacagaccccattctgggaaaaacctccattttcctcatgaaaccccaggagctgaaagttgatagatctccctcaaaatctaagtctcggttcaattttcaattttacattatgttacctgactttttttgttttttttttttacttttgggtatatcagaaattgcttcacattatgggagagcttttagccatggtttataataaccagataggaaatacactataagggactgctaatggcaattaggaggaatacttggctccttgcatgcttggatcagagaagcacactcttgaccacctagaaggtatgaaaacatccctatcccccactgagagatgagaatcccatgggggatgggctgattacaaaatgggctgattggctttggattgtcttgcaataaaatgcagggtagaagcactgcactagcttcttctgtagtatttccctctttttggggggaatccaggatcccatataaaatggcacccttaatttgggggatctgtttttgccttccagctgtgcctgcttattaggccctagaaattgcaagctttcccagccctatttttcaaagggctccagcctgaatctagtaatcccactaggaaacttaagaactggcaaatgaaaaatcttacaactactggatcttctgtctgtctatgtatttatatatgttttgtgtgtgatgtttacataaaagctctaattaattggtttaaagaaaagtaggcacttaagtcaaatattttgtcagtaaaattaaaactaatgccctttagttcacctaactttagtaatcttttggtaataaagacagattaaaaattattgataaaataggctgggcacagtggctcacacctgtaatcccagcactttgggaggctgagctgggcagatcatgaggtcaggagatcaaggccatcctggctaacacggtgaaaccccatatctactaaaaatacaaaaaaattagccaggcgtggtggtgagcacctgcattcccagctactcgggaggctgaggcaggagaatgacgtgaaccctggaggcggagcttgcagtgagctgagactgcgccactgcacttcagcccgggtgacagagtgagattttgtctaaaaaaaaaaattggtaaaataaaatgtcttcaaaatttagacatttggtctaaattgggtctgatgttaggtttgctaaatgctttaagatcataaactgcttctttaacttttaaaaattgttcaatttacctagcttggagtcattactttctagataaggcccggtgacatgtgaaattagccccctagctgctcaaagaaggttaaaaagaaaagagattttgtataagaaaggatcttgtatggtaaatttttgtcctaaagtgaaatgactggttgttgaaatgaccgttgtccaagcatgtaatagatggtctaagccatgaaaggattcatgaaagggaatttatgcaagaaacgttgtacaatttaaaggttattaggctgcctaaatgcttcacaaacgccactgtgactcttaactatacacttacctgcgttactgctaggtaagtgctgggcatatgtggagatagccacattccatagctatgctggaaaaagtcagacttgatctgcacttctgtcctttgtctgtcctaagctccacacttggtacataattaaaatgtcctactaaccaggtttttcaccaaaaatagaagttgcacagagttaacagtgtaacatgtattgaggctactgaagaaacatttccacattcaaggcatgtaagaaaagtagaatgtacttttggtaaaagattataagaagacctgggaatatggatttctttcccaagtttagagggttattgttttaagtgagacaggaaaagtctaaaggttttttttttgtttgtttgcttttgttttttgagatggagtctcgctctgtcgcccaggctggagtgcagtggcgcaatctcggctcactgcaagctccgcctcccaggttcacgccattctcctgcctcagcctcccaagtagctgggactacaggcgcccgccactacgcctggctaattttttgtatttttagtagagacggggtttcaccattttagccgggatggtctcgatctcctgacctcgtgatccgcccgcctcggcctcccaaagtgctgggattacaggcgtgagccaccgcgcccggcctaaaggtttaagcaagttgtgaaaagtttataaaaaattaattgtaaaagagattctgtgtgtaaacatattggctaaagttaaaggggtattagtcaatgtttccataagttgaacattggaataaaagcataacagagttttcttaaaacatggttctgctctgtaacaacaacaactaaattgtaaagggttataaaaggtttataagaacattaacttatggtcaaactaattaaaactggatagatttataaaattttaataaaaactagctttagcattaaaggtgcaataatgcaaacatgaaatttggttttctcttttgaaaaagattcttgtgtaatattgagaagcaatgaaaaaattttgtttgccttttaagggaggggagagagaagtgaccaattcaggggacggcttcactgggtcttgtagtttgagaagctgagtctcttttctatcaaactaaaggttttttcctttttaaaactttgtgagttatcattttggctaaataactgacttatggtgacctggcattctattttgtgacatccagtgttttaaaccatatttgacaaacctgacaagatcaaattagaagttaaacaaaaataggtcccctacagtccaaaaagatataatctgcttatttaatgtattaaaatcatgcagaaaacatggccaaatataaaatgatgtttaactttctttgggttatattcatataaatacgttattagcatgtgtttcaaaactgtataagattcttataagtttgatatgccttagcatatgttatcagtaataattataattgatacattaaattattgtgtgccacagaggttaaaaattttcttgttttataatcagctatgaaacttggatgggtgctcttgaatgcaagtttctgatagctttggagattgcaacattagaataaaggaaaaaacgttcaggactctcatggagagctgacttgttcaggaacattaagcagaacaagagtttactgaatggaatgaactaatagaaaactgaactaatcttttccttttttttttttgcttaaaatgtggctgttccttttcatttttcagagagccaagaaaacttttcttttgattacagcttttaacaactgagaaaaatatactcctgtgaacaaaatttggagcatgtttgtttctctctacctgatttctcaagaatctggaagctatttgcaagtattcttaatttatggcaacataattatttgcataagtgcaataagaatgttttcttttgcaacaggacacaattggagaaactgtttattttactaaggttttgactgggatggcatgcttttgtttaaggaatcaaacttgatttacaaagccaataaaaacccctagggtaaactggcctcataccttgtctacgcagtccctgtacagggttcctaacgtatggtaagtaaagaatgtcactttccaaaaggccccggaatcttaagttatcttgggatctcaagaagaggggaatgtacccaactcataggcatttgagggtacaaacccatggctgggatgggctttaaaaaaagtctatctaagactctttatgcagagttccatcaaagccaacttaaaaggcccatgtgaaaaataattattcttgctgtgctctttgcaaataatcatgccaagtataataaaattaaagtttatttcacaaacaaaatcggtcctatcaggatttgtttttaataaaaataagaactgaagagagaaaaaattgtttcaaaaactacagtacacctgttgttagttgtttttgaggatttttttttctgccatttagactgaatcctaaattttgggaggctacaagtgctcaaactaatgcttttaagtctttacttttaaaactgggaatggcactccttgttccggaactcattacttaccttattgtacactgtttgtgtaaatgtcgtactaaaactgtagatgagaatacgaatgcctttgtcatgaaagccttggaagctcagcctggcctgcgtgagtacactcaaacagctcagacagctgcaaagcagttccactcctctcaccttggggtcaacacctaccccactatgccccctgtctgcaggaagaatccagagtgatcgacggccttttcccatcttcatagcccacaccttaagaataaggtgctatgaaaccctaagggagggattgaaacagcctttgcaaaaattataactgagaaaataatgacagtgaaagagatcagacctaaccgactccatcttgcttctaacctttaagctgtccttgttcattcctgggcataggccgaactaacctcgggaaggaatttgcagaccctgcactccatggatcagctgacaccgcctagactggtaatctggctcaatcagttctgagatcctacccaggaacagaagatagcaaggaaacctcacttcgaccccctatgattccatctccaacttgatcaatcagcactccccacttctctagcccctacccgtcaaattgtctctaaaaacttaagctgagcacggtggcttacgcctgtaattccagcactttgggaggccgaggcgggcggatcacgaggtgaggatttggagagcagcctggccaacataatgaaacaccgtctctactaaaaatacaaaaaaacagctaagcgtggtggcgggcacctgtaatcccagctacttggaaggctgaggcaggagaatcgcttgaaccctggaggcagaagttgcagtgagctgagatcacaccattgcactccagcccaggcaatagtgcgaggctccatcttaaaacaaaacaaaacaaatgctcaagaagtctgatttgaataataatgaaactctggtcttccgcaaaaataaagtaaaaatacaggtaagttaattctaataaggtctattgttacaaagtctttttgagtttctatacagcagaacaatattacaagacagaaccttcaaaaaccacttcattgcaactctgagtccctaaggaaaagagaaaaaaatgtggaaaaatcaaacgcttttttaatggcacagaggtcattgttttcttctataattgcaacagcaaaatctagatatctgggtatatatacatgtatatgtgttttttacattttagatagcatgccattctccattttatgaaaatttcatatagaatacatatatttgaaatatgaactgaaaaacattaagcattaataaagaaaataatgaacatctcctactggaataacttaccattattgtttttatatttatcaacagctctagaactttaacatggacatatataaaagtgaccacttccttagaattccattttgagttctcgttttgttgtgttttattttgttttgttttggttttgttttggtttgttttgagacggagtctcgctctgtcgcccaggctggagtgcagtggcacaatctcggctcactgcaaccttcgcctccccagttcaagcgattctcttgcctcagcctcctgagtagctgggattacaggcgtctgccaccgcgcccggctaatgtttgtattttttttaggtttcaccatgttggccaggctggtgatttcccgttttgaaaagtaaaggtttcagccgaacggagacctactttctgctgtgtcacatcgccctctggtggctaaatggctttcttacacagtaaccccaaataataactatcatataaaagaactttttaaaaaatcgtgataacattaaaatgattagaaatatataactcataagcaaagtcacagcactatgatatttacatgtttatcacacgtcaaatacatttaaatattttgtgatgtgtgaatcttcacattcctgaaccacctataaagttccatttcccaaggttaaattgaggcaggatttttaaagacttttaactagctaacagagaaaaatgtacaatttccattaacctccccagtgacaagctttctcaagacccagcgaggttgtatgtgtgtttgtgttttgtttttgtttttgtttttgttttgagacggagtctcgctctgtcgcccaggctggagtgcagtggcgccatctcggctcactgcaagctctgcctcctgggttcacgccattctcctgcctcagcctctcgagtagctgggactacaggcgcccgccaccacacccggctaacttttttgtattttttagtagaaacggggttttaccgtgttagccaggatggtctcgatctcctgacctcctgatccacccgcctcggcctcccaaagtgctgggattacaggcatcagccaccacgcccggccgtgtgtttgtgttttaatatggtttttctgtgtataaaagctatacgtgttcatcttagaaaatttagaaatgacagaatttgattttgcttattctaaatcccttgggattatttccagtatagatggcagtgaggaaggaataatttcaggacactggctttcttcttccacaagaccccagctgggcaaagggaactggatggccttgggcctgtggccccagtgcaccctcctctggggcctgtacctggctctggatagtaatccccactgcagaatggaagaggctgctcccacataagccattgagtccagactccagaaacctgggtccgtgcagtactcaaaaaggaaagtaccgaccacccagaccagagctggcaagaaggcgaaatgggattgattcattcattcaacaaatactcgctgagctccagccgaatgctaggcaccatgttcaggatagagatgattgatgtaatccctggccttggcagtttggggtaaagagctatcatcactgctgacttcataacaatcacatgccttcagagataaagtgaacactcacttctaacaaagcaaaaataagaagaaaaagaaatgcacactcccgatttctttgtccaaagtggtatgactgggtgatttgtgaccttcccatttgcatgcccgattgccaaaaagcatggcaattaccccacacacctttactcatcccaaactaactatgctgaaaacactgcacaatggagatttcctttatgcctgctcaggcctaacagttccatattcactggcctggctgtcttctccaagctgaaagaggcagagccattaccagtatttttcttggaagggcaggaagtaaaaacacatctgagtaacactcaagaaaatattgtttatgtccaagatgatgaattaatctttttttattctctctttctcttttttttttttttgagacagtctttctctggcacccaggttggagtgcagtggcatgatcacagctcactacatccttgacctcccaagttcaagccatcctccatcagtctccagagttgctgggactacaggtgcaccttgcctggataaattttttattctttgtagaaatgggggctcactatattgcccaggctgcatctttattctttcatcccatcctcaactaaagtcatgttactgtaatagaagtgaaataccatagccccgtgtgcctcagcaggcaggggctgtcagcactcttcatattgctgagcatttcaaagctgtgttggcagctgttccacagtcgacttcagggtccctgagatgattggctcttggagatgatccagcagggttctggtagctgagctcatccaccaagtccacactggcagtgaaaatggcttctgggcttggggctttctgggcccagccccagggcagactgagtcaacacacgaaggacagccttctgcacccacagcagacaggggaggggcaaagggagacacgcggtcccagtggggcagggaggctagaacacggccacaccctttgcgagccacaaacatttttgctgagcacaaaattctctccagctgggcagacagaggaaaaaagcaaaatgaatgagtagagcacgtggcacatcatcagggagttccatggaggaaagtggagcaggtgaagggcaggacgagggacatggagtgccagctaggggcttgagaaagtgatggcaagagctatgtaaggctgacattgggatatggttctgaagggagtgaggatggtgacgtggctgtgtgtggaaagggaatgtcaggcgggggtgacagcagggataaatgcctggagagcatggctgtgtgtggaaagggaatgtcaggccggggtgacagcagggataaatgcctggagagcagagtggcccgctatttcccaggaggaaggacctgtggctcaagtgtcaatgaaagtgagcggagagggctgaagtcggggtaacagggccagcctgtgtgcagccccctggatgtgggtgagggagttgtctctgccgtgtgagaggaacagccacaggagggctttcaggagagcgcatggtgtgaggtttttcagactcactgtggctactgtgggaagagtgttttaggtgcctcccctttaccccactgggtgagcagggtttctgccctaggcctagggggatggctgcacacacacgcacgacacttgacagaggagatgagcactggcttattagccacatagacagactcataccccgaggaggagaaccccaggccatgcagggggaatccgcgggaatgaacagccctgagctcaggagagggtctacatgcattgcaattaaaaaggaaatgcagccgggtgtggtagctcatgcctgtaatcccagcactttgggaggccgaggtggacgggtcacctgaggtcaggagtttgagaccagcctggccaacacggagaaacccggtctcaactaaaaacacaaaaaaattagccatgtgtgatggtgcatgcctgttatcccaggtattcgggaggctgaggcatgagaatcacttcaacctggggggcagagattgcagtgagctgagatcacaccactgcactccagcctgggtgacagagtgagactgtgtctcaaaaaaaaagaaaatgcatgccgtcaagtccgctcgtgccgagatgaggtgtctccagttgtccagcatcacatcgcggtacagggtcctctgaacagggcccaagcgctgccaatcctcctggcggacccccagccacgtccttgaatgacactgatacctgtaattgtgcatttctcagcactttgggggttcggaaacagggacatggaaaacacatttgggatgtgattcctactatgtttattgttgcaaatctaaacaagttactgtaaggtatgcctattttagttctagttttgccttacgcttttggggtaactcaagcagtaaacatattttgaacatcgtaactcatttgtacatgagcgtgcattagatacatatactatcatgtactaagctaacactagtattgttttaaaaaattcttatttaggtgaaaatcagtgtaattagagttttcacaatttcctttccacactttaaaagatcatcttgggcattccctgggctgtacacaccctccttgaagatcctgctgtggctactggggagtctgtaaagtgatccatgtaaggcctgaatgtgctgtatcagacttatgtcaaagaagcaatgcttcagaagagtggacggtggctgaaggggaagccagaaccagagacctgaaaaagagatgaccgccttcactaaagcaacagcaatggggaaaggaatcggggactagtcccatggcagaagccgcaacggaatttgtcatccatttcttgagtggcttccctgaatgagtagctgggtcaatgctggtgccatctatagtattaagggaaagatggcaaagtcagagtctataaatgaggattctacggcagttctggaccttgtggaactttatgtctaactggaaagatccagaaatggcagttttcactaatctgcgaagtgcagaggcaggggcagcacgggctctgaggactgagatgaggaaggacaagtggaaagagaagaggatcggttttgtggatgaggccatcagacttgactcatgacaaaccaggaggaatggagaagctgatggggcagggttcaaggtccatgcagccccagtgagagcatgaggtgaagctgtgtcagaacagcaggatgtgtccgggatttagtcgcacctgagaataaagttacatggtgaacttttctcatcactttccccagtggacagtaaaccccactgtgggaaacggcattttcagctgtaactgtgcagatgccacacccctgggcagtcctcactctgcaggctccgattctcacagcgcccagtgatgccagcaaaacactttatcaggagtgtccaatcttttggctttcctgggccacactggaagaagaactgtcttggactgcacataaaatacattaacactaacaaaagctgatgagctaaagaaaaaaaatgacaaaaaatacctcataatgttttaagaaagcttacaaatgtttgttgggcctcattcaaagctgtcctgggctgcatgcagcccgggggctgttggttggacatgaaggggattcttagagagatttcactgcactgaatgctcacagtttatttacataacagttcaaactccagttatcactgtgccttcaaagtgcacacgtcgctcctagcacctctgcccaccagcctctacatgaacaccaggagcaagtggcgatcagtgaccaaccacaccactcccttcagaatctgcagggcccttccctccgcatgcacagctcggttcctgtacagacaacaccacgtgtagtcatcttgcttcttagattcctagtaataaaaccactcggaatgttacaaagataaaaactggaagagtggattggccaacaaagaggaaagtgcaggaaagaaaggaagagtgacagcctcggaagtaccattcagacctccaggaaagggcactgtggtgctgcctctgtgggtgctgacattgcactggtcaggaggtgcaccaagccaggctaggggccaccaagcctggcttttaatacatttttataaagaaataagcttgaactatcagtgtgtctaaagattttaaattacaatatatgaaataaatatcagttttcctgagtttcgttttcatgtgttcatatgaagacaatatgcaatggtaagagacatgttaacgtgtggataaaaaaattcaaaggttgcagaacactcatgattttctccactgattattaagatcactttatagttttggcttgcatggtcgttcttatagtcacagactactatgcgaagtgaggactatgtcgatataaggaaatctttgttggatagaagaacactaggagtttcaaaaggagacatgggaagaagtcatgtccccaaagtcctctatttggtactgagaagctactcacttcggtataaggagggggtgacagactttccagagggaggaggcattatctgagttcagacgaaagatgtgctgagcaggggaagagacaggtgacctggttcaggagagaaaacaaaactttgaaatatatttaagaatataaaaaactggccgggtgcggtggctcatgcctataatcccagcactttgggaggccaaggcgggtggatcacgaggtcagcagttccagaccagcctggctgagatgatgaaaccccgtctctactaaaaatacaaaaaattagccggactcagtgcaggtgcctgtaatcccagctactcgggaggctgaggcgggagaattgcttgaatttggatggcagaggttgcagtgagccaagatcatgccactgcactccagcctgggtgacagagtaagactccgtctcagaaaaaaaaaaaaaaaaggatataaaaaactgatagttttgacctaaaaacagcaaaactagaaagacccaatgcccaactggatgtggcaggagctgagagggcgggagggtgggttagggtgacattgtccccagggagcagggggatgggtgtgatgtgggagccaccccaagccgtccggtgcctggccctggggtgaccaggtgagggaatcaatattcctgcaggataagagccacataaagaaggtagtggaggggggagcctataggagcagttaatttgcttgtgaaaggcgtgtttatcacctctaagaattagctggccctgggaggagcagtctttccccagccagagaggccccagatgccagagcaccaagaacacagaaataaataaaaacatgggtaacgtatttgtctgtagtcaagtcactggtgggtggaagccataggcaaatggtttccatttgtgataatggaatttccacgagagaaaatgcaccaccaaacagggatttggaacatgaatgataagcgtggaaacattttgcagagagcaggatcgtaagctgtcaagagacttgcagatcacaagtattactatcttaatggacatccattctccctccaggtattccagactttatccccgccagaggcaagaacatcataaagacatcgacctccacttctggaagccagtactgagctctggcttgccacactgccttcctcttccattgaagagccagcagggacagcagcctgtgtgagctcagggttgtcactgcaaggtggttgctacatgacttacacaaagacatttttcagatttcacttttctttttctctcacgaggaatcagttaggtttatgcttcttatcaatgcacatatttaaacacatagtatccctcatggccttggctatctggcctggcctggctatctgagctatgctcagaaatagctttgtaccaagagtaactgtgtatgtctacatgccaactttgccttgcaattgatcagttctatgttttctctggttaattggaccattggactacatttagacacacagaccttgaacccccctacagaagccattgtaaagcaaggtggttggttcctaaacagatcacctgaaaccttctcattttctgttgttctggaaggagtgaggaggacaggaaggtgtcacagagcggggaggaaggagaagtggagttgagtgagacctgaatggtcttaccgctcctacatcgcatccacatgcctgaaaccctggaccctgggccaggtgaagtcttccctggggtgtactcttccttggcccttgagccgaagcaggagggccccgtagaggcagcacagcctgtccacccacaacgctcatgagtatgtggactcacatttgtagttttgcagagagttaatgtcaactttgttgtccattgacttattaacaacttatttctcctttgcacggaaaaaattcagagaattgataatatagattacagtagccaaagaatgaaacaacatggtatagaaaaaatagccttattgtttggctgcattcccactagcgctgttgagacttgggagcaccaggcaagtctctgaaaaggggatgaggaagccgaaagcaagctgcattttgcttggctctaacttcctctgggttttcccagtgaatcttttgttatgaagtttctggtcatttactgcgacagagagaacagcagagccctgaattttcctcctggccctgttgtccacacatgggctatcttagatatattattcattctcaagatgtctttcacctttcaagctcagcacctttctccagaagcctgctcctctgtgctgtgtttctggcctcagtgagtgaggacagtcacccagccatcacgcgaggaactcagcggccatctgtgccttcatcttccttgcagtcagaggatcactaagtctcactgttcttctttaaagccctccccatttctgccctgaattactgcagccgcctccctgctctgccatccatctgggcattactgccagggtaatctttccgtatgtgagtgctgctgatattggttctccaaaaggactgctgtggctcctgtctccttcggggtgagattcgagccatggagcagcagcttcagcatccagtccatttgttgggtctcaggtcctccagttttccttggattctccttcctcaccaatccaccgcacacttcactccaaccacacaaaacacagttttcagaacaagccacactgcttcatgcctcccatcggggtctctcaatctccgtattatttatgctcggggctggagagctgtgttgtaggggcctggcctgtgtgctgtaggatgttagcagcaaacctggcctctacccaccacgtgccaatagcatacccaccccccagttttgataacaaaacacctttggacattaccaaatgtgccctgaaaaatcatccccagttgaaagcagttgctctttgcttttacaaatgctggtccttttacctggaataaccttcccttcatactgaactcctacccagtcatctcttcgaaacttcaacccagtcatcttcaaagcttcaaaagtcaacccagtcatctcttcttctctggtgacctccttgctcaggcacagccagagctaatccttattttcctggtgaagccagcattctttgtaatacctctaaaatcaagctcatctcactatactggagtcttttgcttgcaagtgtctttctttgcactggcctatgagtgtccaggagaaatggcagagatcatggcttctttgtgccctccttgtctggggtagatcctagcaaggcacacacctggggaaagtttgttcaaagaaggaactgaattcatcttattctctcatgttaatggcaattaaaacatgttcctttatggtgatgttgacaccaatattttgtgtttactaagataaactctaaaccaaaactggagcctaattttgcttctgaggttctgatttagaatgctaaaaggaaacaggtgtgaaagctaagcacttattctacaggtgggaatgtcaatgatggggaacaaaatcaaaattccttatggagcccaaccaagccgtcgtttcttctcatcataaaactgatcttagcggcatttatttagggtctaatatatgtcatgctatactaagatttaatgagatcactatctgatttcccaaatctttctgaaacaaatagattagcaaattctaccataaacttacacaaattggcatcaacttttgaaaagctggcatttgcacataaattactatttcatgatgactctatgtacaacagatgtctgatgtattctcccagctctagaatagtcaatagaggaataagaatatcaaaattattaagcaaatccagaaagtgaaatttttacccaggcaactggtcttatcccttcaaaaatcgatgtaaatcactagacaaggaaaacacgttaccaaacactaaagaattaatcctggaaaagggaaacatacaggtaaatataaaatacttttatcttgcttttcataattttttatgaaataatttacagtttaagcaaaaataacaaagcatgatggtgtttaggacgtatgtagaaacaaactgtatgaaagtatggctgtggcatgtcattgaaacatatacatatatgttttcatccacagttccttgttcataactctcatagcccttgtgacagtaaacagaatctctctctcacaccttctcctgcccttctttcccctgcccatggctggattctgtgggtcatgagaccctcattccaaagagggttttgtctcataacctggaggaaggaaggctacacagagaggccaagaagaatctgaacacacaggccttgctgggtttagaacccattttgtccaatcacatttccacagtcacccatgcttcaatcaggcctatccaacaaattccccatataaagacccaagaggacagggtttggaagcttctggagagctgaacacatgaagggtgactaaaaggtgaagaactcattcacgtgctgagagggtggtgctccctgaatccacatggacacaagctcctgcacctgggacccttcaaaatcttccagacctcatcctgtgtgtatctcttcatatggctgtccatccgtatcctttaaaatgtccttcataataaactggtaaacaacataagcatttccctgagttctgtgagccactccagcaaattaatcaaacccatagaggggattgtgggaagcccagcttgaagccagttgattagaaattccagaagcctggacttatgactggtgtctgggggtggggaagtggcagccttgcagaacgggccctctctttgtgggatctgatgccagctctgggtagatagagttggaattgaactggaggacgtccagctggtgcccactgcagaggtgactgcctgcttgctggtgaggagaaagcccccacatactcagggtctcagaagtctgctgtgtagattgctgttgtgttggtgtggacgcagaggagaaacagttcgggtttttcctaagaatgacagtagcacaaaagatgggaggaggagatagaaatatattgttgcaaggtttttacaatatacgtgaatgggtatcatattatatgaaattaaatggtgataagtttaaattgcaaaatataaatccagagaattcttctggcccttatccaagaccatcaaggcagtacttctctgagtctgcaagaatcacagtgttactgggtttggggtgccccctaatacagatatggcttagactgcaacacccaagtcccttggaatacctggaaagctttcccagaaaggatgggtacaaacaagcccaactgcaaagatgacactgcctaactcttcaatgcccagacactaccaaacatccacaagcatcaagactctccaggaaaatatggcctcgtcaaataaataagtcaccaggagccaattccagaaagacagaggtatgtgatctttcagagaattcaaaatagctgttttgaggaaactcaatgaaattcaatataacacagggaagcaatttaggatcctagcaaacacatttaacaaagagattgaaataatttttaaaaatcaagcagaaattctggagttaaaaaatgcaactgacatactaaagaatgcatctgaatctcttaatagcagaattgatcatgaagaagaaggaattagtgagcttggggccaggcctggtgactcacgcatgtaataccagcattttgggaggctgaggctagcagatcacctgaggtcaggagttcaagacttccctggccaacatggtgaaacctcatctctactacaaatacaaaaattagccaggtatggtgatgggcacctgtaatcccaggtactagggaggctgaaacacgagaatcacttgaacccagatggcggacgttgcagtgagctgagattgggccactgttctctagcctgggtgacagagcaagactttgtctttagaaaaaaaaaaaaaagatttagtgaccttgaagacaggctaattgaaaatacctcctagtcaaaggagacaaaaggaaaaaaatgaaatagaatgaagcaggcctagaagatctagaaaatacccttcaagtggcaaatccaagagttattggccttacaaggaggtagagagagataggggtccaaagtttatacaaagggaaatttcttacaactgcatgtgaaatgaatctataattatacacacaattttagttgtaaaaaactagataaaatagtctttttgaacagacatttcacaaaagaagataaaaaaaggccaataagcacatgaaagattctcagcataattagttctctggaaatgcaaattaaaatcataatgagatactactacatacccattaacatagccaaaattacccaaataaccacccagaaaaataccaaatattggcaagcatacatttctgtatgagagaagcaaggatgtcatatatttaatggaaactatcacacattcctggtggaaatataatgcaatgagttttattatcattctatttatacatttttaaaaaagggagcaacggcaggtcatttacttataaaagtctcaaaatcattctaccggtgacttcctttcataaataaccactctctataaaacacttgccaagaaacacatggatcctacaagggtcgggtgttactcttatcaatcattattgataaacaattatgatgaggggacccaaagaaggcgatgtacccgctgtggcaccggtggccacaaggtggcgtgaatgtcgagcggctgccccagccacctagaaagagattggagcagccaggcttccagaagcagaggaggcctcacagagggcaccgagactagacaggaacctctcaccttgtgaatttccctaaagaggggtcttcctagataagctttgaaggaagacccagtacctacacagtaaggcacaagttactgtgaagaaatctacgtcaaactagatgaggcctatgttaccttaactacggcctcatttaccctacctaggacctgatggggcttaaattatcctacacccacattattctagatcagggtttcttagccctctcattattgacagtttgggctggagaattctttgactcctcggtttggggagcctctgcccacctgcccaactgtggcaaacaaattcatctccagtccttgcccatgacccttactgggcaaaattgctcacagttgagagccactgccccaaataaggcttaaattactagtaaggctgatattacaccaaaaccagtctccattttcttagatcaatggttcttaaactagagcctgcaaagaatccccgaaggagcttgtgaagctgcctacacctgagccttcccccggagttcctggtttctgtgtctaacctatttctagatgatgtagatgctgtcgatgcaaggacctcactttgagaagcactgtcccagatggtgactacattacccatacgcacatttctctaaagcctccatttccctaggaccaccttatcctaattgaggcttacaacagacttgaggtgttcatgttactatttttattattaaggtaaaaccaggaaattttcatagaaaagaattcaaaagcttctgaacaaggtattatatgcatagaaatacctcaacataacatagatgctgggaaacaaaggcattgtcagccttgggcatgaggaagggcagggtgcaggcagggcacaggcagggctgctggcttcagccctgggtcttctttgaagatggaaaaggaaaacaatagaagacatcagtttaaacaaatacttcagtaattttcatgttgaaattagaagagcttctgttgcactttgggaattgctactttattttgactctagatatgaataagcaaatagcatgctactgcaatcaactttgacaaagacaaaattgtactggtgactttttcaagggcagcttatggaagacgtccgattacaaacttggtgaatggcgaagaatattcatccctcacagattttttaaaattatcttggtttttagtaaaaatcacgttgtctttaacagccacagacaccaaagaagttccaccacatcattttttcatatgattacggctcatttataagaatttctactatttcaaagtgtatttatttgtaactcaaaagaagatcagtctatttttctgcctactcggctgtagaataccaccctctactaatggctcattgactcaaggttaccttaaaggaaaccagacccagggtcaagaaggaatcaagccctgtgcatactcagtgctattcatgtgttcacagaatgattatgggacagacattgcacgtgggcatttgtttcatatttgcatcacgtggaggtttacatagcaaatattaactattccaggccaggcctgatggctcacgcctgtaatcccagcgcattgggatgcagaggcgggtggatcacctgaggtcaggagttcgaaaccagcctggccagcatggtgaaaccccatctctactaaaaatacaaagtgagccgggtgtgacaccacacacttgtaatcccagctggctcacagagcatttttctccaagcatctcaagcccagtatgaagtggatgtgtcctggctcagaatgttccctcagtgacagcaattgcttctcacaccacctcttacaataggaataggccttagaaaacccagcaatctattgggatacttcagcgcagcaagcaaggaatcactaaagccaccaggaggcccctcccctggagctccatatgcactgatacctccagacacatggcaagtgcaggaactgatggggactttggggcagcctcttttttttaggattctgtggttgaagattatatcagattagaactttatgcacagaccctgtttctcaaagcccctgcccccacactcacagtggaatatttgcacagtaacaaacctcaaatttgccctccttcctagtgtcttgccaatgaaaagtgcttccgactctgaccctagtcctgcttatgtttgttgttttgttgtttgttttttccaagcagagctaaagcaagctcagtactattggagatttggaaagtgccttcacattctttgccaattctcacctgagagccctgcagacgccccacgagaggaaaatctaaggtcattgagggaggggccgtgatcttggtcctgaagctgttgctttcagaggctttaaatcacttcactgtacttgacttgttctctcccattgcctttggtttccctaagttctagtccttagacagagcatgtgccttgcaaaacttttctctttaatccatcttaatcctagtgagcaggtgatatggtgggcaggggagcagtatatgttcaatgatttcttgctgtgctttctttaggctgtaccctttacaaggagtctccagtcatacagctgattttcctctgtcctctactccacctcctggctgtagcatacacagattattgtcttgaatctgaccccagttgtttattaattataccccttttcatgacacgggaaggctaagatgaagctgtctgggatggaaaagaatcccttcctctcacatagaataaagatcttgaaaagtattttttctttgtagggtctgtctggagaaagttctgggcatatttatcagaaaatagttctcctgatgacagagccatgagggcatctgtttgaattctcgtcttgagaacccagaagcttttggagggaaattccataaaagtgtgaggtgtgtggcccccagttcttaccctaccctttccctgcttctcctccaggcatttatggaattaccatgtaactcttcgcaccagcttgtgctttcaatggaagaatcacccaatctatcaatttagaaaggagattttatttctgaaaaagggttggagctgcaggacggccatcttaacaggctggaaagcaaagcctcccacagagactgtgagcaggcacttcaagagagggaaagacaagaaatgaattcatgcgaatggattggccaagcgtacacactcagcaggctatagaaggacctattgatagtcacatgacaggcaggctctcatgtgtaataagcaaacacaaacgttacatgcatttcatatttgcttttgggtgaggacatgagaactagacgaattacaatctggctctgtacacgaaaacggctttgtgcaggggcagaaagacacacagtgcacagcctccggaaattggccaggacaagtccatggtcagtctcagctctttttcctcaacttcagttctacctggttccacttcagcactgtgcctggaaactcccttaaggaagcatctgagcgtgcattcatcagaggactccttttgtttatttcccacctctcagcaattactgtccttgttacctgttgtcacacatcataaaattgaatttaagaaatttcactatgttttacaagtatttctggtggaaagatacatctggtctctgttgtcaaacctagtttgaaagtgatcatcttgcacaaaaaatattagaattaattttatgatgttcaccaagatttatcttggaatgtatacaaatattcaaccttaaatttcaaggtatcacaaaattttgttacatatatatatatactctatatatagtgtttattttgtcttacatatatattaattataccaatagaattatatagtgttattttgttttatatatatataaacattatatatagtgtttggtatatatatagtgtttattatatataatatatatagtgtttattttgttatatatataaacactatatatagtgtttggtatatatagtgtttattttattatatataatatatatatagtgtttattttgttatatatatataaacactatatatagtgtttggtagaatatcatacctaattttaaaatattcaaaatatctatatctgtcacataagtaaagcacaagctctacattgccctaatagaagagcttcctatttgtctttctcccacaatgtcaggggatgaaagcaggtggtccccactgagagtacttcctggattagatccttggaatgtcagtttcctgcctgatcatctcattttcattcctcaaatcagaacatgaattccatcttgagttaacttctcctccagagtatgaaagcatcattcctgctgcttctcctctaggctgattcaacaggatgtgcttcatcttttgcactgtgaagatattctttggggtcaaaagccccttcctggctatctggttgtctggcgatgcgctcattattgtccctagaaccttcctgtatcctggtccctggagtatgctcttggcctgggggttcagttccttcctgaaacatgatgttttgctcagctccagcatgaggctgtagaactggctcagttcctaatcctggaagctgggaggagtttttcaggtggtagtggcacagagggcaggtctcctggacatacagccatttcttaagacagcctgcatggaaaaaatgaacgcaaggcgtgatcacagcagatttcatgtcccaaacagattcttatcgaaggagttacctgataacagatggcacaaatatcattgtgtttctcaagctgctctttcgtagcaatgggtaacgatttaatcttattcacagcatccctgtggagaagaaagctcttccaccccagctgggcctgaagccacacgttatagtaggaatgaatggatgatcattgagcccatcactgtccattctccaaagatggtctctgagacgcaataggccaccatacagacggccgcaagaaactccagcaggtggtaagtgccattcacatagtagatgacatcatccatgttttccaccggctcttttctgaattcctcaaccataaatcagacataaataaaaagtgttcccagaacctgaagagaggtaagaatgctgctggaaataatgataagaagccaaaaatccaggtggaaaaactggcaaatcatataagccatatgagcagggaataccaataaaaataaacaaagtcgcacagcacggaagtgtttccacaagctcttgtctctggatgctcccagtgccaaaacaataggatctgcaatttctaacatagactgtaggatagaagctgcaacaatgaaaaggataatactgagcaggaatgcccgatgaacaacctgcagttctatcagcccagtctgcactgccaggattaacagcgttactccttctgtcatgctccaattcatggcaggatcattcctgaaagctcgataaccctgcaagtaaaactcgcagagtgtgagaacacccaaggcaacaaaagaaaccgtgaagaccaaacccaaaagagagtaaggagtgctgcagcattctgcaatacttgtcagaaaaaggaaaagaagcctctcacgtgatgccggctgatctcgagtactgaaataggagtaaatctgaagagcaaataagatgagccagaaaaccatgaaaagaacagggactaccagttgattccacaaggacattcccaaggtgagaaggccatatacctccactacctgaaccaattctctgtatgcagatttagcaaggttataaggtagcaaaagattagacccaagaaaatagagaacttccaatccagtaaaaatcatagcaaatttattgatgataacaattgtctccaaaggaaccaggcagagtcgtgctagcagaggaagcacgtgagctgaaaacagccaaatctgctttgttttcatgacacaggagcataaagtacacaccaccaactgacctattaaggctgtggtaaaccgattcatagagagaggttctaaatacattggtccctcataggcaaaccgcagttcactccgaacgtagtccctggaaatttgatgtccagtatagaaaagcagagcagtcaaaaaatatagataaagctgaaccagatgttgcctgggcaatgttagcagcaccacacttaagatataacctcaggctgtggactccctccctggggagcggtgctgccggcggcgggcgggctccgcaactccccggctctctcgcccgccctcccgttctcctcgggcggcggcgggggccgggactgcgccgctcacagcggcggctcttctgcgcccggcctcggaggcagtggcggtggcggccatggcctcctgcgttcgccgatgtcagcatttcgaactgagggtcatctcattgggactggttagacagtgggtgcagcccacggagggcgagttgaagcagggtggggtgtcacctcccccaggaagtccagtgggtcagggaactccctcccctagccaagggaggccgtgagggactgtgcccggtgagagactgtgccctgaggaaaggtgcactctggcccagatactacacttttcccacggtcttcaaaacccgcagaccaggagattccctcgggttcctacaccaccaggaccctgggtttcaaccacaaaaccgggccatttgggcagacaccaagctagctgcaagagttgtttttttttttttatactcctgtggcacctggaacgccagcgagagagcacctttcactcccctggaaagggggctgaaggcagggagccaagtggtctagctcaatggatccccccctacagagcccagcaagctaaaatccactggcttgagattcttgctgcccggacagcagtctgaagttgacctgggatgctcgagcttggtgggcggatgggcgtttgccattactgaggcttgagaaggcagttttcccctcacagtgtaaacagagtcacctggaagttcaaactggccggagcccaccacagctcagcaaagctgctgtagctagactgcctttctagattcctcctcgctatgcagggcatctcggaaaaaaaggcaactgtcccagtcaggggcttatagataaaacccccatctccctgggacagagcacttgggggaaggggtggctgtggacacagcttcagcagacttaaacattcctgcctgctggctctgaagagatgagcagatctcccaacacagcggtccacgctgctaagggacagaccgcctcttccagtgggtccctggcccccatgcctcctgactgggagacacctcccaacaggggttgacagactcctcatacaggagtgctccagcaggcatctggcaggtgcccctctaggacgaatcagaagaagaagcaggcagcaatctttgctgttctgcagtctctgctggtgatacccaggcaaataggatctagagtggatctccagcaaactcagcagacctgcagctgagaggcctgacttttagaaggaaaactaacaaacagaaaggaatagtatcaacatcaacaaaaaggacgtccacacagaaaccccatctgaaggtcaccaacatcaaagaccaaaggtagataaatccacaaagatgaggataaaccagttcaaaagggcttaaaattcccaaaaccagaacacctcttctcctctaaaggatcacaactcctcatcagcaaggggaacaaaactggacggaaaatgagtttgacgaactgacagaaggaggcatcagaaggtgggtaataacaaactcctctgaggcaaaggagcgtgttctaacccaatgcagggaagctaagaaccttgaaaaaaggttagacgaattgctaactagaataaccagtttaaagaagaacataaattacctgatggagctgtaaaacacagcacaacaacttcgtgacgcatacacaaatatcaatagttgaattgaacaagtggaagaaaggatatcagagattcaagaccaatttaatgaaataaagtgtgaacacaagattagagaaaaaagaatgaaaggaatgaacaaagcctccaagaaatattggagtatgtgataagaccaaaccttcgtttgactggtgtacctgaaagtgatggggagaatggaaccaagttggaaaacactcttcaggatattatccaggagaactttcccaacctagcaagacaggccaacattcaaattcaggaaatacagagatactcctcgggaagagcaactgcaagacacataatcttcagattcaccaaggttgaaatgaatgaaaaaatgttaagggcagccagagagaaaggtcggtttacccgtaaagggaagcccatcagactatcagcagatctctctgcagaaaccctacaagccagaagagagtgggggccaatattcaatattcttaaagaaaagaattttcaacccagaatttcatatccagccaaactaaacttcataagcaaaggataaataaaaacctttacagacaagcaaatactgagattttttgcaccaccaggcctgccttacaagagcttctgagggaagcactaaatatggaaaggaaaaaccagtaccagccactgcaaaaacataccaaattgtaaagatcatcaacagtatgaagaaactacatcaactaatgggcacaacaatcagctaacatcataatgacaggatcaaatttatacataacaatgttaaccttaaatgtaaacaggctaaatgccccaattaaaacacagagactgacaaattagatcaagactcaagacccattggtgtgctgtagtcaggagacgcatctcatgtgcaaagactcaccaaggtctcaaaataaagggatgcaggaatatttaccaatcaaatggaaagaaaaaaaaatagtggttgcacccctagtgtgttataaaacagactttaaaccaacaaacatcaaaaaagacaaagaagaggattacctaatggtaaaggtatcaatgcaacgagaagagctaactatcctaaatatatattcacccaatacaggagcacccagattcataaagcaagttcttagagacctacaaagagacttagactcccgcacaataatagctggagactttaacacctcactgtcaatatttgacagatcaatgagacagaaaattaacaaggatattcagaacttgaactcagctctggaccaagtggatctaatggacatctacataaatctccaccccaaatcaacagaatatacattcttctcagcaccacatcacacttattctaaaactgaccatattattggaagtaaaacactcttcagcaaatacaaaagaatggaaatcagaacaaacagtctcccagaccacagtgcaatcaaattagaactcaggattaagaaactcttcaaaactgctcaagtacatgaaaactgaacaagctgctcctgaatgactactgggtaaataatgaaattaaggcagaaataaataagttctttgaaaccaatgagaacaaagatacaatgtaccagaatctctgggacccagctaaagcagtgtttagagggaaatttatagcactaaatgcccacaagaggaagcatgaaagatctaaaatcaacacactaacatcacaattaaagaactagagaagcgagagcaaactaattcaaaagctagcagaagacaagaaataactaagatcagagcagaactgaaagagatagagacacaaaaatcccttcaaaaaatcagtgaatccagtaggtgattttttgaaaagattaacaaaatagatagactgctagccagactaataaagaagaaaagagagaagaatcaaatagacacaataaaaaatgaggaaaggcatatcgtcactcatcccacagaaatacaaactaccattagagaatactataagcacctctatacaaataaactagaaaatcagaggaaatggataacttcctggacacacacaccctcccaaaactaaaccaggaagaggtcgaatctctgaagagaccaataacaagttctgaaattgaggcagtaattaattgcctaccaaccaaaaaaagcccaggtcaagacagattcacagatgaattcttccagaggtacaaagaggtgctggtaccattccttctgaaactattccaaacaacagaaaaagagggactccaccctaactcattttatgaagccagcatcatcctgataccaaaacctgtcagagacacaacatcaaaaaaatttcaagcctatatccctgataaacattgatgcaaaaatcctcaataaaatactggccaaccaaatccagcagcacataaagaagctgatccaccatgatcaagtcggcttcatccctgggatgcaaggctggttcaacatacacaaatcaataaacataatccatcacataaacagaaccaatggaaaaaaacacacaattatctcaatagaagcagaaaaggccgtcaataaaattcaacaccacttcatgctaaaaactttcaataaactaggtattgatggaacatatttcaaaataataagagctattcatgacaaatccacggccaatatcatactgaatgggcataaactggaagcattctctttgaaaaccagcaaaagacaaagatgccctccctcaccactcctcctattcaacatagtattggaagctctggccagagcaatcaggccagagaaagaaataaaggtattcaaatagaaagagaggaagtcaaattatctctgtttgcagatgacatgattgtatatttagaaaacctcctcctctcagcccaaaatctccttaagctgataagcgacttcagcaaagtctcaggatacaaaatcaatgtgcaaaaatcacaacaattcctatacaccaataatagacaaccagagaaccaaataatgagtgaactcccattcacaattgctacaaagagaataaaatacctaggaatacaacttacaagggatgtgaaggatctcttcaaggagaactacaaaccactgcccaaggaaataagagaggacacaaacaaatggaaaaatatttcatggacatggaaaggaagaatcaatattgtaaaaacagccatactgcccaaagtaatttatggatttaatgctatccccatcaagctaccattgactttcttctcagaattagaaaaaaaactactttacatttcatatggaaccaaaaaagagactgtaaagcgaagacaatcctaagcaaaaacaaacaaacaaacaaagctggaggcatcatgctacctgatttcaaactatactataaggctacagtaaccaaaacagcatgatgctgacaccaaaacagatatatagactaatggaacagaacaggggcctcagaaataatgccacacatctagaacatctgatctctgacaaacctgacaaaaacaagcaatggggaaaggatttgctatttaataaatggtgtatggaaaactggctagacatatgcagaaaactaaaactggaccccttccttacactttacacaaaaattaactcaagatggattaaagacttaaatgtaagacctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctgcacagcaaaagaaactgtcattggagtgaacaggcaacctacagaatgggagaaaatttttgcaatctatccatctgacaaagagctaatatccagaatctctaaggaacttagacaaatttaaaagaaaaaaaacaaacaacgccatcaaaaagtgggtgaaggatatgagcagacacttctcaaaagaaaacatttatgagaccaacaaacatatgaaaaaaaggtcatcatcgctggtcattagagaaatgcaaatcaaaaccacagtgagatagcatctcatgccagttagaatggcaatcattaaaaagtcaggaaacaacagatgctggagaggatgtagagaaataggaatgcttttacactattggtgggagggtaaattagttcaaccattgtggaagacactgtggcaattcctcaaggatctaggcctagagataccatttgtcccagcaatcccattactgggtatatacccaaaggatgaacaattaatccactataaagacacatgcacgtgtatgtttattgcagcaccgttgacaatagcaaagacttggaaccaacccgaatgcccatcagtgatagactggataaagaaaatatgtcacatatacattacggaatactatgcagccataaaaaagaatgagttcatgttctttgcaaggacatggatgaatctggaaaccatcatcctcagcaaactaacacaggaacagaaaaccaaacactgcatgttctccctcatgagggagagttgaacaatgagaacacatggacacagggaggggaacatcacacaacagggcctgttggggggtgaggggctaggggaggaataacattaggagaaacacctaatatagatgacgggttgatgggtgcagcaaaccaccatggcatatgtatagctatgtaacaaacctgcacgttctgcacatgtatcccatcacttaaagtataattaaaaaaggtaactttgcaaaatatttagagagatttattctgagccaaatgtgaggaccatgccctgtgacacaccttagaagaccttgagaacatgtgcccaaagtggtttgattgctcttatatctaatgtcttagagagacatttgacatcaatcaatacatgtgagatatgtgttgatttggtctataaagacaaaacagcaagaagtgaggcagtgtggggaggggattacagcttacaggtggattcaaagtttttcttattggcaattgattaaaagacttaaggttttatctaaagacctgaaatcagttgaaaaagtttctagatttagagagcgggctttggagaacaatattcttattatgcagatgaagtctcttatgtggccacccttagaggcaatagatggcaagtgttttctattaagacctttaaaagatgctagactctcagttaatctcctccatataacaaaaacacctggaaaggtaaagcgattctctacagaatgtaaatttctctcacaaaatataactgtgcagggcaatttaaaatatgtcaaaaatatactttagggcaaaagactttgattcctctcaaggcctgctgtcatgtgatgctattcttgagtcaggttagaatttggtatcttactgctacaaagaatctgttttctgagccttaagatctgtttgaatgaaaatgctggttagttgtgcttgaattccaaaggcaggagtgcataatgaggcatttctgatcctttcttgctaacatggcctaaactagcttttcaagtatctctggaactcctttttgaagaggaagggtccattcagccagttgggttgcttagaattctatttttagtttataggacatatatgagacttatcctaatcaggggtatcagaaaatattcattgaggtaatcactttaaagttgagacatgaaagatggtcccagattcctccctgcaaaccttctctcctgatactagaagaaaagttacaagaaacaaatgttaacatttcttctgtgttcaaaattgccccccattaggaaaataattaaacttgcaagacttatctttagaaacaagtaatctagttgatttctaaagtccttttacaaacccacagattctgattagtttacagattacatagagcatcccatctaatgggaatctgcaattagctggattcccctgcatttgatttttaaatgttgaatttatacagatacataacagttcaaaacctttatgtggtacatgtgatattttgataaaataatatgtgcagtgatcaaacctggataaccgggatatccttcatctcaatcattgattatttctttgtgttaaggacattctaaattttctcttctagctattttcaaatatacaataaattattaactgtagttgtctatgtaccattttagcattcccaacagcagtaagtgaaagttcctgattttcagctttctcttcaccatttggtattgtctatattgtttattttacccattttagcaggttagcagtattttttgaatattaaatgtacatttacctaataaaaatcaaactgatcactttttatctttacttttagatgtggtttctcttcaggtctttgcccattttaaaaataaattttgtggttttgtttttgttcaattataagtcaatttatatatttgtgataaaagcccttttccaaatattggatttgcaagcaaattctccaaatctatggctgatcttttcagtctcagttaagggtttattttcaaatatctaggttagtttgtccatctatgaaaagaggataatcttaattctaaattcttagaattattagaataataatgtaagttgaaattattccagtatctggcccttcacaagttttagtataacaccagtgagaaaaatttgcagattgttctgtgtagaccagaaatcagaaggtgataaaggggcaattagatttgaataatccggagatatgaagtgtatttggtattcacctccttctatttctctatgaagacaaaatggatagatgacctctccatgtgaaatgggacacataagtttttaagatgattctgaaagaaagttccttatacaatcactcaggtgatgttccaaacacagggctgtggaggggatggtggctgccggtggttgctgtcagccacagggttggtttgtttcccacaggttccagaaatagtttctaataacaaatgtcatattttgtttagaattgatttattttttataatttattttctccctgtaggcagcactcagaagtatgttctcagaataattcctgatcctctgtgagttcctggtgcagctcctggaggcaaagcctgcatgggggagggagtcctcctcacatgcagccctgaggctgccacgtcacttcacccaccgttgcccttcagtcacttcctgaacacttatgagttgatcttcctgaaacatgtggtatttggcagtgtctttcccaggtaagataatacttccattctgtttatccctgcaggcacctgtccctttctggaatataaattggtttcgattgtgtggtagtggataagtggggggaggaggtttgtgtgcatcttgtcatcttccagagtgcacccctcatggggttgacagtgacaagcatgcagatgggcttgctcagctggaagatgacaggcattttggtaacctgtgaccccagtgaggctctctcgctgcaagatcaatcaggctcaggcctctggctaaagtgcagccagcaaggggtccagtgcccaaccctgagagctccttccaggtaccaaaccactttctaagggaagcttttttcctgcctggatcccatgcatgtgtttgtattttcttcacaaaggcctttatccagaaacaccccccaagagcttatagtgttttgaattcaactgaagggcattattcatgaaagccctcatggccaaagtcttcacttctcattaaaggacattgattatgggattcaccagaagctgctggcctttcacaggcacagaccttcctctacaccagtggtccccaacatttttggcaccagggaacggtttcgtggcagacaatttttccatggatgatggcggtgagtgattatgggatgaacttactccacctgcattcatcaagcattagattctcatagggagcactcaaactaggtcctttgcatgcccagttcacaatagaatttggatcctaggagaatctagtgcacagctgatctgacaagaggcggagctcaggcagtgatgctcacccgccgctcacctgctgtgctgcctggtttctaacaggctgctgaccagttctggttcactgcctaggggttggggacctctgctgtaaatgcttggagaccttaccctctgggaaggggcatagaaaaacaagtcagatgagctccaaatcaatgtacattttatggattcttgaggaaagagtgcaaagaggaacgtccccacccactttccctctacctggcatcattcccagtaatccgcttgaggaacccggggtgtttcaagatagtttaggcttgttatactaggggacgccagaaaaggaaacaattaatgtgtccatgcgggtttgtcagttgcaagttattacttcagtgcagggtattgatcacggagaagtctgtgcgtatcttgggcaggaatacatgggaactctgtttcttctactcaaatttgctgtgatcctaaaagtgttttaaaataaatgtaatgtaaaaaaagtggcaaagacattttggaagaaatgttggccacttcttagaaattatgtttagtcttaccacgtgataaagcaatcctgctccaaatgatttatccattcgattttaaaatgttatgtccccacaaggcttccatgggagtgtttgcatcagcctgattgattgctgcctttcccactctgtgaattttacttacagggtgaaagttgaaaagactatttcctatataattagagtgtatacatctttctattgcttcttttcctcaattacttaacccattttctaaacacgtttaaacctcataaatcctgtcatcttctcacccccagcacagctgcctccttcctcaaggtttctgacactctcaggatgtgggttttcacactgcgtgtcttgcacattaatatacggctgtgtcctcagatctcaggctgctcagctccatgtaggctgtgtctgtagacgtgtcccaggtcgtggtgactctgccctggaattctgtgcatatattgtttcaccatcttcaggatcaacacgttccatccactcaagcccttttccaggggcctgtcgcccccagtgtatgtagtggaaggtgaaggtgtatctgggatcaccttcactgaggacccaggtttcctcacctcagccccagactgcaccgattggacctgggaatgggcacctgtggagaggacagagaagtggttgagactccacttaactggacccagtcccctcatcagccctggaacttaggattctcttccctgtggctgctgccaccaagaggaggatcctcccggtccagtccatggtgaggtgctgtgctctgggggcttctgtaggggagggatgtggttgttgtgtgatgctctctgggcaaggacagatctgtatgtacctcggtagacagcagtgcatttgcatattcacgaggcaggtatttcatagctcaagccacctcaacctgaggaagaagataggtgacacacggaccacgccacagtgggatgcagagctccctgccctgaactttgtttaatgatatttgccctctgttatgctcagaagtccatgaagacagaactcgttttacagaaaaccagaatctcccaggacattgtcctcaatgtcatttcttgttcatatggcaccctgacaacctgaacttttcctgggccttgacctctgcacatctaaattctgggatgagtgtatcttccgacagtaacacccattgaattaataaaaccactcttcaattcctaactataaatacatttgaaaagaccagacatttctccttttaaatgctgtttgcattcaattatttggttaggtataggctacatatataatagaatacttaaagacacatcagtacttactacattcttatttagattttaggttattattgctttgaaataaagaacattcaattcctgagagaaaacccctccccagcctcctgtgcacctgctccagggctggatcctgtgctgggtgcgccctgagcgccccctgcagctcagctcctgccctgcaggaaagttcctgtctgggctcatagagaattctcctcccagcgtctcaagcacagtatgaagtggccttgccctgactcagaatgctctttcaatggcagcaattgcttctcccaccatctcttacagtagcaaataggccttagaacacccgacataatctaccgggagacctcagcacagcaacaaggaatcactaaagccaccagggagccccttccctggagttctaggtgcactgatagggtccggacacatggcaagtctaggaaccgatgggaactttggggcagcctctatttttttttaggattctgtggttgacgatcacatcagattgtaactttacacaaagaccctatgtctcaaagcacccccccacacacacacacacatacactcacagtggcacatttgcacagtaacgagactcagatttgccctccttccaagtgtctcaatgaaaagtgcttccaacactggccatagtcctgcttgtgtttgttgttgttattttttccagacagagctaaagcaagctcagtattactggagatttgggaagtgccttcatgttctctttgccagttctcacctgggaaccctgcagatgccccatgagaagtaaatctaaggccattgagggagaggctgtgaccttggtcctgaagctgttgttctcagaggctttgaatcacttcactgtccttgacttgttctctcccactgcctttggtttccctaagttgtagtgtttggacagagtctgtgcattatcacacttttctctttaatccagattaatcctattggtgaggaggggaggtaatgcagtggacaggggagcagtatatgttctggaaattgacttccaatgttttcttgctgtgttttctctaggctgcaccctttacaaggagtctccagtggtacagcggattttcctccatcctccactccccttcctggctgcagcatccacagattattttcttgaatctgaccccagttgtttattaattataccccttttcatgacacgggaaggctaagatgaagctgtctgggatggaaaagaatcccttcctctcacatagaataaagatcttgaaaagtattttgtctctgtagcatctgttaggagaaagttctgggcatatttatcacagaatagttctcctgacgacagagctacgagtgattctgtttggactctcatcttgagaacccagaattttctggagggaaattccatgatagtgtggggtgtgtggccccccaggagttcttaccccatccctgtctacacctgtcctccagacatttatggaattaccatgtttccgccagcttgtgctgtcaactgaagaatcacccaatttattgatttagaaaggggactttatttctgagaaaggattgaagctgcaggacggccatcttaacaggctgggaagcaaagcctcccacagagacattgagcaggtacttcaagacagggaaagacgagaaatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattccaaggacccctctagctcctacactctgggccaaggtttcctctgagccgcagtcagcctagaggacctaggatacatcttccttggacagagacccaccataggggcagcaggaggtaggggtgggggtaggcaagattcctgtggggaggtggagctgtcatcagagatggtgtctgcaggcagtgggtgtatcgtggctctgctactacttgctgggtggccccatgacgtttctttccccactctgacctcagtttccctatctgttccgtggagataagatgcctgcctacatatttgtggactgggatgtgtgtgggccagttgcagtgtttcttggtgtggtcctggggcaggctgcaccaccccatagagatttctgggccccaccctaggctcacaggaccagaatctctgggaatgaagcctgggaatttgcatttccacaggcatctggctgattctgacatgactgaaaagcactaatagtatatagcaagctctttataaaaggtaaattcatagctgccttttactaaacataaatctcaccttcccttcctcagttaaggacacacaccgcagttgaaaatcactgtgcctttccagatgcagaatctgacctttccgataagattctgttaactgctgctttctgcagtttgtattccaaaacaaggggaatatgtttccattttttcaatacaaatgtttaagtcggatatgctttctcaaactggacacgcactcacacagcttagggtttcagctatggcttcctctcaaattattagcctctttctgccagggagcagtttttcccagacaagaccctggacagaggttggtggggccctcctcatcagaatcactagattatgactgacccctagaggtggcttttctgcttaagtgtcagcccatgggctgggttgtgacccccaaagctgcggcagaagcttccacccatcctgggccccccctgccatctatggggaaaggcctgtcccttgtcttctgggcccagccggcctcacaggcattcagcagattggaaagtcgaagcatgtgctgtgcttggctgggctctcctgcgcccctttttggggtgaggtggagtgcatccagcccccagcatccctgccgtttattcccacccctcatccccacccccatacacactcacaagtacaaacacaagcacagtcactggcacacaccactctggacagcaccatttccagcctcagcggggcagtttccttacagggaagttaatgaggcactaacgaaggctcaggggacagggggaacctctatcgagaagaggctcctagacctggttctgcctctgaattgctgggggtccttgagaaagttgctatccctctctggtctcagtttcctcaggtgagaaatggggggccggccaaatggtctaaggttctgggaacctctaaatcagagcccgtagctggtggtcaagatgagggagaggccctcagggtcagccgaatgcctgagaggccggacaggcccaaaggtgagcaacgtgagcacatcaggtgggctcagagctggcgcatgagccccacagcctgcagagcagccctgtactcgggagcccgctcgcaccaacccagtgggacttcagagatgtggggtccagcctttcctactattgctgggctgagggctgggagctgcagattctgaccccacagctgccttagacatgccagatggtctggggcaagacacacccctctctatgaaatgagcagccagtccaaataggtacattagagaagggctgtgggatggacccagctgtagcctggggctacagactggcttccggggtactcaagcagctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggcggctgctccccacagccaggagtccggcccagcacccacctgagtccgcctcagtcctgctcaattgggttatccgtgctcttggccctctggtcccacccacagagggaggtctttggggcgaccaggtgagctggcccttgtgggaggatgtaactgactcctgagcctggcgagccaggcagcccctcgccaacgtccccacccctacctctccagcccccccgcattccctgatcctcccatccgctcccctgacccagcagttgcctctgctcactctcttttcctgctcccaggctcgcctggtcatgtgtccttcactctcctctgagtctccctctttccaagccgcctccactctacttgacacagtctcccttaagacaccagagtacacaagcgcaagtccctgcacctcacctttactcccagacatgggagggagatgacatgaagacccaaacgccacttagcaggagatctggggtatgcagaggggcagaacggaggctgtggaagctccaggggctcccttcaggaggccacatgtaagctggctattgaatgtggctctgagctgagacctctccttgaagctccagaccaggagccagctgatagctggacccctccatttggtgcctcagagaaactttgcactctctaggtctaactttgaacccagaaaattcccccatgtcggccctgtctcttcacagggaaagcaccacctcagacccagttctgcaccaaacccacatttgagtcacgaggctcctgccctgcactgtgagcactctggataagccagtgctgagggggaaagagctctgaatgccaagccaaaacatgagcttcaactccacctccagctctgagagctgtgggtagggaagggccctagtccagtttgctgtagaaagaccagtctgccactgtatggcacatggatggcaggggcagagtgcaggtggagagaacagaaggtgggcagggcgggggaggcagggacatggctgtagccgtggagatgggaggacagacaggacttggtggccacttgggtgaaccaagggaggagtcaggaagagacacccagttttgtatcagatgtgtagagcgtgggatgctgttcattgacggagggaggaggaggaggaagaggtatggcatggggaggaggtagctgagctctgtcgtgaatgtcatttgaagtccccagggaaagccaggccggccagcaccttcactgcttcagccagctctcagggtgtctgtgctccctggccctctcagctcctgcttcatagctgtcagctgcagtgggagacagctgcacaagggcccagcatgtctgtgtgtttacccaggggactgccgcatggcccatgccgagcagaaactgatggacgaccttctgaacaaaacctgttacaacaacctgatccgcccagccaccagctcctcacagctcatctccatccagacggcgctctccctggcccagtgcatcagcgtggtaggtgcagagggtacctgtggctcaggctcaggtgaagaggcagctcatgcccaagccctaagcagtcaatgtccagaggaatgaaatgactagagttgacttagactcaccggtacacggtggggaggctggaggagggtccatgaggtttataggtgtccagtatttaatgaggtcatggttttgttaacaaagaagaaatgagggtgggagcgagatcaccactggctaggcagccaatgggcctgcagagactctgctcagctgagtctccagcacgaccatgagcttctcatcctgatcctcccatccccaccctacttttctcccccagcttgctcaacaggtgaccttacaggctccctactctttgcagggaataagaaccagactgggggaactgacgggtacagaggcccaggtgtaggcgcaggaccacaggcagtgaagcgtctactgacccaggcgggtgagggtctggagagtgggcatggctgctgcaggcatggaaagcaggcacagatggcggcactcccagggcccattgtcagggtctccacatgtggacgtgtgcagaggtgggggtgctgagggaggaggggcagggaatttctcatcttctctctactgcctctgagttggagatgtcagagggagccatggcccactgtaaagtaacacaatgtccccacccacaggattagaacccctcccctggaagcagctctgaggggaacagtcacatgtagagagtgcagggcactgtgtccagccgggggaaggaggtcaccaagggggttgacccccctctggccaggtggctgccttctgacacaccagcctctgtctctagcacggtggcccccacacacccagcctgtgaaacctacagccctcaagaaggctttggccaaattaaggagcggctccctctcccaggaggaagcacaggtgaaggatgtggagggcagtagagttgtgtgtgctccgccccctttctccacagtcggatggaaagaagggggctttcagccaggctcgcccaggctggggtctgagtgtcactgtccagctattggcttcttgcttaatgggtgagcccagctgctcccgtgcagctgccgccctagtgagggtgaaccggcaggcgagttacatttctgaaagcctgggaatacagtaaatattaggctgtgggctgctgggccaggaagagttgtttatttttcagggtttgtttatctattgacttgatgagggagggttataggtacaaccagtttaaagatggaaattttgagagagcaggcagggatttagtgctgggtaagcctggtcaaagcggctcttttggggcggccagaatccagtaccaatgtcctcagcatgttcatcagctgctgggggagtgcgggacagcatgaaagcacaggagaactttctggatgatagaaatactctgtatcttcaaaggaggtgggttccatagtaatgttaaatgagttaaaactcatcaaaatgtaaaccagacctgtgcatttcactaatagaaattatacctccaattaaaaacatgttttaaaagacagatgggccggatgcagtggctcatacttgtaatcccagcactttgggaggctgaggcaggtagatcacctgagtcaggagctcgagaccagcctggaaaacatggtgacatcctgcctctattaaaggtataaaaaaaaattagccaggcatggtggcacacgctactcgggaagctgaggcaggagaattgcttgaacccaggaggcagaggttacagtgagcagagatcgtgccattgcactagagcctgggcaacagcgcaagactccatctcaacaacaacaaaaaaaggacagatgaaggttttcaactttcagtaaaggcagaggagcttgttacagattcgcctccccacaagagcagttagaaaaactggataaaaatgtgccccgcccccaatcaaaaacaattgttggaaggtaattggagacctcagtcaggacttgagtgaccaggcctaggaggtgatcctgacagtctgtagtgctttcccacatttggtgattggtcaacagtagagggctaagaggctaagaaactgagtatgaagtggtagttaagaggctggagagcctagctgaatgtttggcactctcacagggctgaaatgacctaatgagaatttgggtcccaggaaggagatgggaccttggtggggaccctggaagggccacccctgggagtccaaatgaataaaacatagaccagccatcagaaaacctaaaacctgctttgaaccagcttagtcccaaagtagatgaaggcgatctgcccttactccaattgtgtgccataaactcaaagtcaatactctctggaggcagataaaagtttactatgaatgtcaaaagacaacacaagactaaatgagaaagaccaagaagaaaactaatagaaacatacatgtaaggaagaaacttttttttttgagacggagtttcgctctgtcacccaggcttgagtgcagtggcacgatctcagctcactgcaacctctgcctcccaggttcaagcgattctcctgcctcagcctcccaagtagctgggattacaggcatgcgccaccatgcccggctaatttttgtattggccaggctggtcttgaactcttgacctcaggtcatccatttacctcggcctcccaaattgctaggattacaggcgtgagctaccatgcctggccagtattttgccacaatttaaaataaataaaatttttttttcaggtttgtgctcagactatattctaaacagtcacatggcggcttactcttctccaggccttgctgccggcttttacatgtttattgtctttgccttcttgtcatgtgctcattagatggcagcttccaggtgctcctaaggggccaggaaagagagtgagaaggcacggaggttgccagatcatcccccttggggccccgccctcatcaactccctcaaccgggtctcctgcaactattggtgggccatctcggccaccgcttcgccctgagcttcctgctgctgcagctgggcagtgcctccttctcagaggccagctgctgataggcggccacgtactgctgcaggtgacccaggtaatggtctcgctgctgctgcagactcagcctcttggctcttcagctccacctgcaggataggcgtcagggtaggtagtggctggcttccagattctgggcccataaacagggtagtgagggcactgcggggctctgtcgcctacccaggcccctggccctggccccttcctccaggcctaaatgactgcctcccttgcctagaggcccatgcctccctccccagcctcaaatctcacacccttcttcccaccatttaaactgtaggccacagactggtggaaaagcagagggagccaaccaccatctgctaagttgtggtgaggtcattctgtatgatctccagggtttgcacacacctccgcctgctccccccaagagctcggccttctgccccagcttccccagcctctcctccagctcctgcagcctcacctggtgttcctgcatcttctcctcctgctgccgcagcctcacttcctgctcccacatcttctcctcctgcctccgcatcttctcctcctgttcttgcatcttctcttcctgctcacacatcttctcctcctgctcccacatcttctcttcctgttcctgcatcatctcctcctgctctcgtatcttctcctcctgctcccgtatcttcttctcctgctcccgtatcttctcctcctgcctccgcatcttctcctcctgttcttgcatcttctcttcctgctcacacatcttctcctcctgctcccccatcttctcttcctgttcctgcgtcatctcctcctgctctcgtatcttctcctcctgctcccgtatcttctcctcctgctcccgtatcttctcctcctgcctccacaccttctcctcctgctcccgtatcttctcctcctggtcgtgcatcttctcctcctgcctccacatcttctcctcctgcttccgtatcttctcctcctgctcgtgtatcttctccttttgcctccatatctcctcctgctcccttatcttctcctcctgcctccacatctcctcctgctcctgcctcttctcctcctcccgtatcttctcctgctcgtgaatcttctcctcctgcctccacatcttttcctcctgctcccgtatcttctcttcctgctcccgtatcttctcctcctgcctccacatcttcgcctcctgctcctgcctcttctcctgctcgcgtatcttctcctcctcctgcctcttctcttcctgctcccgtatcttctcctgctcgtgcatcttctcttccagctcccgtatcttctcctccttctcccacatcatctcctcctgcctccgcatcttctcctccttctcccacatcatctcctcctgcctccgcatcttctcctccttctcccacatcatctcctcctgcctccgcatcttctcctccttctcccacatcatctcctcctgcctccgcatcttctcctcctgctcccgtatcttctcctcctgctcccgtatcttctcctcctgctcctgtatcttctcctcccactcctgtatcttctcctcctgcctccacatcttctcctcctgttgctggttcaggcggttccacaactcgttctcttccacctgggcttggagctttgctgacacactctgcagctccttacccaggtggtcagcctccgcctgcagctgctgctggaatagtgaaagtgtttttttttgaacctcagaaggaagcagaatcatgagctagccacataaatgtaatctataggctgggagccgtggctcacgcctgtaatcccagcactttgggaggccgaggtgggcggatcacgaggtcaggagatcgagaccatcctggttaacacagtgaaaccccgtctctactaaaaatacaaaaaattagccgggtgtggtggtgggcacctgtagtcccagctacttgggaggctgaggcaggagaatggcgtgaagccggggggtggagcttgcagtgagccgagattgcgccactgcactctggcctgggtgacagagtgagactacttctcaaataaataaataaataaataaataaataaataaatgtaatctataaaataatggttttcatccatgatcctttaaaaaaatatttttaagccctaactcttgagattctgattccccaggcagggccccaatttgtacatttttagtacactctagaggattctatggcgggaccagaacaaggacccaaattttccagctcttggctggagcctccccataccctgcatgatccctagaccatggtcccagctggatgggtctcccacaacccccggggctgcagctgctcacctgtggcagcaggagcttggccctctccagtttcctttttagctcctttacgttgagctggatctcagacttttcagattctacaagttgaagtttttcttgtagtttggcatttttctccttcagctcctcatcagttatgctatggccagaggcagtagagaaaggaatgaatgaagaacataaaagaccactttggtgattgaccccctaccctcgccccacaaccacagaaccgtggcgctggaagggaccccaggaattaaaagtcccaggtggcaggccagagagaagacatgagttgcctgaggctaccccatgagtcagtggcacagccagcactagagcttccgtgtgcacacatgaaaacatgtatgagcctctccccacactcacctggaccccccacctcccagcacaccacccatgctaagggcccccagacctcccattccaccttcccccatcctacgtgttcctgtacagttccagactcagggcgtccctctcctttgttaactcctcaatgtactgcaaatagagaaaggttaagtcaggatagagcaggcacagcagtagctggacgaccaggaacaactgctacagtgactactccacagtaacacttcctcactctcaatcacacctgacgtgttctcaaggcatttccaagcccatggtctcatttgtttttctttctttctttctttcttttttttttttttttggcagagtttcattcttgttgccctcactggagtgcaatggcacaatctcagctcaccacaacctacacctcctgggttcaagcaattctcctgcctcagcttcccgagtagttgggattacaggcatgtgccaccacaccgggctaattttgtatttttagtagagacggggtttcttcgtgttggtcagtctagtcttgaactcctgaccgcaggtgatccgcccacctcagcctcccaaagtgctggcattacaggcgtgagcgagagcacctggccctcatttgtttttcaaagaactcagtggatgtggaagggacagggaaagagattgaatttagggctggctaacaggggcccagagcgatcagataatattgttattgctattactgttagtactaccactgttcgaacctttattgagtgcttcaccaggcactatgctaacaatcccatttaatcctcacaacctccataggagatggttaccattattacctctattgtgtagatgaaaaacatgcggtattaaaggttaagtgctgcctaagatcacttggagctgggatttcaacacccagctatatctgattctctaagcccattcttccgctggaggtaggggcacagttaagaaggaggaaattaatcctttgttgaatttttgaaaggatgatacgttcgcatagtccaaaactcagaaagtccagaagggaaatatctccccccaacactgtgcctctatcctgagttttttaatgaatccttacaaacgtgttttatgtatgttaccataatacgtacacacacacacatatacacctgccccctctctccacacaaataataacatactcaagatactcttctgtacctttatggtacaagtaccctaaccgccacttaggacttggccaaggccacagccaagtatgggcagggcgggcacttggcctctgagctctatgtccagtgctcgctcctcacagtgctccccaactcacccacaacagccgactcagccccagtctgcctctaacaaccacacacaaaagcagcaagaaatggccatgctgccttctgggcaggacactccatcctacagaagggacctttaggctcactcctccatctgcgaagctgggctcccaagggacggggccgtgtttggactcaccctatccgccttcttcttctgtgtagcgacagcagagagagcctgctctaactctcctgcaaacttccatgaatcatgcaggcggctgatcagatccctggcctctcctggaatgagagacattcagatgtggcccaaaggactccccctaaaggcctgtcaaagtgccaggttgaaggatgatggggtgccagattcccaccttccaactgcttgacagcatgctggctgtagtagagtgccatctgaagctcagttttctgacatgtaaggattcgtatggtatgaacctgggcctttgggagaaaagacaagcaaatgctgaaagagaagcaaagaaacattctccagagggcaggagggaacttcacaccctccactcacctctagctccctccttagggcttcctgatgttggtggcttgccttctgttcctatagaaagaggaaaacagagctcttactagggggaggcagagatccacagcaagagacatgcccccagaatggcaccactgccccagaacaggcccacccatgggaccagtttatcagggaccctgtggggatggggtggaatcttgggggtgagccttcttccccaggctgggagtgggtgagatgagcctggggcctctacatctgagtgcccccaaacccagcggtcatgtcgtgagcaaagaaatcacactacttcttccagctgagctcggttctattgtttctgtggggagagtcaaaggaaggtgactgagggtggcccccttgactctattccccaggccaggaagcgataggcaggggccaggaatggatttaaaaggcacagttctcagacccaatgggaacatgaactggtcacctctcctcaactcccaaagaagaaggatttgggtctttttggtttttgcccacagccacagaactcaaagtctgaaactagattctcttgaaaagacagtaacagaaaccttcagaggtggagtgcgagaaaagcccacccttccgccagcttgtgatttagaaaggtgcattcactcagcaaacgttgagcacatacgggccagggacggttcttcacagcgggaatagaggtcagaaaaggcagacaggagcccttggccccgaggtttccattctagtgggcctttaactctcgggctctcagagctaacagaaacctctgatactctctaactctacctcaggaaacgcaagcccaagaaggagagtttacagcaggtcctggacgagggattaacataaaaacacaatgacaaatctcatttaaacttcacaaacgtaaggaaaacaataccactcgtattttacggatgtgaaaagagaggcccaaagagctcaagcaatttgcgctaaatcatgtccctagcagatggaggggtaggattcaaacccagaattcttagccagtacctggcagttcttccacaatcttaacaattaccctccaccaccccttgggccctctgtccccaggagcccggccagccaagactcacatcctcaggcgagtggcaaccaccagaagtggttgtctcagggttagtgccattatttattttcttctttttggtgtcgcttgctgctgtaccaacactagggttggtctggggatgatggtctgtcaactgtggaaaggaagagcagtgatactcatgagaactacaagctcctacagtcacatcctgctttacagtttatactaaatacccttatagaccatctgatttaatgccaccaactgtaggaaatgttgtcacaatcacttagtgactgagagagattgataccatggctgaaaaaaaaggcagtaatggaacttaaactcagtcttctgactctgagctctgggattttgccctaaatcagcagctgccagggaccaaaaccagaggcagaggtagaaaagcaaatattaagtaggcaggaactgtgcactatgtggtttagggttattcaccctcacacgtctgttagtgttaaaaagtacaccagtacctctcaaacctttacatcaatgtctcctcatggcagaaggcagcctttctgctaaatctgggaatttaacagaaagaggacaacccaagcctcatttcagagagaagtcttgtatacgcttataaatctacgtgactttcatccctaagtacattaatgttttgcctctcaatagaatcaagggaaactgatgcttcagaaagatgccccatatttatcctgtggcactcaaagtaccccaggttgagatgagatgaggaagactcaagctaagttcagtttcccaagatctgttccacagaagataagcagatctcactccagaaccagtgactgaggggcactctggtcccagaacaatggagaattcaaatctgaggtgcagaactgagaaaaaatgttaaaatctctctggagagtagaagcctgggagaaaaccaaaccaaacccgttctcccattgccacccagagacactgtcaacgtgtcgagctcatgggggaggtgtaggcttttcacactgtcaaggtctgtggtaaggaagtcaggcagcctgaaacctctctcttctaggtcccacagtccccattccccttccagctggaaacctgtgctgcaaccagaggaaacagaagtgggcaagaacacttaggggactgggtcctaagaccaaaggccggtcttgtggtagtaatgacagtttgtagcgggactgtgacatcactacattctactcctcggtggagtggttgggggggacacatgagtgcaatgcccaagttgccgctttgagactggggagggggtcacaaaattgggagccaggtccttggagacgtgaccccaaagagccccgggaggtcaggcttggggcggcaggaggtgagggccaattaaggagcaaggagctccaggagtcacatccccaaagtcaccctgtggcaactggtgagggcaggttctggggcacccaggtccttggagatgtgagctcaaggagcccagggaggtcgggtttggggtagcaggaggtaagggcggagtatggagttggaagccccaggagtcacctgctcaaagtcaccctggtgtgccgggcagagcaggggcaggacttatgagggggttgggctggctgacaagattttggtgtggggagcccagaggcactggggtggggggcccagcctggtgtccctcaggagtggcacagactctggcagcagttcggctgtcagagggggcctcgggttgggttggggtgttggtgcgtttacctgttccttggcctcggccaatttgctctgtctggtttctttggacatcataggatgggtagggaggtggggatgggtagggaggtggggatgggtagggaggtggggttggggccacatcagcatgatccaggtgaggacaagtatatacctccagtcacctctacgtcgctgtgtgactgagccagaggaggcgtaaccagggctgcactagaatgcagaataggggtgtggccttcatgcttgaagcccattggtcaatgagaaagatgaaaggaaaaggaggtgtggccagacagcagcgtgtcatcaaggacctgtgttgtcacaaggaaagctgcctatgcaaccgctgtccccgcccactccaggagaggggcggggctggctttcactttaaaaactttaaaactttattacctcaattgaggtacaagtcctattaaaatggaaattttatagtgtgcttgatgattgataaagcagactttattatccaacattccaataagataatcacaatgttttctcttttttggaaaaactttctcttattctcctacattagcgtttagttttttttaaaaaaacaaacaaacaagaaacatgtctaatatctttaaaaatacaaagctttgagccaggcgtgatggctcatgcctgtaatcccagcactttgggaggctggggcgggtggatcacccgaattcaggagttcaagaccagcctggccaacatgatgaaatcctgtctctactaaaaatacaaaagtagctgggcatggtggcaggtgcctgtaatcctagctacttgggaggctgaggcaggagaatcccttgaacctgtgaggcagaggttgcagtgagccaaaatcatgccactgcacttcagcctgggctgctacagaatgtgactctgtctctaaatacacacacacacacacacacacgcacagacacacacacacacacacacacacacacacacacacacaaggctttccatttaataagcactcaaagttctttacaaggttaaagcaaatacaggacccttctaaagtaaggctaaatgctaagtgatgggggagagaaaaaggacataaataactcctactctcatgagttaatcactaaatccgatttttctagaatcacctggcctctaagccctgaaaatgaaactgaatttctcactcgatacttggctatgacttgcaatcatgaaaaccaagaattgtgttatgtcactgtgtattgcttgttacctgggatcaagggttgactttttcatgatttgctccattacctgtgtgcttcttctcccagtccaaactacgcttttttctagagttctacaatttacagttagtatgtaagggtggctctcaaacatgtagtctccggaccaggagcacctgggaacttcttataaatgtaaattctcaggccccaccctagacacgaatgaatcagaaactctgcagtagggcccagcaatccgtgctgcaataatccctccaggtgctcaggaacctctgccatacagcaggtagaaaaatgtgtttccttctgtaggtccaaagccagggatactatatgttctgtctcaatatgaaacaatgacatgcaattaaaagacataaatctccttcctacttccaccctccagccagtgtgttttatttttatgagttcaataagaaaacgtgtggcaatcagagatttcatctaaaaaatatatctacaggtatcagttctcatccagcctgatctcatccaatatcatttctatcctcttacatctaaagttttagaaaaggattttcacaacgtaagactcaggcgcactaggagttctatgataaaagaccaagtagatctgaatgtccaaacttactagagaagaaaagtggactcattggctatattttcaaattgcattcaacaggaaattaaagttttgaattttttccaccttcatccttccaagttaatagaattaaaccagaatactccattcttccaaagcctgtagccaggcaaacttttactgtattacttcttgcttttcaatggatataaagcagagtcctggtaggcacattttgtatacctgcaaagatgcaaaactaaacagttccctcggttcaatattaaaacaaaagtcctgtaaacctcagatggtgagtgtaatacttcagcactagcacgaaagcctcaaatataaaaagataccaagaaccttgctagcaaaccaaagtaagctcttggccgggagcagtagttcacgcccgtactcccagcatattggcaagctaaggtggggtaagtcaggagttaaagaccagcctgggcagcatagcgaattcatatctctacaaagaaaatttaaaaattagctgggcttggcggcacacacctgtagtcctagagctacttgggaggctgaggtgggaaaatcacttgagcccagaagtttgaggctgcagtagctatgatcatgccactgcactccagttggggtgacagagcgagatctaattattacattctgtcctgctcctgtttccactaaaatcactaacttaaaatgtgttcattcagcaggataaaaattaagtgaaatttgactttggtgctttgctagcaaaaaataaataaataaagtgaagtgacaaattacttactgggagaagatctttgtaacctcaatgacagattaaaggtttgtagccttagcctataaagaaatctttaaaattactcagaaaaaaaaatgaatgatttgcagcagaaaatgggcaatggagaaaccagcacttcccacaagaataaaaatggccaatgagcaaatgaaaaagattcaaaagcactagaaatcaaagaaaggtaatgaaaacaatgagattttctgcttaaagaccagcgaagatgacaaatggaagggggaacctggagctctgtccctgttggtgggagcataaactcaaccaattttcctgtaggatgatttgaacatttcttttaaaaatcctaaaactgttttatattactttcctctagaaattctacttctatgaattcagtgcaaaaatcctgactcgagtccattaaaatatatatagaaggaaatccacctctggggtggcaatgactcacttaacatacatccagtgatgatgccagggtatatttctccatagaaacatgcttaaaatatagtaagtgacaaaagaccatgtattgtgattctactttttaaaatgtttacagcataaaaagtgtgaaaagcaacaaaccggaatgttttgagtggcaaaattaaagatttttctttacattttgtcatccaaattattacaaaaacaatgtgatttcctttataatcatggaaaagtgttattttcatttatttatatttacatttcttttctttttcttcttttttctcctgtatgtatcccacataggctacagagcttaaatccctgcctcttgagagaaatcagcccattttcaggacatgcaatacacaaagctgccccatcttccctttatttttatttttatcttatttatttatttatttatttatttatttatttatttatttatttatttatgttgagatggagtctcactctgttgcccaggctggagtgcggtggcgcatctcagctcactgcaacctccatatcccgagatcaagcgattcccctgcctcagcctcccgagtacctgggactataggcatgcaccaccatgcccagctaatttttgtatttttagtagagaggaagttttaccatcttggacaggctggtctcgaactcctgacctcaagtgatccgtctgccttggcctcccaaagtgctgggattacaggcatgagccactgtgcctggcctgtcatattatttctaaacatttgagtgacatttcaattaagtgaaatttaattcttactgacctgatctcttatcctctgtttaatgataccttccagttgaaaggtgtttcctctgtaatcacgggtgccaaaggaaatacaacatgtattcattaggtggatccactaaaccacggattcacgcattgtagtccttacaccctcagcatcagaaacacgtgggaacttgttagacatgcaaattcctgggccagccccacacctcctgaatcagaaagtggggaaggacagctatctgtgctttaataagccttgagatgctccctgaagtttgaaaactacagaactagaatacatatggtagtaagtgctcatactttatccaaggtactagggactcttcccctcttttccattctcttttctgttgaaataaaatgagagctccttttgacttaatgggtataagcaagaaggcaatgagatgaccagggtttcaagttagagttcaaaatttaatcagtggacagtgacaggatgcaagccttctaaacagattgctgcaaggaagctgattataatctatacagtaggtatcattagtgtattgatgttaaattttgggggtggattaatggtattgtgattatataggagaagtcctggttcctagaagatatctgcgaaagtacttaacagtgaaatgctctgatactgccaacttactttgaaatgattcagggggaaaaagggcacatatacaatcttccatacgcagaagacagaaaacaagtgtgacaaaacattaactagtgaatccagttgaatagcatacagatgttcactgtatgattttatcaacttttctgtgtttgcaagttttcaaaataaaagttgagggaaagaaacatcaccccaaatctttctatgaaatgggaccacagaaaaagcagagaagtgaacactttgcagaaaagagcactgcacccatccggacagcatggtcaaagtgcaggctctcctccaggaggctcttctctggtctcttctgtgctgtcacttcccccacatgcagccaaggcttttttctaacaactctttttctaaagatgtaatttttgtcattcatctaagaaagagaagaaaagaattagtatacatttagaaaataaaattacacttacatttgtgaaaaagcaaaaaatactttgaaaagtggggaagcaagaaatgtactgttctacaattctgttctgttcttaccatctttttattctgccaatgacttcctattcctgctgtgtatggtggggtgagctgcaaatgatttcttttcctcattgatttaaaatgtcatgtttataatgtaccaaactcccccagaagcatttgggtttatttctgggctctattctattcaagtaatctatctgttcacaagccactatcaattttgattattggagcatcctaaagttaagtaattgttgtttttgtttttgagatgcagtctctcactctgccgcccagctggactgcagtggcgtgatctaggctcactgcaagctccacctcccgggttcatggcattctcctgcctcagcctcccgagtagctgggactacaggcacctgccaccacgcctggctaattttttgtatgtttagtggagatggggtttcaccttgttagccaggatggtctcgatctcctgacctcgtgatccgcctgcctcggcctcccaaagtgctgggattacaggcgtgagccaccgcgcctggccctgaatttgcttgagtttttagctctctcacccatttcaggattgtcaccacccatatctgacacgtcctcctcctcctctaaatcttctaggtcctcctggccatcagcctctgtttctgaaccagcctcttcatgctcctgttcttcactctctgggagaagactgatatcttcatctttctttcactaaccgcattctggaagcactgtaaaattgcttcattttgcaattccagttgttgcaaagtctgctcatcatcaaaactttctatcacaagtttttgtaaagagctgccatggattctaccattctctactgttttattaaagtcataaagcactttcgttaaagaagtgaactttggttccaatccagcttgaaacctattgggaggaattaaatgagatttagaattatagataataatttcacagccctcttaattaaaagaaaaataaaaacctcaactcttctgtaaaatcaaatttgaataaagtgtaagtatagattctggccccaacaatatataagctgatgagccacagtgatatataaaacctgtcaaccaagtatttgtgaatcagctgtatagattgttggcaggaaaagcattacaaatctatttgcttggagatgtatagagaattagccttaaattttctactctgctacattatataccactccattcattcattcccttattcactcaatgatcaacatttgctttggcttacagtggtcaaggaaaacctctcctagatgtgacatctgaggtgaaacttacagacaagtatagtcttataaagattgggaaacatgtattccaggcagaagaaacagcaagaacaaattctctaagatgcaattgagcttggtaagcctgaggaataaaaaagtgagcatggctatagcgtgaaggaggcagaaggtgaagtcggagagactgatgggagccaaattctgcagggctcaagggtaagagtttgccgttttaagtgtaataagaaaatgtgagaagattttaagcagaaggatgaaatgatgatttatacgaaggaagaagaaagggaggaaggaggaggaggaaagtagagtgattagaaggttgatgcagcattccaggcaaaggatgatggtgatttaagctggagttagagcagtgaatatgctgagtacagtttggaggtagaactgacaggattgctaaggaattagatacagaatagagaaaagtgaagacatcaaaatagcagcctagttttatgtgcgagcaactggagagacagaactgccatttactgcgataggcaaggcttgagtggtggagcaaggggaaaggacttcagcggatggcagagtgtaggtgggtagaaacaacattctactgtattttggacacggtgaatttgtgatgctgagaggaccaaaatttaaaaaattgttaaaagccgtacggtgcggatatcccagttgtgcgctactgaattccaactaagctcagtctggagttgcttgtgagcaaggaactcaagggagaggttggagtttgaaacataaatgagtcataattttataggtcatatttgaagttcttcaacaaaatacacataaaacgtttgtgttgggaagagacatgaaagttctaattctcaagaagcttagtggggtagacagacaagtgacaagtttgtgctttcaataaagtatgatggcaggtaaacactgagtgctttaggagcacaggcggaaggagaaaccaacacagttgtgtgtagggggatgggggccgtaataagcctcaaggggagcttataggcgtgaataactgaggttaggttgatttcaataacattcaactgagagatccatactgtaaaagttttaacaatttttaaaattttgatagcctaggtcctctgaaatgtggggaaaagtgatttacatttccccttaccttcccccagctccacaatttgccaggggtctgcaacccgtgtccacgtgcgaccgcagtcgcacccgagcccgggatctgtgcacttacgtgaggatgcactcgggccagccagtggctttgcccacctccctcagacaccgctccagggtccgtcagcgccaggcccatgggccatggctgtctgcaactcccgacacaagctgcaaggcaagagagccgctgggaaaccgcaccgcaaggatgctgggattggaacaggaattaaaagaaatgaaaaaatgtgtaagcaaaaactcagctgtatgtaaaaaaaacccaattccccctgagaatgagaaagagccttagtcctttaaaaaaactacctgttttcctatggctagtgagccttatcgctcccttcccaggcattatcaaaaccctaattccctaactgtgcaactgcaaggtcactaaacaaacaaatgcaagtcacaaaacatatttttcctaaaaacgtaaaaaaaaaaaaaacataatgcgtgcttcaattaaataactctctgtttctcgcttctgtaatatgcttccccctgcacagatctacccgggctccacaaaatgctaaaagataactctttattcagctcaacgctttgatctgcctggcgtggtggctcactcttgtgatcccaggactttggacggccaagtagggtggatcgcttgtgccttggagttccagacaggcctgggcaacatggtgaaacctggtctttttgttttgtgttgttttgagacggagtttcgctcttgttgcccaggctggaatgcagtggctgggtctctgcttgccgcgacttccgcctcccgggtttcggtcgttgtcctgcatcagcctccagagtggctgggattgcaggcataagccaccaagcccggctaattttgtattttttttttatttttattttggtacagatggggtttctccctgttggtcaggctggtctcaaactcccgacctcaggtgatccacctgcctaggcctcccgaggtgctaggattgcaggcttgagccaccgctcccggcccaacttattaatcagaaaggaatagatcgtcctggtgtggtggctcacgcttgtgatcccagtacttcggatggcccagcgcggggtatcccttgagcctaggagttccagacctgcctgggcaacatggtgaaacccggtctctctctctctctctctctctttttttttttgaggcggagtttcgctcttgttgcccagggtggagtgcagtggctgggtctccgctcgcagcgacttctgcctccagggttttagtagttctcctgcctcagtctccggagtggctgggattgcaggcctgaccaacattgctctgctaatttttttttatttgtttttggtagagacggggtttctccatgctgggcaagctgatctcaaactccagacctcaggttatccgcccacctcggcctccggggatgctggaattgcaggcgtgagccagcgcacacacccaatttatttttatttcattttttatttttatatatatatacttttgagacggagtctcactttgtcacccaggctggagtgcagtggtgcgctgtctcggctcactgcaacctctgcctcccaggttcaagcgattctcctgcctcagccgcctgagtagctgagattacaggcacccgctagcacacccatctaatttttttttttttttttttgtatttttagtagagatgggttttcatcatgttggccaggctggtctcgaactccggacctcaggtaaacccacctcggcctcccaaagtgctgggatgacaggaaggatcggcctggcgtggtggctcacgcttttgatcccaggagtttggaccggccgagcgtggcggatcccttgatcctaggagttctagaccagcctgggcaacatggtgaaaaccggtctctctctctctttttttttttttgaggcgtagtttccctcttgttgcagggctggagtgcagtggtgcggtgtcggctccccgcggcctctgcctctgggtttgggtggttctcctgcctcagcctccgagtgactgggattgcaggcgggagccaccatgcccggctcttttttttttttttttttttttctggtagagacaggtctctccatgttggtcaggctggtctcaaactcccgacctcaggtgatccgcccgccacggcctcccggggtgctgggactgcaggcgtgagccaccgctcccggcccaatttattaatcagaaagaaatagatcagcctggcgtggtggctcacgctttcgatcccaggactttggacaaccgagcgtggggaattgcttgagcctaagagttccagacctgcctgggcaacatggtgaaaatctgtctcttattattattattttttttttttttgaggcggagtttccttcttgttgcccaggctggagtgcagtggctgggtctccgctcgcggcaaattctgcatcccgggttttggtggttctcctgcctcagcctcctgagtagctgggattacaggcgcctgccgccacacccggctaatttttttttttgtatttttagtagagacgggttttcatcatgttggccaggctggtctcaaattcctgacctccggtgatccacccacctccgcctccccaagtgctgggatgacaggcgtgatcggcctggcgtggtggttcacgcttttgattccaggactttggactggccaagcgtgggggattgcttgagcctaggagttccagaccggcctgggcaacatggttaaacccagtctttttttaaattcctttattattattattattattatttttttgagacggagtctctctgtcgcccaggctggagtgcagtggcgctatctcggctcactgcagcctctgcctcccagggtcaagggattctcctgcctcagcctcctgagtagctgggattacaggcgcccaccaccactcccggctaatttttttttattttttagtagatcgtggtaactgccttaaaatgatgattgttcagaaagtcagtttaatttagatactaaggatattgaggttatgtaacatttgagcaagttctaaaaaaaaagagaaatagtatatttaattgctaataaagtattgtcaactcacaaatatattcacatagcatacatttcaagagcagaataaccatgaatataaaaggaattagcaaaaacgaaacaaaaaagacatgaagaaataaaaacagatggaacaaatagcacaaaatacgatgaaagttataaaagaaactatgccaacaatcacaataaatgtaaatagactgaataattaagagaaaatgactataaaacagaattagggcacgcgtggtggctcatgcctgtaatcccagcactttgggaggatgaggcaggcggagggatcacaaggtcaggagttcgagagcagcctgaccaacatggtgaaaccccatctctgctaatacaaaaattagccggcgtggtggtgaacatctgtaatcccagttactcaggaggctgaggcaggagaatcgcttgaatccaggaggcagaggttgcagtgccgagatcacaccattacactccagcctgggcaacagagcaagactccgtatcaaaaaaaaaaaacacacaaaaaaacacaaaaaacagaaaataaacagtatgaaaagacatctaaaacataaagtcacagaaagactgagagagattgaaaaaagatacacctgtcatatgtacctaacccaaagaagggttggaagctatattattatcagataaaataggctttgggcaaaaagcaatatgggagattttttaaggccacaatataatgataaaaattctaataaaccaagggagaaggtaatctaaaatgttaatgtatctaataactagcactcaaaatacatgaaagcaaaatatgacaaaattgcaaccctcagagggcaatttaaatacatatctcagtgtctgataaaagagacaaaaaacaatcagcatagacatagaagatttacatctctctagaaaattaacaagcttgacttaatgtacagaaaaaacatatctctccaaagtgacagcattcacccccccaagtacatatgtactgagccataaggaaaatctcaacaaattccaaagaagcggaatcatgcacccatctttctctctaaccataatctcattaaactaaaaacaataataaaaagataaagtaaaaagccagaaaggcagatgctaaatgagaaagtgacagaaaagttacagattttgttaagcatacaaagcttctatggggtaaagcagtcaaagggatatgcaaatttacacagaaatccaactgatataaatccttgaaagatactacatacagatatttcatcagttctcacatgccaaacccagcaaagccaaactttggagcctcccctgcgagcagacctgccacaggaggagaggcagcacaaacctccctttgcagtgaaaatgccacattgtgtgtgcttcttaccccatcacctctttggaagtggccccactcagcgctagctgagaatcgcttccctcataccactctcagtagttcaccccaagacacacgggacaactctgtacctggtaagtcattgtgaatccaattaataatggcattcagaaagttaggaatctttgaattattagattcatagtgatattcaaaagaaagaaaacgacatcatttctgttccacgcatgttgcccacattcactgcgtaaaaggcaaagggaactgtgagtacccacaaagaacctgatattgacggcacatacatttcttcattaggaagaataaatttagactgtaacaatttaaaaaaccagaaaatacaactgtacattttagttcttattaaaatccaagaggtttaacttatttgctccttgtttaggtaattagtgtctaaaacatttcaaagataacatatatagtggctatgatttctagtactttttaaaaattcaagcccagtctcttctaattaaatgtataaatgatttatctctgtctttcttaaaaagaaccaagagccccaattaaaaagtaaaacttaaatttcctcttaaaaaattgttacgtcaaaattatctaataaaccatagttcagaaaataatttctgaattaagaaaatatgaataataaaaccaacagtttatgtgctgaatttcacatttttattttttattatttttaaaattttgttttaagttctagggtacatgtgcaggagtgttacgtagggaaacgtgtgccatggtggtttggtccacctatcaactcatcacctcagtgttaagcccagcacgcattagctatttttcctgatgctcctcccccacccgccctgacaggccccagtatgtgttgtttcccttcctgtgtccatgtgttctcactgaacctcacatttttaaatacagcatatgccaggtgtcatttcagtacccataattatacatagtatatgtatatgtgtaaatatatgtatatgtgtacatatatgtatgtaatatgtgtatgtaaatattatgtaaatatgtatgtatgtaaatatatatgtaaatatgtatgtgaatgtatgtaaatatatacacatgtaaatatgtatgtaaaaatatgtacgtaaatatatgtatgtaaatatatgtatatataaatgtaaaatatgtaaatatttgtaaatgtaaaatatgtaaatgtaaaataaatgtagaatgtcaaatgtaaatgtaaaatgtaaaataaatgtaaaatgtaaatgtaaaatatgtaaatatatgtatatgtgtaaatatatatgtatatgtgtaaatatatatgtgtaaatatatatgtatatgtgtaatatatatgtatatgtgtaaatatatatgtatatataacacagcatacagcatatgccaggtgtcatttcagtacccataattatacatagtataattatacatagtataattagactactatgttagctaaaaaatgttgattagatacaaatgtataaatttatcttctctaaacgtggaaattctctagaggctatttccagcttctgtgtggattgtagagcaggctgctacctgtaccccaaaaatgaacaccttaaaaaaaagacaagtttctcagcctccctattgcacacacatatgaaaaatatgttaaattcaacgccaaatattcctgagatcaacacagcagtgatcccaaagagaaaatttctctttgctaatgggcacaaacttgaagggcaaagcagtggaagggtaagtctgcagactcgggtggggctcaagtcagaatcacgtggaagatcattgccacatgtttttgtttttttaaatagcaaacaccaccaagtggagcccgccgggtttagtagatattaaacctctaaggagtggcacatccgagactgaaattcccatcttttgattcccagctcaaggtctctgaaatgccagcaccagctgtgaaattgttcttctgcattttcatggagaccttttcttctatactgccatactcttttttttggaacagttatacctgatcttcctatttttgtgtgtgttccaccgaaagtttttcactctaaatacttccctctttccaactgagcatttacatctgtaacaaggacaaaaacatctaacatctctctcacccttggtttgtgttttgttttgtttgtttttgagacagggtcttgctctgtcacccaggctggagtgcagtggcgtgatcaccgttcactgcagcctcgagctcctgagctgaagcaattttcccacctcaacctctgagtagctgagactataggtgtgtgccaccacgcctggctaatatgtgtattttttgtagagatgagtttttgccatgttgcccaggctggtattgaactcctggcttaagtgatcctcctgcctaggcttcccaaagtgctggaaggaattacaggtatgagccaccgtgcctggcctcaccattgttaaaattatggaaatcgtgtttgcaaagcaggttggcctgtttggaaaagggtgtcataatttctcaggtaactccaaaaagagaaagctacgaaaattaccttaatacattcattacagtctcagtataagattatagcttcctctcccaaagcgtaaccacaacctgacgcaggatgagttggtttgaaaataccgcatacaatatcctcttgagtagaatcataatttagaactctaaaaatgaccggaaacaaaactgtccaagtttgtttaacgtaatgtgtttcaacttatttgactagaaaacccttcattcgtgcaacacttataaatatcccatggcaaatctagttttctatgaataatgaacgaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatagcccatgtctggccaggctccatggctcaatcacacctgtaatcccagcaatttcagaagctgaggcgggaggatcactggcctttagtgatccttgaatgaaactccatctctaaaaaattaaaaatattagcttagagaatcatttgggcccaggagtttgaggctgtattgaactatgactatgctactgcattccagcctgggcaacaggctgcttaaacctggaggggcagagcttgcagtgagccgagatcacgccactgcactccagcctgggcaaaggagccagactccgtggcaaaaaaaaaaaaaaaaaagagattctattgacaatagcaacaaaaccctgagaatatatctagcaaagtatacacaggcctttcatgaagagtattgccatagcctgaatgtgtctcccaaaattcatgtattaaaacttaattcccaagatgatagtactaagaagtggggcctttaagaagtgattaagacataagggtgagccctcatgcatgagattagtgccttccttataaaagggcttgtgggtggtggtaaatctgtcccttctgcctcatgagaacatagcatttgcctgctccagaggaagcagcattcaacgtaccatcttggaagcagagaccaggccctcactagacactgtgtctgctggagtcttgatcttgttcttcccaacctccagaactgagaaaataaacttctgctctgtgtaaattacccagtctcaggtgttttgttatggcactatgaagggactaagacaaatataaaaattacccagggacttaaagggagaactgactaaactgaaatatatgccatatatattatgaatcgtaggactcaatgctataaacatactacttctcaacaaattaatctataaattcaagaaattcctacacaaatcccaatagaatttttttgtggaactcgagaggctgatcctaaaattcatacagtcacttgaggggccaagaatagtgtaacagggctggcggggctggtggctcacacctgtagtcccagtactttgggaagtcaagactggaggatggtttgaacccaggagttcaagaccagcctaggcaacatagcaagatgttgtctcaaaatattaaaaataaataaataaataaataaaaagaaggttaagtatgcacattttgttgtgaatttcaattttatagtgatttttttttttttgagacagggtcttgctctgtcacccaggctggagtgcagtggtgccatcttggttcactgcaacctctgcgtgggctcaagcaatcctcccgcctcactctctggagtagctgggaccacagttatgtgccaccacacctgactaatttttatatattttttttgtagagacggggtttttccatgttgcccaggttgttctcaaactcatccacctgccttggcctccgcaagtgagatcacagacatgggccactgtgcccggtctagtgcgcttttttttttttttttttaaccaaacaaacgatgaagtctcaggagtaaaagttgatacacaagtaaattttattggtaatgtttttgtgtggtctttaagcagagggaaaattagtctgcattatggtgtatccagactaaataactgatattaaaatgaaattatccttaggatttgcaatcttagagaaaactttttcattttttttgagttacaaattatcttcacttacatttgagaacagtgagtcacagagggattaagtatcttactcaagatcttgcaagtgtttggtttgaacccaatcttttcactctgcagaactcagagtcactcttatttggaaactttttaactgatgtggatcctctaatatgggcttcctattattcattccgtattagtcagaagttttgcaagcaggcagaattcattttgccaattacgggattttccctcagttgcagtcaaggttcataaaactataactataaattttgtttttgagacaaagtcttgctctgttgctcagactgggatccagtggcacagtaacagcccattgcagctttgaactcctgggctcaagggatcctccgcctcagcctcccaagtatctgggactacaagtgcatgccatcatccctggctaattttgtttaaaaaaaaaaattgtagagatagggtcttgcttcgttgcccaggctggtctcaaactcctggcctcaagcaagccttcagccttggtctcccaaagtgctgagattacaggtgtcagccattgcacctggccaaaactgtaactatatatacacacacacataactacatatagatgtgtgtgtgtatgtatgtgtgtgtgtatatatatttttatatataaatagatatatctgaaaggcatcaaaagaaaaaagctgtaacttttagtcttgatcttgatagtgacttgattaggctatctgtttaacatcaaagatgcaaattaatgctttctttgggtgagcatattaaaaatgcagaaaatattggagtagttttttatgttaaataaattgtattctgtgtatttaaggtatacaacatgattttgtgggatgcatatagatggttaaaaaaattactacagtgaagcaaattaacgtatccttcaactcagatagttacccgttttctttttgtttggtggcaagaggagcttaaaatctcatttagcgtgaatcccaatacagcacaattttattacctatatttctcgcgttgtacattatatttctaggcttgttcatcctacatatctgctactgtgtaacctctgagctatgtccacccattttctctcttgccccccaagtaatttcctaaagtgtctcatataaaaaggcagtagctttcagcttaaactttttctctgtatatatttaagtcaatttctttgaggtatgtttttctctccagaatagttagatgtaggcataccactttaatgttgacactagttcacctagaacttatcttctgcaaatctgtctctatgtccatctctgtctccatctttgtctctatctttatctctgtctatctatctatccatccatccatccatccatccatctatctatctatccatctatctgtctatctaactaaagcaaattcatgcccttctcctatttatggaatcgagaccataaacagaagtgagggaaagaatttggcaggaattgcgatgtgtattacctgtggcataaggaaactttacagaactagggtcaaaagtatactttctagttctttcccatggcttttcactttgatgtagtccttatcaggcaactgaggttttatataagtcccctgattcttagaacatgaaggtgtagtattcaagtttggtcccttgaaagcacaatttttgttaaaaaaatttaagaaaattgtatgatttcctcagcaaatacatattgatcatctgttatacagccatgagaagtggttctgttgaacacgtttattttatcagatcccaattctaaaccaggcatagaatggaaaccatgaaggtaggatgaaataacttctgaatgtttgaaaatagtgtacttaaaaataaatatcaggtgtttttgttttgttttttgttttttgtttttgagacagggtctcactctgtcacccaggctggagtgtgatggtgccatctcacctcattgcagccttgacctcccaggctcgggtgatctcccacctcagcctcccaagtagctgggactacaggcacatgccaccatgcccagctaattttttgtattttttgtagagacagggtttcaccatgttgcccaggctggtctagaactcctgggcttaagcgatcttcccacctcagcctcccaaagtgccaggattacaggcatgagccaccatgcctggctgaaaataccaggtttttaagtatcagcactgcctcttcaatcttttctattactatgttgtgctcagtggtattttttattgaattagagcagtgctgttcaatggaaccttctttgaggatggaaatcttttatgtctctgctgtgtgggtatggtattagctgggtatggggcacctgcctatagtcccagctactcaagaggctgaggtgggaggatcacttgagcccaggaggccgagtctgcaggttcgtaccactgcaattcagcctgtgtgacagaatgagactcagtcgcagaataaaatgaaataaggaaataaaaatgtaattgttgaaataagaaactagtggatggattagacacgagaagaaagaattaattgtttaggcgattctctccaaaaagtaagtcagcatgtcacacagagagacatgaggatagatgatagggcagaagttggtgggcttggaggggagaggaagatcagaatgaggtccaaaatgtgtcttagtgaaatcccaggaggagatattaaaattatattagaaagtgaaagaaatagaagttttatttatttatttatttatttattttgagaaggagtctcgctctgtagcccaggctcgagtgcagtggcacgatctgagctcactgcaagctccacctcctgggttcacgccattctcctgcctcagcttcccaagtagctgggactacaggcacccaccaccacgcctggctagttttttgtatttttagtagagatgtggtttcacctttttagtcaggatggtctcaatctcctgacctcatgatccaccagcctcaggctcctaaagtgctggaattatacgcataagccactgcacccggcccaaaagctttgtgtttttacaaatattacacatgtttcttgtttaagaaaaaaagtcttcacaataacgtaggagaataagagaaacatttttccaaaaaagagaagtcattgtgattattttatcttattggaatgttggataatacagtctgcttcagtaatcatcaagcatgctatggattttccattttcataggatctgtatctcggttaaggtaatactggtaatttttgtactctatgaaaaatataggccaaaatcatagaccttgcatagaagctggatcatgaagacagctctggaggaacacacaggtacacacacacagacacacatatatataaagtatacacatatatattttttaaaagcttttaaagcaaaagccggccctgcccctctcccagagttggcggcctctcccctctcttagagtgggtggggacagtggttgcatgggcagctttccttgtgagccaaaggtccctctggacacatgatgcctggccacgccccctttccctttcatctttctcattaaccaatgggcttggagcattaaggccacgcccctattctgccttctactgcatccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccactcccgaggttcaccggactggggcccccacaccagtgcctctgggctacccccaccaaagttttgccagtcagccccaccccttcagcaagcagcccagtctctgccctcaccaatcaccccagggtgactttgggcaggtgaatcctggggctccccgctcctttactgggccctcatctcctgccaccccaagcttgacctcccagggctttttgggctcacatctccaaggacctgggtcccacagccccagaccccaccctcaccagtcatccctgggtgactttaggctggtgaatcctggggctccctgctgctgactcttcccttccctcctgctgcctcaaggtggacctccctaggctgtgtgcactggcgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcgagactggcctttgatcttatgacccagtcccctaagcattgccaccccatttctggttcctcttgtcacagcacaaatttccagctggaaggggaatggagattgggacctaggagcaagaggtttcaggctgcctcactcccttaacacaaacattgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagtcagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaacagtataccagacttctctctgaaatgaggcttgggttgtcctctttctgataaattcccagatttaacagaaaggctgccttctgccatgaggacacattgatataagagtttgagaggtacaggtgcacttcttcacactaacagacgtgtgaggatgtatgactaaaccacatggcatacagttcctgcctacttaatgtttacttttctagctctgcctctggttttggtccctggcagctgatgattcttggtaaaaccccagagtttggagtcagaagactgagtttcaaagttcatctgtcgcctttttcttttcttctttttttttctagccatgatatcaatctctttgagtcactaaatgattgtgacaacaccttgtacagttgttggtatcattaaatcagatggtgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagattgtggatggactgttgggtacctgtgaagaattctgggtttgaatcctgcctctttgtctgctagggatatgaattagggcaagttgctagacctcatcgggcctctcttttcacatctgtataatagaggtggtattgtttcacttccatttgtgaagtttaaatgagatttgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccgcagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcaggccagccctccaacctcctcctccaggtgggacggggtgcccctctgccagctgagacagtccacacacaccccagccctaatgattgttctctctacctctccccccactcctcctccacctcctcctctctgcatgcgcctcagagcccgtgccaagaactagcagtagtcccagactcgaggtccgtaaaagtcagtcaactgaagaacaccatcaaatctttggtaagagtccactggggtcccctgattccacgctgccaatcctgggctctagtttccccttggggccctgaagaaaggggacggcggcccctggtgccaagggcgaatagggagctggggcgcccaggcctcacctggagggaccccggagcatgcagcatggctctttttttgctgccctgtttgctgactctcccctctccagatgcccctgctcgagtccttgctacacacgccctgggattgttgcctcttggggaagtgctagcctgactggttgtcagggtccctgtatttctgccatgactcagtccctaatttgctctttgattctggacaagccacctctcctttttgggctcatgtttccatgaagtagtgagtatcaaaggtctctgttagctctcgagtctgagatttaaaggcctcctagaatggaaacctcagggccaaaggctcctgtctgtccttttccaccctaaatcttctgtgaagaaccgtacttggcccatacgtgctcagtaaatgtttattgaatgaatgcacttttctaaatcacaagctggcagaagggggggcctttctcaaactccatctctagaggtttatattgctgtcctctcaagagattccagattcagaccttcagttctgtggctgtgggcaaaagccaacaaagacccaaatcctctgtccttgggagcttgaggagagtttaccagttcgagttcccactgggtctgagaactttgcctttaaaatccattcctggtccctgcctaccacttcctgctctggggaatagagttgagggggccaccctccatcaccttaatgtgactctccccacagaaacaacagaagaaacaagtggtacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacggtgtgcagttttctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctggcactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccccgtcccctgggagcctggctttgcagacagaggagtgagcctaaaggtcccttctgcaggatggagtgtcctgcccagaaggcagcatggccatttctcactgcttttttgtatggttgttagcggcagcttgggactgagtcagctgctgtgggtgagttggggggcactctggggacaaagcacaggacgtagagcttggaggccaagtgcctgccatgcctttacctggctgtggtcttggccaagtcctcagtgggtattgggtacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtctgggactatttgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtggttgtgaggattaaatgggattgctagcatggtatctggtgaagcactccataaaagttcaaacagtggtaataataacagtaataacaacagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctccccagattgaaacttctcactcttcagcagttctccagccgcagtaaagcacgtacggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtagagccagaggtggtcatgggactgggctttgtggaggtgggggcagagagggagagggcagcctgtccagcctccagcccctctctccagggccctttccccctgtgctttgggcaggtttgctcgttgaagaaggagaagaagcatgataaatatcgggtagagacgctggagaggagcttgtccaaactcaaaaaccagatgggtaagatggggctggcgtgacctggcagcaggactggcatcagagggctgtgagggtggcttggagtgccccagcgaggtgggtggatggaagggctttgaggcagagggaaagaggtctgtgccaggagacggcaagtcttgtcatctcaatgagcctcagtgtccccatcagcaaagagggcccgttgtcagccacccgcagtgctctttctctgaaagtgctttggaagactggctaccatctgggtgcgaggaatcattagcagtgaggccaagtttgaggagccggagaggagctgtgcgccaagaggagggttttttcttttcttttcttttcttttcttttcttttctttttttttttttggaatccagaggctcttattgtctgcttcctttctcagctgaacctctgcccccggagcccccagcagtgccctctgaggcggagctgcagcacctgaggaaggaactagagagagtggcaggagcgctccaggcccaggtggagtacaatcagcgcataagtctcctgaatgaggggcaaaaggagaggcttcgggagcagcaggagaggcttccagagcaggaggagaggcttcagcagctggccgagccacagaacagcttcaaggagctggtgcgttgccccagctggggagcctgccctcctccctagccctccaggcctttgtttccccacctataaaatggggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggtgggcaccagcctctggggaggggaggtgccaggccagcggtagctccagcccaggggcaggtgaccccagcaccctccagggcagtcctgtggctgtttcttgcttcctgccctctgattttagaggtgggtagccctgggctcctcccaggtctggacatcatcattccagctagagacatggagcccccccaatcacaggggaagagacagagtggtataacagtcttcttatgccagatgcggtggcttacgcctatagtgccaacactttgggaggctgaggcaggagaatcacttgaggtttggagtttgagatcagcctggccgacatggtaaaacctcatctctactaaaattacaaaaacaaaaaacaaaaaaagaaagaaaaattagtggggcatggtggtggcgcatgcctgtaatcccacctactcaggaggctgaggcacgagaattgcttgagcccaggaggtggaggttgcagtgagctgagattgcaccactgcactccggcctgggccacagagtgacactctgtctcaaaacaaaacaaaaagactccttagattaaaactggattccagcctcagttccactggtcaccattcaagtacttcgcatctctaagtctctgtttctttaacttcaaaaggaagttagcattttccttacagaggtgctgaggattaaatgagataatacatgggaagcattaggcctgtagcacatttagcagatggtggttggctcccactacttttctaccattctgtggcctacagttgaaatggtgggaagaggacatgagatttgaggctggggaaggaggcatggggttctaggaaagcaaggcagtcacttaggcctgaagtaaggggccaggggcctgggcaggcgacagagccccacagtgccctcgctaccctattaatgggcccagaatctgcaaaccagccaccatgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtggctgcagcagacccagctaatgaaccagttgcagcagcaggaagcttggggcaaagcggtggccgagatggcctgccaaaagttgcaggaggcccaggggagggagctgccgaggatggggccgtgagggggacgacctggcaaactctgtgccttctcactctttcctggccccttaggagcgtctggaagctgccagccagcagaaacagcagctaacggcccagttgagcctcatggctctccctggggaaggtacgggagaccgctcagaggaagaggagagagccccaggaggaaggggggactgctagcagcataggattgaggagttggaagagacctttagaacagctggtcattatactaaccgggtgcctgcactaagttcagcatcaatatggtgacctcctgggagcggggggccaccaagttgcctaaggatggctgaactggccgaggtcagaaagggagcaggtcagaactcccgcaccgaccagtagtgggaatgtgcctgggcagtatagcaagatcttggttcttcaaagtaaaaataaataacagcagctcattcctctctggggaggggctggctcagggttacacaatgagggtggaggtagaggtgggcccacaatacttcccttgttgagttgtctgaggacccctctggccaccacccccacccccaggagatggaggaggacatctggacagtgagggggaggaggcacctcggcccattcctagcatcccacaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtgaccaacatgtgcagtctctggggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtggctgccagcgcctggctcacctggtggcctcggcccagaaggagccagaggcagccagaggccctggagccccagggcctgggggcgagtctgtgagtggggagacccactgggccctgcaggaagtcacggagaagctggcccatgccaggactcacctccaccttctccatgacttgaaaatgccacctgagggcaggtcgctgccgagatgtgactacaatattttggctccagagcagctttatggaccacctggaggagaaggcagacctgagtgagctggtgaagaaacaagaacttcgcttcattcaatactggcaagagagatgccatcagtgagtgggaggccagggcacagcagggggagctacagggccgtcggaggggccccagcgtctgagccctgtcctcccgcaggaaaatccatcaccttttatcagaaccagggggccgtgccaaagatgcggcactgggaggaggacaccatcaggctggagctcagggaggagatgaaggtagggtgtgcaacatctctgtgggggtgggggtgggggtgggtgtgagggtgggcgcaggcagcggcatggcagctgagcacccctccctccagatgaagctgctggagctgcagcagatggtattgcggcttacagcaactacaacaatgggcacagaaaattcctggccgctgcccacaaccctgctgatgagcccggtccaggagccccagccccccaggagcttggggctgcagacaagcatggtggtgagtagagccctcaggtggggtgggcaggcaggaagagggggctcccactgtgctcagatccctgcctccctctctccaaagatctttgtgaggtgagcctcacctcctctgcccaaggagaggccagggaggatcctctccttgacaagcctactgcacagccgatcgtgcaggaccaccaggagcacccaggcttgggcaacaactgctgtgtgccattcttttgctgggcttggctgccaagaagaaggagataaacatcaccatcatcaaagagctgctcaagaaatttttaaataagaaaccaagttatggggttaatctcctacacaattcatttacttcctttgaatgttagagtcactcatgattatttgtgtttctaatttatagttttaagtttatttgtaaaaagttaaaagagagtgggtgtctgtggctctcactgatgttcactctggcatcctttagcatttttcttttttaatttcataattgtaggtcattagcatgcatatcgagtttgcccttacgtggtgggggttcaaacacacaaagacccactctttgcccaaaactgttctcgctggtttggaataggctgccatgcttttttaatgttattgcagcatgtatattcactacagaattcagacaaaatttgcctatgttctgctgttgtttgatctaatcttaatcacagtgagctcttcgttagctcaatatgtagtttgcccccaagcgtgcactgtttattactttgtaatatgccactatgagtactgacatttagagttgtttaaaggccaagaactggaaacagcctttcctccattttctgtgtattggtgatgggagtgaaaccttttgagggagctttttaaatctcacagaagaggaaagtggcctcctctggcaggtatgtccaggatagagtgtgtttcatctgttccggtgccaggaattagcagtgtattatggtggttcccttaggatttgtatgtgctctgggctcatgaagatactgcatcatgagctgcagcagttgtactctttttcaatgacctaaaaagggcttatttctgaggaatgaaaggttcccatcgttgactgtggatgtggaaaacctttcctagcttagagcatttgtatctacaatacattttaaactcagagttcatgttacctgttttaatcacatgactacatgtcccagtacacaaaagggcactggttggcattcttcttaatgtatttagtaaagatcataagaaatcctttacgagttcaaatgtccctggaacaggcatacaggctctagtcaagaatgaattagagtgaaggaaagctgtgtgacacctggcattcctctctgttcacggagattctttgaggcttgaagattgattttaccatctagacctctttggctaatacctattcttcaaccaccttggttactctgacataggaatttacttctttttccttgaatggaaaacactttaaaaaataatagaaacattattataaactaatatatgtgagatacttagttgaaacaaaagggagttttagtagacggtattatactatctttgaaaatcaaggagaagtttatgaaacttaaaatgtgtacaaactgcagtgcaatctactgttcgtgaatgtcaatgtattatcaggaaacgtgcctatacaatcacagagttatattttctcacagacttctttacaaagtgaaatatgtttttgtatctctgggtttctgttcgggacatattttgtgcaatatttatgtgattgtgcctatgcatgatgaatgaatgcatttcagttatgtattgcctaaatcgtaacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttcaactgactcttccaaattttatgaatgtatcaatgtattagataaacccagtttcagaatgataaagaaaaaatgttagaccaaataatgcggctaattaacagtggtacgatttctagcccgtgggtttaaaatgcacttaaagtcctgttctcgccttttattttctgaacttgccgcttttgcattctttgagttcagtttaaagacggttactttaagagcattttaaaccctcgggctagaaatcggaccactgttaatcagccacattatttggtctaacgttttttcttttatcattctgaaactgggtttatctaatacattgataaattatttcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtcatatatttaagaaaaagctaaaaggaatggaaattgtatgacaataacttaagtctttctccaaagtgcatgcagtcttttgcgatacctcattcagccgagtatttgtgctcttcctcattcggtataaggcagctttcagtttgcttagaaggcaacattggaatgttagagttcatcagaaacatagaattttaaaatgtgagttccactgaatacattttaatttctgtaggaagaatcaaaacacctatttaaagatggcaatatataataatcattttaaaagtatttgattaaacctgataattttccagaaatgaaaaaaaaatcagctctaaaacgaaagctgattttagaaaatttgaaaatgtaaatcagccctatccataatatagtttctctaaaactttatcttagagtcattttaaaataatataactattaaaaatgtaactgctatcttaatgttctgaaataagttaaaacattttaaaatatgaatactatagtataaaagaaagaaacagtgggaaggaaaagcagagaaagaaatgccaattccagtccaaagctttatttgccaagttttgttagaatgaattttaccagtttgtgaattcttgtaaacagaatgtgtaatggaaatactgaaagatttttccctagagtggccttattgactgctggtgtgatgccactgtaatgtaataaatcattaaattgtttctaagtgttgtttttgccttaaaattttattttgtgtttcttgaaaactatagtattaaaggtattgatactgtgcaaatgctgggcatgcttgacatgagataatgtgtttcatttttacaaaattgtaatacaactatgcaagtgtttattaaaaacacaaaataaaaaagttatgggtttttttattaaaaaacttttattaaagttttataaaaagttattttattaaataactttttattaaaaatggttatggggtgaaaaagttatgggataaaaaatgtaaaaaagttgtggcaaaaaaacttctgggaaaaaagtagaaaaaagttttatgaaaagttacaaaaaaagttatgaaaaagaagttatgggatttttttaaaaagtcatggaataaaaataaaaattaaaagcaggcccctgtcagcaaagcctggagaagtggggccggagtctccaccgccaccatgtccctaccacctcttcccaggcacccctttacaattagggtagcaggacaagacctctgtctaatggggaaagacaaacagaccatttgccaccttgaccagggctgagtccctaaatttctggatgatgatgattgttacttaaaagccagaggctggtggagttggtttgtttggaggaggcctgatggtccccttactctcaccatggcaacgtttccctcaggggggctcccatcttcttattcagagaggtagctgaggccagaaagcggggctaactgtggaccagcgagggcatgggctgctggggtggcccaccttccccggtgtacatactgtgtctgtgtaacattttgtatattccagagggtagggctgcccctgtatcatacctagcagaggttggagctggcacatggggaggaggttctaataattatttgtggctgggaaacttatttattgctagcgcaggacagaggaaagaggcggggatggggtcgtggctctctggtggtatgatcacagcttactgcaacctccaactctcaggctcaagtgatcctcccacctcagcctcccaggtaactgggagtataagcatgcactactatgcctggctaatttttaaatttttttgtagagaaaaggtcttactatgttgccaatgctggtcttgaactcctggcctcaagcaattctcccatcttggcctcccaaagcactgggattacaggcatgagacattgcccctgtccattaggttttctctttattactgttttgttgttgtggttgttgttttgttttattttgttttgtttttttgacagagtcttggtctgttgcccaggctggagtgccgtggtgtgatctcggctcactgcaacttctgcctcctggttcaagcaattctcatgcctcagtctctcgagtgcctggggttacaggcatgagccactgcgcccctggctaatttttgaatttttagttgagacagagttttgccgtgttggccagattggtcttgaactcctgcctcaaacaatccgccctcctcagcctcccaaagtgctgggattacaggggtgagccactgctcctggctaagatcccatctctatttaaataaaaaaagaaaattcagagcatgtggaatacagaacaccaaagtccaaagttatttacctctctgaggtaatctgtgtaaacaatttgaaatatatcttttcaagttcatacttgctatgcatatacatacatatacacacatacgttgacatagttccccttccctgctgtcatgctattagagtcttctttttttggtagaaattggaccaactctatgttctttgctggcccatatttctcctattcagtgatgtgttacgaatgtgtgtttaagtcaatgtatgcaactcttcaatatcattttaaaaggttaaatatacaatcatatgaaggcattacaatttattccaacagttccattttgcacatttaataatttccgttggtttgccagggagaacattctcatgccatggctaaatccttttgtacggccatccttaattattccctgaagataaacttttaaataaagttgctagatgagtctcatttcttaaaaagttcttttttggtagtttatatgtaacactgtagttttatatgtacttgcaaatagctatagtgccagtaaaaaatgtgataaaattaaactctttcacgtatgccaaaaatattttgatttagtgcttcattaagtgcatgattacagtccctgtatcttttgatttacctttctacatttacaattttcagcccagatacttagaggtcacatagtaaattaaggttttcttttttttaataatctccgtctttctaaatttggtgagtcacagtaagttatttttgggttgttgaaagctgtggctctgttctaaatatgagcccagaaatcatgccacttacaaaatatgctttgtcttccaacaacagagagtctggtagaaggtgactgttcttggaacttaaaaagtctcaacaggacaagaacagaatctggaaaatatttctgtttctgataatacggctgagtaggtagacatgctggatactccttgcaaaggcatacttgaaattgccacaccaaaaaaaatccagaatctctaagactgaagatgaagtgaaaatcagaagggctactacaagaataatggggaagcagccccagttatcaagtgacgtgtgcatgtgttcaataaaaagttccaaacctaaaataagttgagaaaaataatgtaattgccctacatatacacatcatcaacaatttttcattcatggtatggacagttttttggtttttgtttttttgtttttttttttttaaaaggtgggattttgctgtggttgcccaggctggagtgcagtggcatgatcttgcctcactgcaacttccgcctcccaggttcaagcgactctcctgcctcagcctcccaagtagctcagattacaggcacccagcaccacatccggctaactgttgtatttttagtagagatggtgtttcaccacgttggtcaggctggtcttgaactcctgacctcaggtgatccacctgccttggtctcccatagtgctgggattacaggtgtaagccaccacacctggccacagccagttttgtttgatttatattcccacttcatttgtatacattccttcttcctcttattttgaagtaaaacctatacatcatatcattttttaattaccttatatgtatctgtagaagacaaggaatttttaaaaacaaatatattcacaatgccattaaataccaaaaaaattaatattctgaaaatagccacaaatccagagttcacattttcttgactttctcataagtgattttttctaggttatctaattcaatcaggtaactgtttgctcatatttacattcccacttgaaaaatgtctaaacttaaactgacataaaacgcagatgatcttccgaccaaatgcttagtgtaaaaaaaaaaacttccaactccaagaggagtccctccaaatacagaaaggaccagtattttaagaggtatgttaactaaaatgtggcaatttaaggagcagagcaggaagaacctttaagtccgaaacttacaacaagtcaatttcatagtccgtttccctggtccttccacagcaacctctggcatctgttttctctacaacggaggtaaaaatagtagctgtttcattagagcagtgctagaagagggtggtggctatataaagtttagctatttgtatattgtaacaaaccaactttttttttgttttggtcaataatagacttcttttggaaaagtagcagcctcctgtctggggacacctgcagttccactaagagaacattggtgtctgctaacctttgcctctatttctctcaataatatactgtcaagctgttccttgatttagcaattttatgtacttccttttcctttcttttttcttttcccttttcctgagacagagtcccactttgtcacccagtctggactgcagcagcgccatgatggctcactgccacctccccccgggctcaagcaatcctcctgcatcagttttcagagcagctgggattacccgcggggcccaccaggcccagctaatctttgtgggttttgttgtgtttttccgttaagagactgggtttccggccaggcgcagtgactcacgcctgcaatcccaaaacaccgggaggccgaggcccgcggatcaccggaggtgaggagctggagaccagcccgaccaacatggagaaaccccgtctctaccaaaataaataaataaaaaagtagctgggcatggtggctcacgcctgcaatcccagccactcaggagggtgaagcaggagaatcacccaaacctgggaggcggaggcccggggagccgagaccacgccactgtactccagcctggacaacaagagggaaactctgcctcaaaaaacaaaaaacaaaaaacaggtttcaccatgttgcccaggctggtctggatctcctaggatcaagcgattcgcagcactcagccgtccaaagtcctgggatcacaagcgtgagccatgacgccaggccgatctattcctgtctgattaaaaattgggccgggcgcggtggctcacgcctgcgatcccagcaccccgggaggccgaggcgggcggaaagcctgaggtcagattgaggccagcctgagcaacatggagaaaaccccatctctaccaaaaaaaaacaaaatacaaaagtagccgggcctggtggctcacgcctgcaatcccagccactcaggaggctgaggcagaagaaccacccaaacccgtgtggtcgaggctgcggggggccgagatcctgccactgcactccagcctgggcaacaagagtgaaactccctctcagaaaaaaaaaaaaaaagaggtagagagactgagtttcaccatgttgcccaggccggcgtgtaactcctaggctcaagcgatccgccgcgctcggccatccgaagtcctgggatcacaagcgtgagccgccacgccaggccaatctcttcttttctgattaataaattgggcctggcgcggtgactcactcctgcaatcccagcaccccgggaggccgaggcgagcggatcacctgaggtcgggagtttgagaccagcctgaccaacatggagaaaactgtctctaccgaaaaagaaaaaaaataaaaagctgggcatggtggctcatgcctgcaatgccagcaccccgggaggccgaggcgggcgggtaacctgaggtcaggagtttgagactaccctgacgaagggagaaaccccccgtctgtagcaaaaaaaaaaaaaaaaagtacaaaattagccaggtatggtggctcatgcctgcaatctcagccactcgggaggctgaggcaggggagtcacccaaacccgggaggcggaggccgcagggagctgagaccgcgccactgcactccagcctgggcaacaagagtgaaacttcacctcaaacaaacaaacaaaaacaaaacaaaaaagcgagaccgggtttcatcatgtggcccaggcctgtctggaactcctaggctcaagcgatcccccgcgctattcctttgtgattaataaattaggccttgcgcgctggctcaagcctgcaatcccagcacctccagacgccgaggcgggcagataatctgagctcgggagtttgacaccagccttatgaacatggagaaaccccatctccaacaacaaaaacaaacaaaaaacaaaatgagctgggcatggtggctcacgcgtgcaatcccagccactcgggaggctgtgacaggagaaccacccaaacccgggaggcggaggcccgttgagccaagacctcaccactgcactccagcctgggcaacaagagtgaaactccgcctcaaaaaaaaaaaaaaaaaaaagagagaccgagtttcaccatgttgcccaggcctgtctggatctcctaggctcaaatgatccccagtgctctgccatccaaagtccctgaatcacaagcatgagccatcatgccaggccgatctgttcctctctgattaataaattaggcggggcgcgctggctcacacctgcaatcctgtagcggaatttttaaggaattagatagactcacggggtttaggaggacatttattaattatttaggtgcaccggcccagtcggattaacatttaaaggattgagtactgaaccaagagttacctttcaagcattatgtagggcgaagggggagatctgtgcagggagaagcatattatagaagcgagaaacaaagatagttatttaattgaaacatgcatttttttttttactatttaaggaaaaatatgttttgtgacttgagtttatttgtttaggcacctagatttattttgtttatggagataatagtaggtacctcataggggattattagatcacgcttaaaattggaccatacttaatactttaactggggctttaaccatcatcatttacatcatccatatcccattatctttccttttggcagaaaggcatatagtgaaatctatgcaaattaaatgaacatatgggaaactcttttttgcagaaggtgttgtggggctccctctacatgacctgaaaagtacctatatggctgtaagacactttacatatcacctagtttataccctggcatgcccatatgacctactaaatcatacaaacacaccaggttctaatatacagtaatattcattttttaacttttcaattaacatataatcctaaattgcatgctttatgttgaagaaaaaaacagcaactaatataccatcatagtgacatattaaatgctagtttagcctgattctcccagtgtaacaatgtatttaaaattttgtagatatattcagtatatgtttcaacatgtctttgggccatatgtattttgtgctaaagtttctctttataaaaaagcaaagcaggagatgagagttttatggtgggaaatgaattcaattattatattctaagggagattaaagagaaaaataaattttcctgttaattctgtgaccaacaaaagtaagcaatatagctgagaaattcatctgagctcacagttgattatatatatataataatttttttttctctaacagagccacaaccaatgagacaattatagtttcaccaagtcaaatgtcagctagaggacttacagtttttacacttggcaaggcaaagcaaagaaatgtgaagaatcctcatttacttgttagccaaacttagtgtcaaaaaaaaaaatattcatcattggttgtcaaacacagggtagttctctgtcactggaaacttctgcagacaggataattactatgattaaatggcagtggatttaaaatatttcggtagtggttaaagtaacttgaatactgatggtataatatcaaatcaaagctgcaaaactgtccgctaattatccagagtataaagtatctgatgctgtgtaagtataacgccaaagcacattcacaggtacagaaattgatgagggcttaatcatgctttttggaaatatagtaaagaagataatgttttttctaccttaaaaaataaattttagaccatgtccttcaagctatacagtttgtattattgacaattggctctgattatataatttactctagccattgctttcaatttatttatctatatttctgattattcctctaacacaaagatactgagggctttctctgtgttaggcaacagctgcaaagctaactcttggaatacagagatgtgaaacaatgctagcatggctcagaaatagtttattgcctcatgaaatttttagcttagtcctattcccataaacatttctatgtgagtggtggggactgggggggcacctcactctcctccagggacaggccatgtcctaagcagtagtttgaaggtatcactttggagaatttaggtctggagactctgtagaaatcagtgaggtttcaaagcatcattattacattgcaaagtcacatgggcaggagtagataagaagtaatatgttgtatttcctcttttgtagtgtgagttagttgatctaaatgttcactgtgttttctctatctttgaattatgtgtaacaacgtagatagcaaagagctgtcaagaggccatgagatttcaaataaacagttaagagcatactccaggaaactgtaaaagaactaattagagtccacgtgttcagtgtcagttcaaagacacagagagataggtgctcaacagatggaatatgttagaacccgtaaaaatgaccaagatgggatggcacaaaatcagcagagctataatcaataaccaatgaattgggactctcttctgtcttttccactgtatttgggtcttcgtaggttattcaatcatgtttgaagtgatgaaaaaccattattcattctcaaggcaaaagaactagatatgcttttgggaaaaagaggataacggaaggtttttaaacttttacaatgggccattctacatgcagtgtacaaatcatctaaaattcatttttcccctagaaagacagatcttaaaccagctagaagttataaataatgtggttcatcagagctgtatactcttaaattcagattttctgagtccatcccacattatcctagttccacaagataactgcaaaaatgtctcattgccaaatacattcaacagtgaactatatagttgcctccaagaaattcattgcacattggtctgttcattgcattaagaaaccttgcagttaaaaacaaacaaaaaatgtacttagtatgttttaaaatatagcatctccaatattatttaaaacttactttccttgttgtttctctgaatatttctcaaaagaactattggaaaatattgcttaacatgattgatcttccatttgattgacctgcgtttacgcccatgcctattttgtgcaggtgatcaattcatttgtgaagagtgctttcataattatgcattgaaatgcacaaggttgtcatccctcaaaaatgctactattatcacccataattaagtctaccaaatttacactagaaaacaaacacaaagagaacagtgggtagttgttagatcatttagcaatcagaggtaaaaattagtagcagaaacaaaattattgtcatttctcaaattattttcaaagacaatgttgccttattactaatatttgattgggaacatttacaaccattaatctagaaaagaaattcttctactgcaatgcacctcctctatttacgtgtgtgaatgagtgtccattttcttaaagttccaagttacttattcattcattaggtaatcttttttcacatggaacgaaatttttgtggtaatttatgatagttgaaaaaaagatttggggtgattataaccctatttagatatttctgcctgcatctacatcatatcaaaaaaagtagggcctcctctcccttccctgaattaactattggagggggccaggcatggtagctcacaattatagtaccaccactctgggaagctgaagcaggaggatggcttgagcccaggagtttaagaccagcctgggcaatatagtgaaaccttttctctaccaaaaaaaaaaaaatttttttttaaatattagctgcacgggcctgtagtcccaggtacttaggaggctgaatcgggaggatcgcttgaaccctggagttttgactgcagtgagctatgatcccatcactgcactccaacgtgggggacacagcaagaccttgtcttaagaaaaaaaagaaagaaaaagtattggagaagtttttaatctgtagcatccttagtcttcaaatttcatacctttattaccactgtcatgtttcatgtgctcaacaaatgttaaaataatgaatctcagcatgatttctagagatcgtactgagcaggatttagaggggcaggggggtttccccacttgtattcctgtccttcatatctgtctcttctggattttttagtttattacttttcagggacaagcttttcgtttttctcctctagatcagcataatctgaaaaatattaaaattaaaataactaataatagactgcattaatagattagttccttgtacagctttcatcgttttaagtgaaaactttctataagttatttagggttttgaatttataatactgtaattaaaataagggttttttcctcccactgacagtaaagctgtcactgccacaagatttgagctaaaagaaaatcgtagattttgtacttctttgtcagcgctgccaaaaaaaaaaaaaagagagagagagagaaagagacatcttgacaacttttaattcaatcagagaacttgagtgaatcgagctttcttctgaagcaccattcatcgagcaagacccctgacggtgccaggtggaaacttaatggatcctttccacctggtttgttttcagtgtttaatcctattagtatcagcaggatgtaagtcagggtatcaggtgcagaacctgtggaatcagccaatttggcttgctcgtttactttaataaggtcccataatgagtgagagtacaaagttcaagccctgttgagggtctgcattaaactctcagaagtatttagagtgtgccaggagccgcgagggtctggttcgggtggtggcgggaactgtgttagagcgctaggtacggcgcgacaaagtctgtccaacccaaaacggtgctgaggcatggggtctgagctccggtactcagaaaagcacctcagccggtactcaacagatcctcgggggcttgggggctcagcattggcagtgagggcatgaaagatataaaagacagggcactacctgtgggtattttctgttctccaaggaggaagtagcaaaaattaggatgctggaatatcctgtgttgtagcaatcccagaacaactggtgctcagcaaataccacacaaaacaaatttttaaaaatttaatctcgccggctacagtggctcacgcctataatcccagcacttctggagggcgaggcgggcagattacctgaggtcaagagtccaagaccagcctggccaacatggcaaaaccccgtctctactaaaaatgcaaaaattagcctggcatggtggtgcacacctgtaatcccagctactcgggaggctgaggcaggagaatcacttgaaccagggaggcggaggttgcagtaagctgagatcatgccattgcactacagcctgggttacaagagcgaaactccgtctgaaaaaataaaaatgtgatctctttgtatctgttctttttcttttaatttttttcttgacccaagcatgtgaactcatagtatacattttgatatcgaagatacactaagaattaagtactagacccaatcccagataacaaaaagtgacataaatagtggaagaaaggactatttattgggtttatactattagacagcgtgctaggaacatcctttattgtcttgtctagaccttttaaacatgcagtaagatgcagatactctttcccagttgtacagaggaaactgaggcttagagttgcagacttaaaagtatctaactgacatgtgggaggatgggaaactcatccagactttagaggaaatgaaggattcattacacaggtgagtgtttcttgcagctgttctagatcagaaacaattaccaatctagactttcatgtgataaagtcattcgatagaaatccaagcgggctgggcatggtggctcacgcctgttattccaccaccttgggtcaggagttcgagaccagcctggccaacatggcgaaaccctgtctctactaaaaatacaaaaattagctgggaatggtggtgctcccagctacttgggaggctgaggcaggagactcgcttgagcccgggaggctggggttgcagtaagcccagatggcgccactgcactccagcctgggtgacagagcaagactccaagactccgtctcaagaaataaacaaagaaagagagaggagggagggagggagggaaagccaagtaaccactctccttcagggcttctagtttatgtatacactatgtactcagcaaatatttttctcttaagtgtggttgtttcgatcctattttcaggaggtgaatgtacagcgtaagtcccctccttttctgttgatatgactgtgttgattggtagtgccagccactttccatctgagcagttctaggtacatactcggttggtacgcaaaggaaaactattctgcatgccattaatgctggaataaaatgtgtttaggaagtgtggctgttttcccaggtcatgtttaattgaaggatttctgtcacatacttgttcttgttgatgtgttcctggggcctggagaaatgctgcccaccccgtcacttctctggagaatctcagggctgcatggatggtatgatgctgcccgggctgaccattctgaaaatactgctggctggtccctagcagcaggtcagcaccttggttacacggtgtttacagaggcatgcccaaaggagatacattgactattcctggttattttttgtcctgtaaatagagacattgttcaaagtcttttttcccctaacatttaaaacaacacgttaggccttttaagtgtttgccaaagaacctggagttttactggagtcttgactaacctgctgaacttttcaagctgaaaccctgagggttacagtataaaaatttagaacctacttagagcagcagtctcctcatgctgttactggtctccttaaagtcagaaacaagatctacagctgctgctgtcggtcacctgagagaccaggctgaggcagcccagcgacctcccaaggagccttttaattactaggttcaagtgtggtttgcagtgaacgtggcgaaggaggtgtgggctgctgtgcagtgaggcagaggcagagcactcagtgcgcatttgtgccctgcctgttcctcctggcaactccaggatgtcatcagccttgcagggagggggctcaccttcttagtgtgggaaactggccccagggcatacccccttgagcgtttcgtagttagaaacttgtgtgcagcttcccaagggaccttcctgtgtacagatgtccactctgtggaaaaggatacaatgggaagcttccagtgtcctgtgcagcttcttagattccatttgggattcacctggaaaaagcaatgccttaccccttgaagtttctccatttaaactccagttaggtaaaggggagaaaagtagaaatattcaccttttgtgttccccatcttttaattttttgttgtttcggttaataaaaataacatattcagcatgagaatttggaaaatgcagaaaagtagaagacaattaagcccccagccccccactcgatgctgtggtaacaagcattcttgctctgcggccaacctcataccctgtatgcagcttgtatcctgccttttccccttttagaaactcttggccaaataatcttaaccataagcatagtatttcatattaaaattttgttggttttcttttaaaacattgtttttaatatcttttgccaggtcagcttcaataagatataattgtacccaatgaaggtcatcactttcaggtatgcaatttgataagttttgacatctgtgtacagtcatataaccaccactatgatcaagatatagaactccatcactccagaaatttccctcatgcccctttggagttgatccttcccccaacccccacacagatcccagcagccattggtcttctttctgtccctgcgattttgtcttttccagaatgtcatatacctggaatcatgtgatagttagccttttgagccttccatttaacttctttcatttagcatgatgcatttgcgatttgtggtggtgcgtgtatcctcagttcactccgttttactgctaagtggtattccactgtatgcaggtatcactatttatccatcacccaggggaaggacatttaggttgttgccagtttttggcaatcaagaatcaagctgctataaatatttgtttacaggtttttgtatgaattaagttttcattttctttgggtaaatatccaggagtgggattgctgggttatatggtaactgtatatttaacttcataagaaattgatacactcttttccaaagtggcatcaccattttggattccccccagcagtatacaaggcttcagctcactctgcaccttcaccaatacttgatattgatacacaccccttttgcttgtttgttcagcagttctaatgggtatgtagtggtatctcattgtggctttggtttttatttccctaatgactaataagcatcttttcctgtgattttttgccatccggatttcttatttggcgaaatatcttttcattttttcccttttgtccagggttgtttattttctgactgcattttgagagttctttatagattctggatacaagtccttttaagcattttacaaatatattcttctagattggtttttcttttcattttgttgttggtggtggtggtggtttgttgttgttgttgttgtttttgagacagagtcttgctctgtcgcccaggctggagtgtagtggcacgatctcggctcactgcaacctccgcctcccgggttcaagcgattctcctgcctcagcctcctgagtagctgggattacaggcgcctgccaccatgcccagcttatttttgtacttttttagtagagatggggtttcaccatgttggccaggctggtctcgaacacctgacctcgtgatccactggcctcagcctcccaaagtgctgggattacaggcgtgagccactgcagccagcctcttttcattattttaacagtgtcttttgaagagtggaagttttaaattttgatgaagtccagtttatcagatttttccccttggattttacctttggtgtcatatctaaaaaatctttgcgtaactctaagttgcaaatattttcttctatgttttcttccagaagttttacagttttaggttttacaattaaaatgtacagttcaagttaatctttgtatataatgcaagctatggattaaggtccactgtagcaagcggcagatgttcttaagtatctccctccctccctccctctcttctttccttccctccctccttccttccctccctccctcttttttttttttgagacagtttcactctgtcacccacccaggctggaatgcagtagcactatcacagctcactgcagccttgatatcctgggctcaagtgatcctcccgcctcagcctcctaggtagctgggaccacaggtgtgtgccaccacacctgacaaatttttaaattttttgtagaggcagggtctccctgtgttgcccaggctggtctcaaactcctgggctcaagccttcccttatcagcctcctaaagtactggattacaggcatgagccaccacacacagccaagtgtctgtttaaaaagaaaagttgttcctaaatgattccttacactccagtaaaacagggctgtgaaaatgagttatgtggaaagctgaccgtagctgctgctttttaaaaaccataccttcttatccgcccgttttgagactggccctttgttgatctacagctctccttttctggaagatgctggaaagaacactgttagtggccttcatttcccctctggtctgggtctcctgtagatggcttctacgattctggcccctctgtacacatcattctcgctcagcagctgcacaggtagacagtgaaaactagcatctttttgattatagactgttggcttcctggggaacagccatgttccatgttgggtcagcttattgataaggggaagagacctagcattcattaaaaacttacccagcaactttgctgtgtcacagaagtcctatatagcataaaatagtactaggtccatcttagatgaagcagtgagatctgttcaaggtcatccagctagtaaaatggttcaacttgacttgccttactccagaactttttgcttatgccattatttcctgttagctcttcatggaaccacttcctgtgtgtctgatggctcactgtgcactcacacacacacaccaactaatggcaggtgcagattggcaggtgcagatgacaagtattgcagtgcagttgcttttagcaatttatcttcctttttcttctgagctggatttaatttactttagtttcccacatttggcattgtagcttttacctttagaatggctaattggctactgcaatatttctttcatatgtgaattataaaagtggccttaatggatgtttcttttcatccagttaggtgtttattgtatcagtgtgtgactgggaaggccaggctagctgcaggttatcacaggcctcttgcagtacttcactggaccccttgagtccttttcagtggatcatctcctgcccatcttcactactccggagtggtctcaccatctttactgggagtcccagaacgtgtctgttcagagcgatgagacccagggcagaaagattccggttaccctttcccggtctcctcatcctaactccttggatcttatcacagtaaatgatcagaagtggaaattctcatgttagctgaaattctcttcatgtttttttcttgtgtttagacctcgttatctttaggcatccctgttactgatgataaccactctgattccctagtttgtaagacactgcaccccctccatatttaaaagttatttgccattggaggtatcatcaaagactactctccctttctaaaatcttggtgttagcagctagaagagagactgccagtcttccccgccagccctactttatgacttaatgcatggcaccacttgtgcagctgatgcctggtcgggccacactttccattatgaacatgctctttcctgacttccctcacattcattgaagtccagtcccggctcagttgctggccgcggctgcttctattgtagaaagtggaatgaataaaaatgaagggcttctgacactggggtgaaactttgtcactgaagagatcttttcaatccaagaagaggaacccagccagcttcgccaaagctggaaaaagctgcaaccttcttttgcccctgttgagatattggaacccccactggttggcttccctctgccctacagctgcccacctgagatttctcacctgggcagagccacagcacagcacagagaaactcagtttccggggactttggcagggatcttggtgctgtgggaggattcaaaccccatctcagccacttgctagctctgtgcatctggtcatattaccccacttctcgcaatctgttcttgcatctgtaaaatggggtagtgttaccacctcggtgggcttttaatgaagattatatgagttaaatgcccactgtattgccagcaaagaatccagcatggtgctcagtgaggaataccgtgcatggctacagtttaactcctgtgaaataaatagatgctggaggcagggaggtgcttcctccgcccccccgtgatgtttctgtggtttcaccttcccatgctgggcactgccctccctagacaagacctgtctgtggactgtttccagtacagctgtttagccagacgctggccccgtctgcagccatcacaggccctctgtctctctgctggtcatgtcatgctctcctcaaggtgccgtcctgctgttcatattgtttcattctttcccaccaggaagcatctggacgaacagtcctgccacgctctttgaagttcccgacacatggtaaccaagacctgagggcagcaaaccgctggtgctgtctctgtgagcaagagccgggtggcacatttggaagccatactgtatttaacttaatcaaatgtggtatgggaggggttggaaaccaagttgtctcctggggggaagaaaagacaggttttatttttgtggctgtgtttttttccctttttaatctaactgcctgttgatgttgacactcatcagggttgtaggctgtcatgaatgtgtacgtgcttaaccagtgaattccatgttgctcgtgtgaggcctttcctgtcatgacccactgtgcttaagaacctgcctgatggggagtgtcggctgtgaaatctgcaaaaagagctgacgttccggctgccgtgatcatgaattgggggtgtactctcctgcctgtgcatcttctcgcgctgagattttgaggcggttgcagccctcggttagtctcccagtggagagaaatcagttgtgcctccctgcttcccaccatagctgcctgaaaacatgacgctcttacgcttgtccttccatcaggaaggtgtccactcacgcccacccatgagggggcttgccgtatgccctggcctttgggcatatttatgtagagttcctttctcctaagacgtgagtttctgatgggggatgtacgagtaaaaaggttaacttctgttcttatgcgtggcgctgtgttcactttccagagtctgtttggatggcggtctcggggtacggcagcgtgtgtgtgtatgtgtgtttgtgtgtgtgtgtgtgtgtgtgaaatcgtgcaaatctacatgtcccagcccattctctgttgaaacagatcacagcaacgacaaacactcatggcgccgcttcactccacccgcttcagatagatcattgttagatatttcacatttttgtatggtggaaataaaaatgaaaaatgtatttccaaaagatgaaaattaaagacattttcataggactctggttttctcctctctttttttaaataagtgaatgatgttttcactctctagtaatacacagataaatttcacactcttaaaaaatctgctaagccactaaggctgatgttcatggatttttttctttttctttttacccctaactgctgtacctgccacgatgggtcagctcctcagtgcagagctgagccctggtgttaagtggccttgtaggagggtgggaggaatgaggacccttagcactcacgctggaatcccaggacgttatgcagattccgatttgtaagacaatttccccaatcaagagcctctgtcacacctgtaagctgagatgggaggatcacttgagcccagaagttcaagaccagcatggacaacacagtgagaccctgtctctttaaaaaaaaaagaaaaagaaaaagaaagaaaaaaaatttcttttttttttttgttaagcatgttaacttctctttaagcatgtttaaaaaaaaaacaacttctctttttttaagcatgttaacttctggagttttgtagccacaaagttagaaacccaggcttggctggaaggactgcccacccctcctgtagtcagcacccacggctcagtggaaagtgtgaaggtgggatggagacagacagtaaaggagggtgtatgcaggagtgtgtagagagggctgccagactgccgagtcagcagcactcacagggagaaatgaggagagtctgacccttctttttgaaagaaaaagagggggcccagcacagtgtctcaggtctataatcccaacacatcgggaggccaagacaggaggatcacatgaacccaggagttcgagaccagcctgggcaacatagggaggtcccatctctacaaaaaatacaaaaattagccgggcatggtggcgcatgcctgtggtcccagctactcaggaccacaggagaatcgcttgaacctgggaggtggaggttgcagtgagctgagattgtgctgctgcactccagcctgggcaacagagcaagaatctgtctcaaaaataaaaggaaaataaacaacttcacagggtagttgtgaggattaaatgaaattacatacaatgcccaggacgcgcaagtacatagtaaattgtagttatatttaaaagtcatggttttgatctgaaacccttactgcatttgcttctatcagtgggagcagacatagtcactggaatgtggcttagaatgaaacacccagaggagctttcatacatgcccagaactttattttctctgctgcatcaaatgacttaaaacaagtgagctgtggctcacgcctgcaatcctgccactttgggaggtggaggcaggtggatcccttgagccaggagttcaagaccagcctgggcaacatgacaaaaccctgtctctacagaaaatttaaaaattggccgggtgtggtggtgttcgtctgttgtcccagctactcaggaggctgaagcaggaggattgcttgagcctaggaggttgaagctgcagtgaactgtgattgcaccactgtgcttccagcctgggtgtcagagcaagaccctgtcaaaaacaaaacaggtgagctgggctaacccacttcctcctccacacacacacaccgggctttcttgacatatcttttgggcataaaatcctaggatggtacttctggccttttgataccgaggcccaggggcatattatgacaacaaggctatggtctgggggcttcttgaatatggtagccagatctggaggcaggcgtcagagtgggaacttccgtgtttccctgcagatagttctgtagtcctttgattttggagctgggctggagaccaagcgctgtggctctgtccattttcataactgtgtatttctccagttttccccttgagattttattatgaagattttcaagcatacaccacctaggtcatcattaccattttgttatacagtcatgccttgccgtcaacaatggaggtcccactagatgatcttagagctgggaaattcctatcagctccagtgtatctgtgttttaagctaagtgtttttacaaaggggtcaaatagttgaaaaaaatttagaagtttattaagtaaagaagttacagtaagctaaggtcattttcttcttgaaaggaaaatttttttaaaattcagggtaaccgtgagtcccaggccttcacattcactctctatcactcaccagaacgccttccagccctgcaagctccattcacggtaagtgctctacacaaatgtatcatttttattttttatactgtatttttattatagtttttctatgtttagatacacaaataccattgggttacagttgcctacagtattccatacagtaacatgttgtaaaggtttgtagcccaggagcaataggctatactatctaggtttgggtaaggacactatgatgttcatacaatggtaacattgcaggctgggcatggtggcttacacctgtgatcccagtgttttgggaggccaatgcaggaggactgagttcaagtctgcagtgagctatgatcacaccactgcactccagcctggggacagagtgagatcctctctctaaaaataataaaataaaaatccttctatccacgtttgggaatattaaatttttttaaatcacctaatgacacatttctcagaaagtatccccatcattaagtgacatgtgactgtatttgctttattacatatccttccattcctcaatttatcttttctttctttctttctttctttttttttttttttgtttacagacagtctcactctgttgcccaggctggagtgcagtggcatgatcatagctcactgcagcctcgaactcctggccttgagcagtcctcccacatcagcctcccaaagtgctgggatgacaggcgtgagccacagtgcccagcctacataacgtttttgagattcatcaatgttttgtaggtatcagtacttccttcctctctatttctgagtatggctctactgctgcttatttattcaactgatgaacacctaggctatttccagtttggggccattatgaataaagctgctgtgaacagtcttgtacaagtctttgagaacaaaatcttcaatttgggggagtaaatgccaaggagtggaactgttgggtcatgggataggtggtctatttagaaactgccagatctttttccaaagtgatcatgtaatttatactgtcaccaacaatgtatgagagttctattatctcccttccttagcaacatttggtggtgtcagactttaattgagccattttgatgggcgtatagtatatctctttgcagttttcgttgtcatttatctgatgactcctaatgatgtacttactggccacaggtatatcttcctttgtgagttagctgttcaattatcttgcccatatttcatcagattgttggtcgcttcattaagttgtagaagttggccaggcatggtaggtcacgcctgtaatcccagcactttgggaggctgaggtgggaggatcacttgaggtcaggagttcgagactagcctgggcaacacgatgaaaccccgtttctactaaaaatacaaaaattagctgggcatggtggcaggcacctgagcctgtaatcccagctacttgggaggctgaggcaggaaaatcacttgaacctgggaggcggaggttgcagtgagctgagatcacgccactgcactccagccagagcaagactctctcaaaatcaaaccaaaaaaaaagttgtagcagtaagttgattacatattttggacatcagtcctttgtcagatagttgttttgcaaatatttagtcccaatgtatggcttgcttattttctttttttttttttttgagacggagtcttacactgtcaccccaaggtggagtgcagtgacgcgatctcggctcactgcaagctctccctcctgggttcacgccattcttctgcctcagtctcatgagtagctgggactacaggcgtctgccataacgcctggctaattttttgtatctttagtggagacagggtttcactgtgttagccaggatggtctcgatctcctgacctcgtgatccacccacctcggcctctcaaagtgctgggattacaggctggagccactgtgcccagctggcttgcttattttcttaacagtatcttttactgggcagaagtttttaattaggatgaagtctgttttatagactttttctatgtcctgcctaagaaacccccaagttatattcatccatgtttccttcgagctttctagttttagcatttatgtttaaatctatgatctatcttgaattaactttttatggatggtacgacactagagttgagattccctcattccatatggttgtctagttattccagaaccatctgtggagaagacctttttgtttaattgttgtgctgctttggtcaaaattctgtttacttaattataagcatggatcttgagggggtgtgtgtgtttcattttatttattttcattgacaaataataattgtacatgctcatggagtacatagtaatgtttctttttttttttttttttttttttggacagagtttcgctctgtcacccaggctggcgtgcagcgccccaatcttagctcactgcaacctctagctcccgggttcaagcaattctcctgcctcagcctcctgaatagctgggattacgggcatgcatgaccatgcccagctagttttttgaatttttagtagagacggggtttcgccatgttggccaggctggtctcgatctcctgggctcaagtgatcctcccacctcagcctcccaaaatgctgggattgcaggagtgacccactgcccttagccaatagtaatagtaattttttgtttgtttgttttttgagacagggtctcgctttgttgcccaggctggagtgcagtggcgtgatctaagttcactgcagccttgacctccaaggctaaagcaaccttccaacctcagcttccagagtagctgggaccacaggcatatgccaccacacctggctagtttcttgtgttttgttgttgtagaggtggggtttcaccatgttgctcaggctggtctcgaactcctgggctcaagtgatctgcccgcctcagcctccctccagaagtgcgggattataggcgtgagccaccacgcctggcctggatcatatgatgtgctatttgtagtgttttgaggagcctccatgctgttctccatagcggctatactagtttacattcgtgaatgtgagttttttatttatttatttattttgagacagagtcatattgtaattacatatataacgtaatgaggtgatggatatgctaattacccttatgtaatcattatacattatatgtgtggaaacattacatccgtggttcacccaggctggagtgtagtggcacaatctcagctcactgcagcctctgcctccgggctcaagtgatcctcccacttcatcctcccaagtagctggagttatagtcacatgccactacacccagctaatttttgttttgttttgttttgttttgttttttgagatgcagtctcgctctgttccctaggctggagtgcagtggcatgatctcagctcactgcaacctccacttcccgagttcaagcaattctcctgcctcaacctcccaaggagctgggattacaggtgtccgccaccatgcccagctaatttttgtactttttagtaaagacggggttttgctgtgttggccaggctggtctcgaactcctgacctcaagtgatccacccaccttggcctcccaaagtgctcggattacaggcgtgagccaccgcgcccagcccctgagtgtgtgtgtgtgtggttttgttttgttgttttttgtttgtttgtttgtttgtttttgagatggagtctcgctctgtcacccaggctggagtgcagtggcacaatctcagctcactgcaacctccacctcccaggttcaagtgatgcctgccttagactcctgagtagctgggattacaggcatgcgccaccacgcccggctaatttttgtattttcagtagagacagggtttcaccatattggccaggctggtctcgaactcctgacctcatgatccaccagccttggcctcccaaagtgctgggattacaggcgtgagccaccacgcctggccgagtgtgtgtgtttttaaagcgtgcatcattattactgaacagcagcaccaagagagtctcacagttcctgtgtgttcccacttggactattttgcaacactcctcttgacgttgaaaagaaaatgctatgacacttggttactgctgaggcgaggccaagccaccctctccagacctgggaaaccagtgagtattaaaaatagttcaatctttttcgctacttttttaaaaatctcatgagttcagctgaaatctttttccccaaaatgattcatggagtaaatcaatgcatctgatttttgctgaggaggggaaataggacacctgaaggccagttcatgtttcccctggttgtgagccatcctctcctccaagttgcctgatccctgcaaacagcagttctgtttgtcttcagctgcctgctttttctagtcgtgctgtgaacttgaacttgagaaagcttgatgctgactgggcctggtgaaaacgctacacgttcaagttgagggtctttttaaatggaaatcttttagactggctcatgtctgtaatctcagcactttgggaggccgaggcgggcagatctcttaaggtcaggagttcgagaccatcctggccaacatagcaaatccccgtctgtactaaaaacacaaaaattagccaggcgtggtggcgcatgcctgtaatcccagctacttgggaggctgaggcaggagaatcacttgaacccaggaggcggaggttgcagtgagccaagatcgcaccactgcattccagcctgggtgaccaaaaaaaaaaagaaaaaaaaaagttttccaaaaataaaggtttagacagatgattcttgtcaaaaaaggacaacaaagaagcacctttttttttctgttttagggggtgaggtggggaacttaagtatgtttcataaggaaagagtgaaccctcacggtgatattttttaagcttgaaaacataggaaaatgctaaatcagaaacttgaagccagggagccttgcctgtgtgtgcaagcgtggacttgagcaaagcgaagccttaggcacctgtgccaggcccgtgcaacttttccgtggacacgtcttcccatatttccaataacaaccagagaaccagttacccgccttttgctgccgtcctcttcctgcaggaggaagggtggggggacaggattcttccacccaagtgcccttgcaggtgtctaagcctgggcggtggattcttggttcctggcaggccttggtgggcaggcaacagccagaatgccaaaaaacacccagttagattgaatgtggttccctagttgcggctgtcggtagggaggaaacttaagtctccttacacatctcctctctgcgcgctgcggtctagtttgcgcagcctcttcttattcctaataacccaaaatctgagaatttagagtccttcttgttacttaggaaggactaatcttccccggcaggttgtcctgcatttgttgaatggggtaaaaattgcatagcatctcgagtgctgtgcctacaaattaccttgataaacgattgtgactcagcaaagcttaggcttttgccctagttttggaggctggggctaactaggaaaaaatggagggtctgttgggtgtttctgctgtttttacaaggcttcagaattccccactgtctgcgtgtgtgtgaatcagcaagtgcttcgcatcctgattgggtggtgtgatgggagcacccacctcgcagagcctcagagccctcattgtctcccttttccatttgctcattcctactttggctagtggcaccctgaaagagttttcatcagtaacagtgttgaggaaaccacgcattagaggcagcggggccacactaatcagcatctgggctgggtgattgctcagatctgagctcggagcttgctgtgctgctcaccagctgtgtgagcccgaggatgctgtcccggctcccagcctcggtttcctcagctgtgggactagacgggactaaaccagggggagaacggaaagcacccacgggtagtaagtgctcaccgaggcattttcccagattcctgccattgtttactgacactgggaagcacccacagcctcctcctggaaaacacacaccccctgctctcaagaactttccattttaaaacagacttgccctctggtgtgtcatccttgctttctgaaagtgagttttcttctctacgccactgtatgtttttttctgatagcagtagggaactgtgtattggagctcactctatgggaagcgttttgtactcttgacgtttaggcatgattatccccatttgaaggtaaacggaggctcaggcgggttcagtaacctgcactggaggtcagggtcagtggcagagctggaattcaagccccaggatgtctgactgcaacgcccatgtgcctaaccacgatttgataccgtcatccagatgaaggacatcacagggtagggagataaagatagaaggaggtggaggtgcccagcaactgagggtggctgggatcccttcataaacctggctcatctatgtagagcatggatccttctggagtcagtgcacctggatggggccagaatcccccctcttcccactctctctgtctgtagctctagaaatagagttatacacatacctgcaacttcccctttctgcatgccacaggcagacatcacactttgtccatctcttagattattcttaagagatagcttccaggaagggggattacagcaccaggaagcagaaacatttcaaaggctcttgatacatgtggccaaactgttttccaatttactcatcagccagaggactacagatcctgcagtgcagcatttaaaacacccacctcccaaaccagccaatcatttcttttttctttttttttttttgagatggattctcgctcttgtcacccaggctggagtgcaatggcgtaatcttggctcactgcaacctccgcctcccaggctcaagcgattctcctgcctcagcctccctagtagctgggattacagttgcatgccaccacacccagttaatttttgtatctttagtagagacaggatgttggccaggctaatctcaaacttgtgacctcaggtgatccacccacctcagcctcctgaagtactgggattacaggcgtgagccactgtgcccggcctttttttttttttttttttttttttttttttttttttaagagatgagatctcgctctgttacccaggctgcagtgcagtggcacaatcatagctcactgcagcctcgaactcccaggctccagcaatcctcccttctcaacctcccaaatatctgggaccacaggtgcatgccaccacgcccagctaattttttattttttatttttatttttattttttatttttgttttttttgagacagagtctccctctgtcccccaggctggagtgcagtggcacgatcttggctcattgcaagttccgcctcccagattcaagccattctcctgcctgagcctcccgagtggctaggattacaggtgcccaccaccccgcctgctaattttttgttatttttagtagagacggggtttcaccatcttggccaggctagtcttgaactcctgaccttgtgatccacccgcctcggcctcccaaagtgctgggattacaggtatgagccaccgcacccagcctaattttttaaattttcatagagacagggtcacgccatattgcccaggctggtcttaaactcctggccctgagtgatcctcccaccttggcctcccaaagtgttgagattacaggtgtgagccactgtgcatggtgaaatatgtttttatatattgggacaactgagaatattagaatgtggacaggctattagatgatactgaaatgtgttaattgtgcttaggagtgacatgtctaatgtctaacttatctttaacctcacagagtgagatgaaacaaatacagaaaataataattaccaaatctaggtagtgggtagataggtgggtttatggtacacctgggatgacaggtgtgagtcaccgcgcccggccttaaacatttcaattacaagggggatatgggggcccacagcgacaaggggtttcacctccaggaagaaacagacatggaacctgctggctgggctttgaaactccttgttctcagcatgtggccccagtggagcagcatcagcctcacctgagaccttgctagaaatgcgcattcttgagccccacttcagtcctactgagtcaggaactccagggccagggcccggctgtctgcaaacaagccctccaggtgattctagtgcctgtgcaagtttgggagctgctggtctgcagaaagctaggtcaactgaaagaggaaatgtaccacacttatttataaccaaatgtgtgccagctgggagcaagtccaagggaaacgtcacttccatctctcgttcacatgatgagttggcgcctcttaactcaatagtgtctttagtttggatgatttgaccacatggaaaatgtccctctgtccctcatgctaaggagcctagccctcacaaaccgttgttcttcataccgaggcctatgatggcctaggcacgttattattaatatccctgttgttccctcgggaggggatatgaaggcttagagcagtttattttttttaattttttttccaagacggagtcttgctctgttgcccaggctggagtgcagtggtgcgatcttggctcactgccatctctgcctcctgggttcaaacaattctgctgcttcagcctcccaagtagctgggattacaggtgcccaccaccacccctggctaaattttgtatttttagtagagacagggtttcacaatgttagccaggctggtctcaaactcctgaccttgtgatctgcccacctcagcctccaaaagtgctgggattacaggcgtgagccgccacacccagccctcagagaagtttagaaacaacccaatgtcccacagctattaagtggcagaactgaaactcaaacccagtccatctgccagagacggagctttaacggccacacaagctgagagagagaaagagagttgagacacttatataaggtgggagccctgcaaatgattgggtgtggtggtgttctggaatcttctgaagctctgtattgagtgctgtgaggcatggctttcccctgccccttctaaacttggaccctgacacatcaaagccagtcttgggcacatgtggctcttgcctggttgacagtccccatcaagctggtgaggtggtcttgtcttttttccccaacctgttgtaatttgactcttaggaattgtgccgtgagcactgagacttgtagacatcccattgtaggggtcttggttgtgtatcactgtgcccatggctcttagggtgacacacacccaactcccaaatcctgtcccgaatgacaggtgggatccagaggcacttgaaagcccagggagtctgagggacagggatgctgacagtgggcactggtggtttgtctgttttactgtttcaggggaatgagcccaccatgtggaattcagatgggccttctggctaccccaggggcctccggctcagcttcctgggcatgtcagagagccgtgccaggggccagagctgaggaatgaggctcggcttactgcccacccaggaggagtccctctggagagcctcagaaagtacctgcaatggcaatacaacagaagagcctctaaatatttccttttggggatacggcaggaaagccaaaggaaatgcgaagaggtgtctgaacgcccagaggaaatcagtgggcccttccagaagttctatttgtggtaagaaaccttggcacggggcccccagctctcctgcaaaaatagaccaatgtgctgagaagcagctcaattctgggagcaattcccctccatggggaagagagcttgcactgggacttagaaggatctgccccctctcttctgcttgcccctggactccagaaccaaaaacagggagaaaaaaaggtaaacattttttaaaaaagaaactcttggccaggtggagtggctcacacctgtagtcccaacactttgggaggctgaggcaggaggatcacttgaggccaggagtttgggagcagcctggacaacatggcgagaacctgtctgtatcaaaaaaatacaaaaattatctgggtgtggtggcacatgcctgtagtctcagctacttgggaggctgaggcaggaggattgcttgagcctgggaggtcgaggctgcagtgagctatgattgtgccagtgtactccagcctgagtgacagagtgagaaccccatctcttaagaaaacaaaaaaccagaacttatgaatgtatccatgacttaactcaaaaatgggccagtggaaacacagggcaaaggaaggtttcaaataagcacctggacacaaacagacccaggaggtgacacacggcattgaggacccactccccatcactaggtcctttggccccaaatgagtgagatgactaagaaaatagggtaccatgtgcagcagaagggagggtggctagacagaaaatgatggccttgactgtgatggtcatcacagacaggacccctaagaaaggtggccaagggggtctggggacccacttttagaataccaggctgacagcataacaggggtttgggacaccaccatgaaagaagacaatgaagccaggtgcagtggctcacgcctataatcccagcactttgggaagccaagacggaaagattgcttgagcccaggagtttgagaccagcctgagtgacatagcaagacccccatctctactaaaaatttaaaaattagccaagcatggctgggcacggtggctcacacctgtaatcccgacactttgggaagccgaggcgtgtggattacgaggtcaggaatttgagaccagcctgaccaacacggtgaaaccccgtctctactaaaaatacaaaaattagccaggtgtggtggcaggcacctgtaaccccagctactcagtaggctgaggcaggaaaatcacttgaacccaggaggttcagtaagccaagatcatgccattgcactccagcctgggtgacagagtgagactccgtctcaaaaaaaaaaaaaaaaaaaaagccaagcacagtggcatgtgcctgtagtaccagctacttgggaggctgagtgaggagggaggattgcttgagggcaggagttggagaccagcctgggcaacatagcgagaccttggcttggaagtaaggaaggaaagaagggagggaaggaaggatgaaggtagaaagaaatgggacaagatggactcctgaggccatcctaattctggaacacaatacaatggcctctgtatgttaggagggctcatttggcttctctctaagccagcggtccacatctttttggcaccaaggaccagttttgtagaagacaattttccatggatgggatggtgggggtgggtgtgggaggggatggtttcaggatgaaactgttccacctcagatcatcaggtgttagattctcataagaggtgcccaacctacatccgtcgcacctgcagtccacaatagggtttgtgctcctatgggaatgtaatgccacactgatctgacaggaggcggggctcaggtagtaatgctcactcacctgccgctcacctcctgctgtggggccggttcccaacaggccatggaatgcttactggtccacagccctggacttgggcacccctcttctaaggcacaaacttctactgtcttaggagcagcaccctggcctccacagcagggagagagcaggaatacccagccacagatattgatgaagatattgatcaacttcctaccgtcatggtggagccatgcctggaggcctctggatggtcatcaggtaaccccagcacattttcctgtcccagactcctggccacgctgaggttgctgtgaacagacacgatgtgcagggtcatggatgtgaagctagaactccttgacaagcaggagctttattttatggcccaagcagtttggaaacaaaatcataaagtgcttacccatccagtgtctccccagcctgcactgggaggtatcaaactgaccagatccgacagccccttccgcccgcagaagatgggtctgcgtttctctgtctttccctcttggtggccaagaactgtcaacatccagctgtggctctgcactcagccgccactcagcctgctcaggttgaaaggtcaaatgttgtctggaattggcagcccagcttactagcagctcttctgtcttcagagtgcagcgaggggagctgtcagagggctgaggcaaggaccagagaggcaactcctgcgacagagaaagctcatccctgggtatgttctggagggagaatagcagggtctgtcccaggaactttattagctagcggttaagatcctcatccccagaaaagccaataggaattagctgggtgatgtgtgcctatggtcccagccactcaggagggtgaggagggagaattgcttgagcccaggaggttgaggctgcagctagctatgattgtgtcactgcgctccagcctgggtgacaaagcaagatcctgactcaaaacaaaaaaaaaaggaagaaagaagaaagagagaacgaagaaagaaaggaaagaaagagaaacagagaaggaaggaaggaaggagaaaggaaagaaggaaggaagaaaaggaagaaagaatgacaaaaggaaggaaggaaagaaagatgaaaagaaaaggaaaggaaaagaaaagaaaaaagaaaggaaaaaagaaaagcagataggaaagtgaggggagagggccaggaagacagaagacaggatgggcaagaaggatgggaaggattcccacaccagattcaggagtggctctgcattgggaaatccttctacaactgctggggacttggttttgcaaacatgcacagagaaaccttcatccacctctgtgcaatgttggactgaagtagaaatgagctgctgttttctggaagcaccccatttctttgagctgatcttctctaataatgaattctggtgaagcctgccattcacagcaccccgccctcccgtctgtaggaggtgggcacaggacccaggccagctgatcagagagctcccttgccctgggatgagcacgtgacccagatggctcaatcacggggaagatcctcttgcctgttgtagccactatgctggaagaacaggatttgggcttgttggccgccatcttccagtccacactgggaacccatttgcaggaggagggaaggaggacaacccagtttgagggagcatatggacagcagctgtggaaggctccatatgtgcccaatactagatctaccccatcccttcctgttccataaatccatacatcttctcccacttttgcttaccctagtttgagttacatttctgacacctgccaccataaaagcccaaatgattacaaggaatatttggctgcagaaaagaccctgcagtctgtgaaaaaagaggctgctggtgcatagtcatcacagaccagtgcaaagagtgaaacagaaacatccagcttaatctgcaaaagcctttttggatctttgagaggcgttcattaacttacagcaaattgatgagctgatattcttctttcatccaggtgagtgcattaactaggttaattttcctgtctcaagggactgctgtaggttagggtgaatgaatgaaagaagcaagtttttaaacaggaaaaaagcttcagagaagttgaggtgacaagcatcgcttcacccccaatggaaggtgagcttgtctgttaggtcccagggactgaactggagttccgtggttaggggatgacccatctcaacaagaaacttccatcatcctcccgtggggatctgattaagatcttctccagaaggagatggcctcatgagttggggcttttcaatctccctgtccctcctctagaagggcattgctactggccttgccctgccaagtcttcagtctacaacagcactgacccgcttcagacacagcccagatccttcccagacacgctgttattccgactttttgccctttcagtccagccttccctatcacttatgctgaaattgggaacatttcccaaaccaacagtttcccagtccacaatgttcccttgctgagtgtccccacaggacaggcaggcagcctgataaataaaaccagtcataaaacctccctgccttagcaaagggactgctttgccaggctgctgtcacatagcactcctgtctcccgtttgacttcacatagtgaaaattgtctaaaagataaggcaggagctctggttgacaccaccacccccatagatctctctctagaagcattggaagaggccgtctcaaaaaagaaaaaaaaatagaagcattgcaggaaagacgtggtttgtagtgaaacaaattggaagtcaagctcagcctcaaccacttacttgcttctgaccttgggtaagtcctatgtacctaggaacctcggttttcttttctttcttttcctttttttttttttttttttgagatggagtcttgctctgtcacccagtctggagtgcaatggtgcaatctcagctcattgcaacctctgcctcctggattcaagcgattctcgtgcctcagcctctagagtagctgggactacaggcgtgtaccaccatgcccagctaatttttgtatttttagtagaaacagggttttgccatgttggtcaggctggtctcgaactcctgatctcaaatgatccacccgcctcagcctctcaaagtgctaggattacaggcacaagccaccgcgcctggctggaacttcgactttcttctgtacaatggaggggggacagtaatactgcaatatttacaattaggttcaactgagagtaacagaggtctgaatacagtagctgaaatggggtgggcagatcacttgaggccacaagttcaagaccagcctgggtaacatagtggcatactatctacaaaaaaataaaaattatccgggcgtggtggcacaggcctgtaattccagctacttgggaggctgtggtggaaggaacacttgagcccagaaggttgaggctgcagtgagctgtgattgcaccactacactccagcctcggtgacagagtgagaccccgtctctaaaaaaataataataaaaaaaaaatttggccatgcctatctgcaagaacatctgggaaaggtagctgcggtaggtagcctcaaaaatgcctccaatatcactgggtgcagtggctcacactttgggaggccaaggcaggaggattacttgagcctaggagttccagacaagcctgggcaacatagtgagaccctgtcactacaaaaaatttcaaaattagctgagcatggtggtgcatacctgtagtcccagatacttgggaggctgaggtgggaggatcacttgagtccaggagttcaaggctacagtaagctatgatcacgccactgcatgctagcctgggtgacagagtgagattctgtctcaagggaaaaaaaagccccttctccactccccaaaagtccccattaatccctttattccagcattttcccccttgtgaggaagaggggaaatttgtatttgtatttgtattcccacttgctttgagtgtggctggacccagtaactttcttctaaccaatagactatggctagaagaatagaatttagtcacataaccatgtctagctgcaataacatctgcattagtctattttcatgcggctgataaagacatacccgagactgggaataaaaagggattttattggacttacagttccatatggctggagaggcctcagaatcacggcgggaggcaaaaggcgcttctttcatggtggccccaagagaaaaatgaggaagaagcaaaagcggaaacccctgataaacccatcagatctcatgagacttattcactatcacaagaataacacgggaaagaccggcccccatgattcagttacctccccccaggtccctcccacaacatgggggaattctgagagatatcattcaagttgagatttgggtggggacacagccaaaccatatcaacatctgtggtaaaagtgatgggatgttccttctgagattaggtttcaaagagatgacagttctgtcttgggcatcctgtcttgctctgaggaaaaccagccaccaggtagtgaggtgctccctggaaaggcccacatggcaagaaactgatgcctctgccaggcaaagtgactcacgcctgtaatcccagcactttgggaggctgaggtgggtggatcacttgaggttaggagtttgagaccagcctggccaacatgatgaaaccccgtctctactaaaaatacaaaaattagccagtgtcgtggtgtgacagagaaggaatctgtctcaaaaaaaaaaaaaaaagaaaaaaaaagagaaactgatgcctctggtcaacagctagcaaggacctgaggcccttagtgcaacagtcttatcatgagtgagcttgggaagaagatccttccccagattaaccttcagatgatggcagcccttgcagaaatctcagtgcgatctcacaagagacctgagccagaggactcactgaaaacatgagatgccaaacttttttgttttgatttcaggagctaagtgttgtgcttatttgttacacagcaatagctaactaatacaatagttttccagctagacacatttctaggattctgttactaagaaggaagggaaggctggagacagggaagcaatgaatagtcactgtcaccaaaactgaggggttaatttgatcaggtctggctgccccgcttgctttggtcacttgcttgttttattaatttttcttttttctccttttttctttatcttctttctcttgctttctctctttctccttccttcctcccttccttctccttccttctttccttccttccttccttcccccttccctccctcccttcccttcctccttccttccttgcctgctgtgtcaattttttttattataatagagacaaggtctcactatgttacccaggctggtcttaaactgggcttaagcgatcctcccaccttggcctcccaaaaaactgggattacaggcatgagccaccatgcctgtcctttttcttcttttcctatgaagctgaagacagtcatagctgaaggctgtggtagctgaataccgtggcgttaaatgctgaaatgtacccttcactagcttctttagagatcacattcacaggtcactatggtaatgtttgcttccgttgtttttcaggaacttaggccagctcccatccagttcaatcaggttgggaccaccaattcttcaatgggcctgcccaaatgcccaagaagtggacttttgatgtcagagggccaaagatcccaccctcagatcatgctaatgccaccactttctgtacacatgtcctgtgaaatgccacaaaccctgactactacgcttgtgcagaacaaacctatcaattaatttttccctactgccaatcacctttccccatgccttacaccaccgtgtttccctaacgcataaatatccctaagccttatcttcaggaagcaggatgtgagagctgttctaccaccttgtttggtggccttgcaaataaatcctttctcttttgcaaaacccatgtcatagtcacagtgactgatttactgcacgcgggcaggacagacctgcacccggccaataacaccactcatacctactccaaagggccgttgtgaggatggaatgaggtaaatctgtaatgtacccatatccagtttgccagcacccaggaagtgactaacgagacatggttttttaattattattttattattattattattattgtatttttagtagagacggggtttccccatgttggtcaggctggtctcgaactcccaaccccaggtgatttgcctgcctcggcctcccaaagtgctgggattacaggtgtgagccaccactcctggccggagatgtggtttttagtgaagggccactatctagtgtctgcttcccaagcttttcgccaagctcctctaggagacaaggtgggctgtgtctaacattcaattttcctgacttctcccctttgacagttcagattccccatgccctccagccaattagtacaattactacttctttttcttctttttttctttttcttttttttttcttttgagacggagtcttgctctgttgcccaggcaagaatgcagtggcacgatctcggctcactacaaccgggttcaagtgattcttctgcctcagcctcccgagtagctggggttacaggtgcctgccaccatgcctggctaattttcgtgtttgtaggagagacggggtttcaccatgttggccaggctgatcttgaactcctgacctcacgtgatccgcccacctcagcctcccaaagtgctgggattacaggcgtgagccaccgcaccgggtgttacaatcactatttcttcaaaaataaagatccccaagcccagcaggagggttcacagaatggtaagatttcagagggaaaagggctagagcccttctaattcagttcccccactcaccattgtgaacccagacacttgcacaaagtcacaaagcaacaagcaggggtgggacttggcccctctggagagataacgtagctctgtgttcctccctctctccaaactgctaatgctcaggcagaggctggtgtatgcagcattttacaaagtttcctatacaagcactttgggaggctgaggcgggtggatcgcttgaggttaggagttcaagaccagcctggccaacatggcgaaaccctgtctactgaaaatacaaaaaaattagccgggcatggtggcacacacctgtaatcccagctactcccagctgaggtgggagaatggcttgaacctgggaggcagaggctgcagtgagctgagattgggccactgcactccagcctggactgcagagtgagaccccgtctcaaaaaaaaaaaaaaaaaaatgccataaagtttcctatagaaaaaaataaatgtgcactagttcaacccagttttttctccctgagaggagttgaggtcaggtttatgggacatgcggtgctttttgagtgaatgagcgtcataaagggaaaccttctggtttccctttaggctttagggggcccctgctcttgtgtctttggcttggcagggagctgaagtccttgcagtcacgagcctgtccctcgtggatataactgggagaaaagtctagaaagtgctccctggggtcccaggataatgtgtccacctaccgaaggcaagaatgcaatctatattattgcccttccccaagggtgcaggatttatgtcaccctggaagaatgcgaactcctgaatcagttcacatacaaagaaaccccagtttttcagaatagattgagaccaaagcctttcagtgaaaatgaatgttttgggcagaaaaaaaaattaatgaaagtcctaagatttttttaaagtattaatctaataatgggagatataatgtgccagtctccctgctgcttatttccgctagtgaactgggctatatgggaacttaataaaatattcacagaaggcggctgggcacagtggctcacttctgtcatcccaacactttgagaggccaaggtgggtggattgcctgaggttgggagttcgagaccagcctggccagcatggtgaaacccccatctctactaaaactacaaaaattagccgggcatggtggcaggcacctgtaatcccagctactcaggaagctgaggcatgagaatcacttgaacctgggaggcggaggttgcagtgagctgagatcatgccattgcacttcagcctgggcaacagagagagactctgtctcaaaaaaaaaaaaaaagaaaaaagaaaagaaaaagaaaacaaaacaaaacaaaaacattcacagaaggctcaactgcaatatttaaaatctttaccagtggccgggtacagtggctcacacctgtaatcccagcactttgggaggccaaggcgggtggatcacctgaggtcagaagttcgagaccagcctggccaacgtggagaaaccccgtctctaccaaacattagccgggtgtggtgctgcatgcctgtaatctcagctactcaggaggctgagaggggaggatgacttgaacccgggagatggaggttacagtaaactgagatggtgccactgcactccagcctgggcaacagagcaagacgctgtctcaaaaaaaaaaaatatttaccagtcatgtgtatttcataaacagcagcaatttcattaaaatcagtgcatatggggaaaagggatgcgtaggtactgtcctatcttcttgattaatgctgttaacatatttttgcacatttaaaaaattgacattgataaatttttagcatgaagttgcagaagttgacctgggtcctaactgtaaaatgcagaggaactctacccatgaggaagctttgtgaagttgattcattactaatgtccctgtgagtacctaacttaaaaagtccagtgtagccaggcatggtggcgcacacctgtaatcccagttgctcgggaggctgaggcaggaggatcacttgaggccagtagttcgaggctgtagagcatggtgattgtgcttgtgaatggccactgtactccaacctgggcaacatagggagatcctgtctctatctaaaaaaaaaagttcagcaagaactggagggctgtggaggactgagcattgagtttagaaaattgtcactacagggcgggcatggtcgctcatgcctgtaatcccagcactttgggaggctgaggtggggtgatcgtttgagcctaggagtttgagaccagcctggacaacatggcaagacctcatctctactaaaaattttaaaaattagccaggcacgtgggcatgtgcctgtagttccagctacttgggaggcccaggtgggaagattagttgagcccaggggttcgaggttgcagtgatctgagatcactccactgaattccagcctggaccacagaatgagaccctgcatccaaataaaaaaataaaaagtaaaagaaagttgtcacagcaaaatgaggcacacggagtttgaacacctctctttttgggagaacacactgagtagacaacaccgtgtgtgtgcgtgtgtatgtgagttcatctgtgagtgtgtggggggtgctttggatgtggaagagtgtgaaggaggccatgaatctttttattctgataaagagcaggaccaggcacagtggctaacacctgtaatcccagcactttgggaggccaaggcaggtggatcatttgaggtcaggagtttgagaccagcctggccaatgtggcaaaaccctgtctctattaaaattacaaacaaaaaaaaattagccaggtgtggtggcgcacacctgtaatcccagctattcgggaggttgaggcaggagaattgcttgaacccaggaggcagaggttgcggtgagccgagatcgtgccactgcactccagtctgggcgacagagcatgactccgtctcaaaaaaaaaaaaaaaaaaaaaaaaaaaaaaaaaaaaaaaacccgggagtatttttgaagcagccaggagctggatatgtgtccagcttgcatctttgtgataagcatttaataaccattgagcttagcaatagagttacggaactggtacttagatgtttttctttttctttttttttttgagattgtgtcctgctctgtcacccaggatagagtgccatggcgcgatcatggcttactgcagcttcaaccttctggactcaagctatcctcctgcctcagcctcccaagtagctgggaacacaggtgcacaccatcacacctagctaatttttaaatttttgtagagatgggggtcttgctatgttgcccaggctggtctcaaacttctggcctcaagcgcttctcccatctcggcctcccaaagggtggggattacaggtgtgagccaccgcacctggactgtgattgcttttcttaacatggtactctgccattatattctctattaggaatttgatatgctcagaagatatagtgagttgcctgtttactaacatcagggtcctttcaggtagtgtccaccacaggaaacattactatttgggtattgtgacccatggcaacgacccagcactcacctttccagacctcatctggtggccttgtaaccctggagctgaagctgcatgcgcacaagcaatcagtcgcagtgtatccacacagggtcccaacccactccaggattcatttcgggatggcttcccctccctcagccgggtctccagccccattgctctccaggcatgcccatctccatctccacggcgatcatgtgtttgcagggagacatcaatatcctcttctcttgcgctttctgaatgggagagtcaatgtcaaccggaagctagcagggacttgggtggacaggtgtctcacgctggatgggggaatccaggtgggaggggagggtgggcttgctctcatttgtgggtgggtaatgggatttgctatgaagctggagggaaaatctggacccctaaagaggggtcccttcccttcctaagggaaggcctcagcttcgagactgcaggaggagctgggtagccattggatatggctaaagcacatgaatcatgaccgtggtgcactgtttggacagcaagtcagtggcccaaggagagagaggttagtgatgggaagcgtcctgggactcaccgatgcatctttatatttttctctttaaacattaggaggaggccaggtgccgtggctcacacctgtagtgccagcgctttggaaggctaagatgggcagactgcttgaactcaggagtttgagaccagcctgggcaatatgtcgagacctcatctctacaagacattttaaaattagccaggcattgtggtaggtgtctgtggttccagctactcaggaggctgaagcaggaggactgcttgagcctgaaaagttgaggctatagggagctgtgatcttaccactgcactccagcctgggcaacagagtgagaccctgtctcaatcaatcaatcaagcaagcaatattaggagaagaatttgttgatgtctcttttctgtcataagctcggctctccaagagccttttcttcccaggaggacatgctggtgtttcatgaatctaggacttcttgcctgaagcttgtaaagtgctagatggaatgaaaacggcaatagtaagagcaggctcttatgccaccttgctacacacaaggcattgctctaagtgctttgcaggggttaagagatgcagttgagtagctgaggacagtctaggggtggggtttccagaggctgtcaggggagtggcccccagccttcctggtggaatccctgagcattaatcacacacataagtttcactccacaaacatgggttgtgaaaacattacaatctagccaggcgcagtggctcatgcctataataccagtattttggaaggccaaggcaggagggttgcttgaggagcccctgaccagcctgggcaacacagcaagaccccatctctaccaaaaaaaaaaaatggccgggtgtgttggtgtgcacatatagttccagctacttgggaggctgaggcaggaagattgattgagcctagaagttcaaggctgtggtgagctatgattacactactgcactccagcctgagcaacagaacaagactctgtttttttttttaaagccataatacattatttttttctaaattaaatggaatgtgttgtgaaccacaatcatttattttatttacttatttgtttatttttgagacggagtcttgttctggcgtccaggctggagtgcagtggcgtgatctcggctcactgcaacctctgcctcctgggttcaagcaattctcctgtctcagcctcctgagtagctgggattacagctgtgcaccaccacacctaatttttgtatttttagtagagatggagtttcatcacgttgtccaggctggtcttgaactcctggcctcaagcgatccacctgcctcagcctcccaaagtgctaggattacaggcatgagccaccatgcttggacctagccacaattatttaataccagggctccctgccgtcgctccccagagctgggagaaggtctcaggagcatattgggtcaggtatgtgtggaaaggccctccaggctcaaattcacactgggcctactctgtgccctgactccaagctccaggagccctcaaaggtggcagctccattgctcatgagccaagcttagggaccggggcccttcctagcagccagaaagagccttattcttagcattttttttttttatagagacagagtctggctgtgttgctcaggccagagtgcagtggttcaatctcatagctcactgcaacctcaaactcgtgggcacaagcaatcctcccacctcagcctcctgagtagctgggactacaagcgtgcaccatcacacctggctaatttttaaatttttaaatttttaattttctgtaaagacagggtcttgctatgttgcccaggctggtctcaaactcctggcctcaagcgattcttctgcctcagcctcccaaagtgctgggattacaggcatgagccaccttgcctggctctgttcttagtaccaagggccctcacaccccctgtcttttcttgggactctgccaagccccaggctccttctcaggcttggggacggtacccaaatcagcacatccacttccatctccccacctcaccccaaacccttctctccggcatctagagccacgccgaagtttctcttcttgagtctagccctcctgggtatgcttggggactgaaatgctcaaattggcctcacctcttgacactgtaattgttccttatcgcctattaaacaggaaccctgctttgtgtagttcagtgcctgctgccaagtcagagctgtgacctcaatgaaagtggcccagccacaccaaacctcagtttccgtaacagtcctgggatccaatgtggctttcacattacatatcacttcactctgttatctccgatggaaaaccaactcaaactggcttaagcaaaaagggtactcactgggccatgtaaccaaaaagtgtaagcataggtgtggcttcaggaacggctggatcaaggcacccacatgtggcatcgggagtccctctcctggctgttggtttcagttttctctgcaggggttacattcgagcattggttccctcctcatagtggcaaggtggctgcgcaggacaagaggcatatagccaagggctcagctacttaaggataagttccatcagaagcccaagttgaggctggccttggtggctcacacttgtaatcctagcagtttgggtggctgaggtgggtggatcacttgaggtcaggagttcgagaccagcctggccaacacagtgaaaccctgtctctacttaaaaaaaaaaaaacaaaaaaccatgaaaattagctgggcgtggtggcacatgcctgtaatcccagctacttgcaaggctgaggcagaagaatcacttgaacctggcaggcagaagttgcagtgagccgagatcaaaccactgcactcctgcctgggcaacagaacgagactccgttggcaatgactgggtcatctgtccagtcctgaactggtcactgtgtgaggtagaagcattgtttgattggccaggcctgggacacacggccatctccagacctaggaatggcatcatctctacccaaaccccgtgaaccaggaggtggggaggagcaaagcttcagaagaaactccgggccctgccatcaagcagaggaggaaaggaagccacacagactgagacatcaagtacccactgtgccctcaccaccagctcctgccctggtcagtgcactcctggaccatttctcctccccgtcttgttcacagtcaccctctcaccccagcagagatcaggccaggggactggtggcaagtgagtgaagggtttcagcctaccttccaggcacagtgtaagcggaccccccacacacaggggctctcctgggttacacagtgtcctcccaaaattcacatccacctggaacctgcaaatatgaccttatttggaaatggagtctttgcagatgttgtcaagataagatgaagtcatactgttttaggatcggccccatatgtggtacgactggggttcttatacgaagagggaccctggcacacggatgcatacagggagagcgctgtgtgatgagaaaggcagagattgcagtgatgctgccaccagccaaggagccaccatcaaccaggagacgggcatggatccgattctccctgcgaacctccagaaggagccaaccctgccaacaccttggttttggacttctgttccccacaactgtgagacaatacattctgtggttttaagctttatgataatttgttactgtagccctgggaaaggaatacaagggtagacagacactgatcaagtaagcaaacaaatgtgaaattgccctgtgacaagggaggtgcagggtgcctgtgttggggaagaattctctgagacttgaagtcagagaaagagttagctaatggggctgacaggggtctgcacatgcagctcacggcccagatctcgttggccgagtgtttttgcagggattaggaactaagaatggttttgcaagaagaacatcccaggccgaagggacggcatgagcaaaggccatgaagtgggaggcgccctctgtgaaaccaacaagctttcagccacgtgggtctctctgatgcgttgtctccgccacagagggctttaaaaagccccgaaactggacaggtgtcactgcctgtggcagtagcggccatttggcgcctgtggtttcaactccacccgtttcacatgtctatgttaccagactggcccctgaaggggatctgcgtgccaggccctgacctgccgggctttggaaacatccttgccagtgtcccctgacctgcgccccgccctgtggagtgaggcctggttgcccaagctggctgggccgggctgtttgctgcttccaacaaacataggagagaatgtattgctgcttttgattgccagtgagagctccgcgaggcctggcccgagatgtggctggcgtgaggggtcccggacctgctgtggtggggacgcacccagttctgtggcgcttggtccagcgaggactcgagcccactggggacggggcctcgggctgcaggggcggggccccagccgcctgggggtggggcctcaggttgtttgggggcggggcctcaagctgtctggggacggggcctcgggccggctgggggcggggcctcatgcttcaggggcggggcctcggactgcctgggtgtggggtctccagcttcagggtcggggagcctcgagccgcctggggaccgggggatctgttggggaggaggttctcgaactgctgaggaggatcacagtgcttttgcttcctctaggagaccagctgcacaggctgcaacatgccatctctgtgcctgttttcccgtcgataaatgcagagacattactctcatcatttcttcctctgtaacacaatattcatctatgtaaccccttggtaaagcagttgtaagaattaaacaagaggaattgcgctttcattcagcaaatattttttgagcagctactagatgccaggcactgttttagacgcaagtgatacttcaggaaacataatcagacagacaggcagacatgccctcctggaactggcattgtagaacaagggtctgcatcctgtggctcacaggccagatctggttgaccgtctatttttgcatggacgttaaactaacaatgatttttgcattttgatttttattttatgaaaaaacaattgggggttgggcgcggtggctcacgcctgtaatcccagcactttgggaggccaagggggggtggatcacctgacgtcaggagttcaagaccgccctggccaacatggggaaaccctgtctctactaaaaatacaaaaattagctgtcatggttgtgggcacctgtaatcccagctacttgggaggctgaggcaggagaatcgcttgaacccgggaggtggaggttgcagtaagccgagatcgcgccactgcactccagcctgggcaacaagagtgaaactctgtctcaaaaataataaaattaaaataaaataaaaaagagtggtctctggaccaatagctcagtatcacctggacatttgttagaaatccagacctactgaaccagaatctgtattttagcaagacccccaggtgatctgtgtgtacattaaagtgtgagatgtttttgtagcaacatgcatggaactggaggtcattatcttaagtgaaataagccagatacagaaagacaaatattgcatgttctcactcccaagtgggtgctaaaaaatgcatacacatggctccacagagagtggaataataaacaatggagattcaggagagtgaatgtaaattctggcagttcatccaccactgtgaaccatgagaaatagtttaatggctgccaggtgaggtggctcacacctgtaatcttagcactttgggaggccaaagcaggaggatcacttgagcccaggagttcaagaccagcctgggcaacatggcaagaccccatctctacaaaaaatgcaaaatattagctgggcatggtggcacgcacctgtagtccctgctactcaggaagctgagatgggaggatcgtttgagcctgggagatagagactgcagtgagccatgattgcaccactgtacttcatcctaggtgacaaaatgagaacctgtttaaaaaaacaaaaataggctgggcacggtggcccacgcctgtaatcccagcacttcgggaggctgaggcaggtggatcacctgaggtcaggagttcgagaccagcctggccaacatggcaaaaccccgtctctactaaaagtacaaaaattagccgggcgtggtggcgggcacctgtaatcccaactacgcaggaggctgaggcaggagaatagcttgaacccgggaggtggaggttgcagtcagccgagattgagcctgcactccagcctggtgacagagcgagactctgtctcaaaaaaacacagcagcaagcaacaacaactaaaagaaatcactgaatgggtacaatgtatgttatcgggatgatggagatcctaaaagccctgacctgactattacacaatctatgcatgtaatgaaattgtatttgtaccccataaatttatgtaaataaaacattttaaaaagtgtgagatgtgcaggtcgaaaatgatgcagaatgctcagcacagggcctgacacttagcaagagctccatgaatgttagctaatgcggtggatggactcatggtcccccaaagaggtccacatcctaatccccagaacctgtgaaagtggtaatttacattgtaaaaggggctttgcaggtgtgatcaaattaagtctcctgagacgaaggaattcacctggattatccccgaggggcccaatgatgcaatcacaagggtctttttttttttttttgagatagcgtctcactctgttgcccagactggagtgcaggctcgatctcggctcactgcaacctctgccttctgggttcaagcgattctcctgcctcagcctcctgagtagctggaattacaggtgtgcaccaccatgcccagctactttttgtatttttagtggagatgggggtttccccatgttgcccaggctggtctcgaactcctgacctcaggtggccttggcctctcaaagtgctgggattacaggcatgagtcaccacacctggccacaatggtccctataagagatggtgggcagggcaagaagaaatgtgagatgtgaggctggaagcagagggtggaatgcatgctttgaaggtggaggcacctgctctgcggcaggcctgtagaatcgggaaaagacaaggactcagattctccctcagaacgccctggaggaaacaagctctgctgacaccttgattttagacgtcggacctccagaacggtaagagaataaatgtatcttattttaagtcactaagtttgtggaagcttgttggagcagcaatacagaatgaatatagctgccattcttattgttatcctgtttgtcgtaggctggctctgccatcttcccattcagttgtttcaggcaagttattgagtctctctgaacttgagttttctgctctgtaaaatggagacaagaagttttcctacttctggtcaaatgagataatgcatgtaaagtgactccagctgtcatgattgttgttgctcttgtttaagtagaggcagtggccatggctggctctgtgtgacctggggcaagttatgagacttctctgaactttagtttccccgcctacaaagtgggggtcatgacagcatctacctcctgaggctgtcgtgaagctggaaggagaccctaagcataatttctgggcccatgcctcgcttgaggaggacgtaggtataattctggccgaattggagaacgtgatctctaaactgggtgggcccctctaagctgtcctgactccggtcctctgtgctggatcacagcctcagcctggctggcaggggagtagatcattcctattccctttgcctccccagctcttcccaagtggacaccacaaccccattgctttttttagagacggagtctccctctctcacccaggctggagtgcagtggtgtgatctcggttcactgcaacctccgcctcccgggtccaggtgattctcctgcctctgagtagctgggattacaggtgcatgccaccactgccggctaatttttgtacttttagtagagatggggtttcaccatgttggctaggctggtctcaaactcctgacctcaagtgatatgcccacctcaacctctaagtgctgggattacaggcgtgaaccactgcgcctggcccccattaccttttgttgtgactgcagcagactcactggggggcttctgtccccagagggcggggagctcaagttagttcattgaggaggggcaggggccatagggctggggcggggcctggacatcccaacacgagggtccttcctgtgctgaggttccagactgaggcgggagtcagtctgaggcctggccgtgcggcttggcgtctatccaggctggaatttgcaggatttgtgctgtggtgctggaatcggctccctcggagtgtgtgtctcactggattggatctgtctgtgtcttgggggtgttctttaaagggaagaacctgacagacttcacactgcagtgccccgtgcagggcctggcacacagaaaatatctattggaccagtgaatggatcatccaagggactgaacgtccccagtgcaaacaggaagggagtttgtgtcagtggggagtctcccaggccccagtaagactggttgaccaggtcctccctaagttctgggtgttgctgaagtggccttgctgctctgaaaacagctgtgtgcatctcagcctcgcctctcccggaggagggcctctcacttcctacgaaaccaggactgcagcctcagagaggtttgagggtgtgcccagggctacacacttagagtgagtttggggcgtgaggcaaggatttgtggggtggctgcccagctaagcacctggacactgttctgtaggaaaggagagccgttaaagaatttgtatctacctcttttttttcttggttttgttactttcccccaacattttattatgaaaattttgaaacagcaacatcaactcactaacattt

SEQ ID NO: 417 - DNA, 475791 bp, Homo sapiens
  misc_feature (323852)..(373851): n is a, c, g, or t
acatcatcctcttaagtatatactttaaaagaaaaaagaaagttgtagatatcaaaaaaaaaaacaacacattttacttttaactgggcactttcactacacttatatcacaatgctgcctggataacattttaaagaattgtttattacaaatgagaggaaatgccagctaaagtcaagggagttgaacagttttcagttttccctgccaatctaaaccaccagtgccagtaaggactactcagtgaagagtgcagagcaggaacccaagcgtgttgtgatgtcaaaaacagcagttattttatatcatgggttttgaatcactgatattctatttttgttgttgctttttattgatataccagaaataatgttattttttaaatgttacatgttctgaatgacctgttcttaatactttcctctttagagcggtcttcatttatttccccagaagtgtagatgaggtgattgtttataaaacttacatctttaaatgctctcaattgttggagtgtttgacgttcttggttgatccattcttttttcttttgctcctttttatcttgtctcttttctatatttaagcagatgtatatttgtaaattgctcaacattacaaaaatgtcgtggcatacaataaaaatgtcttgacaaagaaagaggctgtaccccaacattaccaccccaagactgcaaccagactgcaggcctggaggtgaattggctgacagctgcaggtccagggcagcgcaactccagtttccacaagtctaggcctgcatgtcacgctacacaaacatagaacattttccttcggaggacactcaccatctgaatactgtgatgctgacgagaatatcttatgctttcttcagcctgttgcaatctgagccaatgattttcttcgcactgatcctggtggaataatacaaatcacctacatggtttttagtgttaccctggtatagcataaaaggttaaaagaagaaagcactgcatttgggcgtagtgtaaggcattcattaatattagttctggtgcggcccaatggtactctcctccacagtctatgatgagagttgcctggctgcttatggaaataatttattcccagcagagtgctttaagaggtgaaaacaatccgccaaccatgagaggacacacaggcagcccccattcttaaatgggatgtgtcccaacaatgttttaatgtgattgttttaaacacatttccccataacattataaatactaattacatttccaagcatacctacaaacgcagagcaactgaaaaattgttataactgtgtttcacctgtgcttaaccactcactataccaatatataatatgctatatgtacataaaatccttaatctatgtaaaaaataatacagtaatactcacagataatactaacatttattgagtaggttttagcttcaatgataagtacttttcatgccttatgctactctatcgtcacatgaaatttgtattattaccactatcttttttttttgagactgagttttgctcttgttgcccaggctggaggagtgtaatggcatgatctcggctcactgcaacttccgcctcctgggttcaagcgattctcctgcctcagcctcccaagtagctgggattacgggtgccgtgcctgatctatcatcctcttttaacagaggagaaaactgtgagcccaaaagagatttaagtaatttgcctaatgtcacatgactactacctaagtggccagactgcgatctgaacccaagttgagagctcacctcaactaccattctattaaccgagtgccttccaaattccaacatttccagaatcagtggaaagagctcctctaaatggggtagggggagtgattatatcttgagagtgaaggttaatgctccaagtctggataagagaaggcacaggagcattttatatacatatacatataacactgccaaggaggtggaggcatctgttcatccacagcaccatgggagtgccaaaggagactcctcttggggctcatgggttttctgaaatgtggagcaaagggcaaatgcctgtagatcttcaaatcctctgaataacagttcctaaatccagaagtacaattcttaaacatgaacatgcaaagaatatactcttctaacaaatttttttatttttaatttttattagagacagggttttgttctatcaccctagctggagtgcagtggtacaatcacagctcactgaggcctcaacctcctggcctcaagcaatcctcctgcctcagcctcttgagtagctgggactatacatgcgcaccacagagatgaggtctccctgtgttgtccctggtctcgaacttctggccttaagtgattctcccacctcaacctcccaaagtgctgggattacaggcataagccacagcacctagccaagttttttttaagtatttgtatttacatggaagagtaattaacatttttgtaagctacgaaagtcacaattttcatgttttcttaattctaacaagaaaagtatagtaggctcggcacagtggctcacgcctgtaatcccagcactttgggaggctgaggcaggtggattgctcgaggtcaggaattcaaggctagtctgaccaacatggtgaaaccccatctctactaaaaatacaaaaattagccaggcttggtggcaggcacctgtaatcccagctacgcaggaggctgaggcagcagattcacttgaacctgggaggtggaggttgcagtgaaccgagatcacgccactgcactccagcctgggagacagagcaagactgcgcatcaaaaaaaaaaaagggagaaaagtatagtaaatatgagtaaatacacataaaagtctgtataaaaatgatatatagaagcttccttttctgtcagaaaaaattaaatttcttagtgttatctttttatgtattcatggatttttaaaaattaagaaaaaaatcaccaaatacaaggtctgaggtgagctgaatattgttatctgtaattgttttgtgtactaaaatatatttagaattattatagctggttattagaaatagagtttctacctattgtggtttttaaagtacctgtggtccgggggtggtggctcacacctgtaatcccaggactttgggaggccaaggtgggcggatcacttgaggtcaggagttcaagacgagcctagccgacatggcgaaaccccgtctctacaaaatatacaaaaattagctgggcgtggtggcacgtgcctgtaaacccagctacttggcaggctaaggcacgagaattgcttgaacctaggaggcagaagttgtagtgagccaagatcatgcctccgcactccagcctgggtgacagagcaagactctgtctcaaaaaaaataaaaataaagtgcctgtgtatgcagtgggaattcaacaaatagttgttgaatgaataaattaaaaccttgagatttgctaaatgcttaaaacccaaaagaaaaaaataatatttttaagaaaaatattaaaaatcattttaactatagccatggataagttcataagcacacaaaaaattaatcactgtgttggtaaaaaccttatttcaatacctctttatccttcatacaagaataaatctctggaagagaaaagaaaagaaagccgctctgagcgtacccacctttctactctggagagaagctcttttgacacagatcctgccccgtttaatagactccagctgctggcactgccttctgagttctttcacttccgaattcttatcgtcctgcagccccaccacagtcaatgactaagttcctctggactttcacatggatcgtaatagacaacttcatcctgtttttctaaaaaggtattaatgattgtttaaaacatattttattatttgtaaaaatacattgaatttttttaaatgtaaggaaaataaagatcacttgtaatcccaccactgagaatcactattaacatataaaaaatctgtgtataaatgtaatatacatatacacatgtgtatatatacatgactatacacatgtatgtaagtagcatgtgtgtatatacatgtaagtagtatatgcatgtatatatacctgtatagacatatgtatatatacacatgcacacacacacacatactacttacatagctacacgtatcaatggagttctaaaagaacactttccatgggatggaaataaatttttaggccaggtgcggtggctcacgcctgtaatcccagcactttgggaggccaaggcaggctgcacacctgaggtcaggagttcaagaccagcctggccaacatggcaaaaccccatctctactaaaaatacaaaactagttgggcacagtggcgtgtgcctgtaatcccagctactcaggaggctgaggcaggagaacagcatgaacctgggaggcagaagttgcagtgagccgagatcgtgccactgcactccagcctgggcaacagagcaagactccatctccaaaaacaaaaaaaaatttaaaaaagataaattttaatggcagcatagtattctctaatttaagcaatccatgttgttaggctgttccaatgttccattattattcatttcactgtgatgaacatctctgtataaatctttgtgtatgctttttatcacttccttagcagataagtgtttaaggatcttgatacccattgccacactgccctccagaaaggcaacttatattctaccagcaatatattattaagatgccttagtgatatttaatcttgattacatattgattttttaaaagtcatgcttactgtaacaaattcaaacccacccgaagtacatcaaataaacagtgaaattctattgctccttccccaaaccttctgagtcattctcagaggaaaaacattatgaacaatttggcatgcatccttccagattaacttcttttttaatgtaatttttttcctaaatatgtaaaatgcttataacctgaaactactgaaaaaaattctgaatactcaggattaaactaaaagttcaggatctatgtgaagaaatttattaaacttggaggaactttaggaaaaaagatttaaataaatggagagagacataccatgttcttgggtaggaagattcaaaattgcaaagaccactattctccccaaagtaatctctaattttaagcaaaatcacaatcaaaattccaaagagttttttgttttgaacttgattctaaatttcatctgaaagaataaaggagtgaaaatagtcagaaaacttgtgaagtaatgtggggggtacttgccttaccagaccctaaaatgtgcctccaagacagttgtgggaacagtatggagccagtagcagaagccactcacgaaccaatggaggagaacaactcagaaacagaccaaagtcaatctaatgtttaactggagaaatgttaaacatttagggaaaatgtttttaaaatcagtgattgggactgtttaacaatttgagggaaaggttcaattcctaccacaatcaaaataaattccacctggactaaagaattaaatgttttaaaaaataacatcataaacatactgaaagaaaacataagtatatattgacataattttgggataggagactattgccagacataatactaaaagcagaagccataggggaaaaaaatcgataaacacgacttcataaaacttaaatatttctgaaaggcaagaaaacgcaaatgacaaggagagattatttgcaacatatgacagacaatagaggacattattcttaatgttgaaaggaaatattccaaagaaaaatggacaaagactatgaataggcatttcataaaataagtacaaatggcttgtaaacatacaaaattttgttcaataatcactcataattaaataaatgaaaattggaagactgccattttctctgtcaagtaagcaaaaatgcaaaagaatggcatgagtctgggaaacatacacactcatattctgctgatgggagcgtcttttttcttttcttttttttttgagacagagtcttactctgtcgcccaggctggagtgcagtggtgccatctcagctcactgcaatctcaacctcccaggttcaagcgattctcccgcctcagtctcccaggtagctgggattgcaggcacccaccaccacgcccggctaatttttgtatttttagtagagacagggtttcaccacgttggccaagctggtcttgaactcctgacctcaagtgatctgcccccactcagcctcccaaagtgctgagattacaggcgtgagccaccacgcccagcctgggagcgtcattttaaatgtacgacctatctagagggccactacatagtatgaaatttagaaatcagaaaataatacagaggtgaggaaaaatgtatctcagatgactgctgtattgttacatagcaaaatgtaaaatatacattgcccttgacccaataattccatccttagatatttattccaaggagataatctgtcctatactcaaagacatgtgtaaaggaaagttcactacactactgttcaaaacagcggaaatttggaaatcacggtatatccatataatggaatactatgcagccattaaaattttgatacttttattatttctgaaacagaaagacaattattatgtattaaatgaaaaagagactattatgcattgtatgcctgtgtcaaaatatctcatgtaacccataaatatatatatctgctatgcacccctaaacattaaaaaattttaaaaaagatgttactgaactggttatgtagttttggttaaaaatttatatttttacatatcagcatattttgaaatctacaaagttatacagcaaattgttaccactaagtatctgtctttttttttttcttttttagatggagtctcgctctgtcttctaggctggagtgcagtggcacgatcttggctcactgaaacttccacctcatgggttcaagccattctcctgcctcagcctcccaagtagctgggattacaggcacgtgccaccacattggactttgtatttttagtagaaacagggtttagtatttttgtatttttagtagagacggggtttcaccatgttggtcagactggtctggaactcctgacctcaagtgatctgcccgcctcagcctcccaaagtgctgggattataggcctgagccactgtgcccagccaaccattgagcatctctagatgatgggattggggtaataatcatttttctttctttgttttgctatgtgctaacaatgaatatattatttgaataataaaccactgaaggaaaactttaggaaattttcagatgttacagtttacaaaaagtaattgataatatggtctgtatttccttaaatttataaacattgtaatctatatacttaaataaaaactttaccttttataagtctttcaagagagtccaactgtgtagtaagcagtatttctttgttttttaatatctcaaatttaacttcatatagttctaactgaatttcataaaattgtattgctaattcatctacaacatttatatttttttcttgttctggaagatcttccatcttattttcatagaaaaaagaaaaataagttaaaacaaatagtatattaaaaacaaactttagaagcattctagctattttctattccttgttccgtactaaatataaaagagcaaataggaaagaaacactttttcatttcatctagtgatgctaatactttatcccatccttgaaacagagaaaaacatttaggttttgagaaacataaatggcaatgaggtattattatgtattgcatatcggtgtccccccaaaattcatatgttgacactgtaactcccaatgtgatgttatttggaggtgggtcctttggaagtaattaggttcagattatgtcaaaaggatagcacccccatcatgggattagtgcccttattagaagagaaagacagggatcactttctttctctccaaacatacacacagaagaaaggctatgtgagcactcagttaagaaggcagctgtctactagacaggaagaggatccgcaccagacagtgaatctgcaggcaccttgatcttggacttcccagcctccagaactgtgagaaatacatgtccattgttgaagccacccaatctgtgacatttaatattgttacagcagccttagccaactaagacaggtgtttacagtgttttctgctttaaagtcataagattataggaaaaaacttaagtgtctaagatccttcagggaagtatctctttgattattttaaagctgtactgaaaacattgctggattgattttcaagtacagtacccacttcaatactgggcttggtgttactataaagtgaatcctacagtgtggtattttgaaacatcttaaccaaaggaaaactttatgtctaaccttccataggagatggtgttggaataagtgaagaaaagcagctctttaacaatgcctggaaagaaaagtgctatctaaaaatacaagtgtgctttaccacatggtctcacttataagtgggagctaagtagtgtatacacagacagtgtggaataacagacactggagactcagaagagtaagagggtgggaggggggatgagaaatatttaatgggtacaattacattatgtaggtgatgattacgctaaaagcccaaacttcaccactacacaatatatccatggaacaaaactgcacttgtatcctttatttatacaaaatttttaaaaaataaaagtggcgcggggcacggtggctcacgcctgtaatcccagcactttcggaggccaaggtgggcggatcacgaggtcaggagatcgagaccatcctggctaacacggtgaaaccccgtctctactaaaaatacaaaaaattagctgggcgcggtggcgggcacctgtagccccagctacttgggaggctgaggcaggagaatggcatgaacccaggaggcggagcttgcaatgagccgagatcgtgccactgcagtccggcctaggcaaaagagcgagactctgtctcaaaaaaaataaaataaaataaaaaataaatacaagtgtatttttaaaacaaagttatgtttatctttgtcttacctttccctgaatttcagctcttttgtgatttaaacataactctttcgctctcatgagttgcagagtctcttgagctagcattagcttaagtttttccaacctgggaattgctgtggcccaggcagcctggccaaatctcttcacatcctgttccatttctttctgcattcctgttagattataaaaataaaatataattacacctcattaaaaagggaaacattgatcatgagctaattctttttttattgcctccatactacctgcagaacatcttttttaaaagaaattttgttttattaattttttattattataaaaataatacatggtcattaatatacaattttaggtattcaatttttaaaaggacaataataagtcatgatctcacctagttgaggcaagtgcttcttatattttggcacacttgcttccatattgtttctatgactagctagacagacaggctcatatggatagtttgaccaaaaaaccaggatcatcattctgctttatatcttgttgattctgtgcaatatatcagaaactcctgccatttataaaaaaaaaatcaagaatcatgcttaatagctatgtagttttctcttttatgaatgtaccataacttaacaaactgacagacattaagttgtttcctatttggtgtttttatcaacaattatttaagactgaaaaaaagtccttcacccagcccgcaagcccctgcacggtctgatccctgcctgtcttgccagcattctccctcataccacattgtcctgcactctctgcgatccagccccgcaggttttctgtaagctcctatttgccaacttccctcaagccaggggaccttcgccagtgctattccttccgcccagaacactcctcactttttctattctctcaatttccatttacccttcagatattggggcaagcgccacttctcagaggccttcagtgaccaccctgatcaagcccaatttctctctcacagaccctcagagccccatgtctctcttctttgtgccatttattgtcactgccattttctgtgtgcttcagtgaatagataattaagatttctctcccttcaccagactgtacaatgtctcttaatgtttgacactgaattctcgccacctagaaaacacagtgcctagtgcgtaagagggactcaaatggtatttgaataaaatgacaatcaattacacgtatctgcgtatagcattttttagattatcacctgctaatgcttttactgtctccttaaaataattcactgtgatatcttgaatagagacgacagcttctccagcccgtctggtccattcttcagcttctttctccagggcaactacccttctaggacctaggtcatcctcatccaaggacttctacagacagaagggaaaattatcttagtaagagctaatagttatgtagaaccattaggaaattgaaaggaaattggtcacatggattaatttaactacactactactcagtcagttaaattttcattcattcagcagtcccttactgcacatgaataaggctctaagctgagcaccacctggaagacaaaaggaccctctggggcataaagtggggggaaaaaaaactactttcacttcacatgcctagaataactttttctagagaggaatgttgtcaacttatgcttctctctattaataataatacacaattgtttaaatgagtgatctgtgttgtcaaacactcagcacagggcctggaaaacagcacttaagtgttagctgttgttatcatttcttttagggatatgtaatattatcacctaaaagacagtatctgtatattcatgcttataacatgtactggtattggactgaatgtttgggtccccccaaaatgcatatgttgaagcctaaatccccagtgtgatgggatttgaagatggggcctttgggaggtaattaggtcatgagggtggagacctcaagaaaattgggattaatgcccttataaaaagaagaggagacacaggatctctctctctgctcttcaccatgtgaagacacagcaagacagtcatctacaaattaagaaactggccctcacaagacactggatctgccagcaccttgatcttagactacccagcctccagaactgtgagaaaaaaagttttgttgtttataagccactaatctacagtactttgttacaacagcctgaactaagacatgtacagctatgtcatccaatatgcaatttttcttctacaaagcataagaaatatgtacaagttagccgacaaggaattacaaatcaaaaccataacgagataccacttcacacccactaggatggctgtaaccaaagagacacacaattacaagtgttggtgataatgtggacaaattggaaccctcatttacttcttctgggaatataaatgatgcacccactttggaaaaccatctggcgtctttcaaaaggttaaacactgggtaatcacaggacccagcaatcctactcctcagtacgtacacaagagcaatgaaaagatatgtctacacaaaaactcacacacaagcattcatagcagaattattcatgatagccaaaaagtggaaacaacccaaatgtccatcaactgatgaaaaaaatgcaatatatccatacaatgaatatcactgagcaataaaaagaaatgaaatcctggtatttgctacaacatggattagccttgcaaacattgtgctgagtgaaaggaccacatattcaataatgctgttgctatgtccagagtagggaaatccacagagacagaaagtagattggtggttgcccagggctggcagtgactaatgggtacagggtttcttttgggggtgaaaatgtcctgaaattacatagtaatgatcattgtgcaactttcaatatactaaaaatcactgaattgtacatctttttatatatgtagatatattttatatatatatatgcatatatatacgtatatacgtatatatatatgtatatatgtgtacatatacatatacacatatatacatatatatatacgtatatatacacatatacacatatacatatatacatatattatacagattatatatatgtatacatatatacacatacatatatacatatatgtatgtacatatacatgcatacatacatacatatatatgtatacatatatatatacagattatatatatatatatatagtctgtgaatggtattttaaaacagctgttacttaaagaaaggaaaattatagactgggtgcggtggctcatgcctgtaatcccagcacaatgggagcctgaggcaggcagatcacctgaggtcaggagttcgagaccagcctgaccaacatgaagaaaccccgtctctactaaaaaaatacaaaattagccgggctggacatggtggcacatgcctgtaatcccagctactcgggaggctgaggcagaagaatcgcttgaatccaggaggtggaggttgccgtgagccaagatcacgccattgcactccagcctgggcaacaagagcgaaactccatctcaaaaaaaaaaaaaaaaaaagaagaaagcaaaatatatgcaagaagtagactctccaaataatagactttcaaaataatgaacagaacaactttatccacaggttagagtggcatgagtttcatctaaatgtgatactatttttatagtacaatcatctggcaggggcatgagattatatgtggaaagatggcccagtgcagggggcagaaatcaagagatctcttaggtgtcttctgattcccgttgttgagacccaaggcaagctatttaacaactctggactctagattcatttgtaacactggaataagaatgcctttcctgaatggtgtcacaaggatgtttgatggctcaatgaagcaagagcgataactgtatttactaaaatttaagttactgaattacaatctagggtcctgctatttaaattttcatcctattttaagaaatctgcatgagtccttagaggaaaacaactgaagcaaataaacatcacatcaaaaacaattcatcaggctgggcgcagtggctcacgcttgtaatcccagcactttgggaggctgagacgggtggctcacttgaggccaggagttcgagaccagtctggccaacatggtgaaaccccgtctctactaaaaatacaaaaaaagttagctgggcatggtagtgcacacctgtaatcccagctactcaggaggctgaggcagaagagtcacttgaacctggaggaggttgcagtgagccaagattgtgccactgcactctagcctagctgacaaagagagaccctatctcaaaaaacaaaaaaaaaattcatcgccagaaaaaacatttaactctttaaaatctgtaggaatcttaagctattaagatgaccaacataaatgtcttcattttctatcaattttaaatataaattcaatatttaaacacgagggtgaactaggcatagtggcttacgcctgtaatgctacgctttgggaggccgaggtgggcagactgcttgagctcaggagttagaaacgagcttgagcaacatggcaaaacctcatctctatcaataaataagtaaataaacataagagtaaacccaaacaaacccaaacaaagtacagagattgaagattaagtgtaaataaagaaataatatatgacaaatagtaaatgtgataaaataaaaattttaaaaaaataccaaaatatcaagcttacataaagttgcaacttctcgcatagccctaaatggctgcagtaagtactggaagaacgtggttgccacggtaactaattcctggtaggcttcatcttcctcttggtaaactttcattaatgctaccatggtgttggcttttcggtgtccttgaataacctagagagcaaatgtgaataaagctcaagtcaggacagtgtaatacatacccaacaaacaaagctaaacaaaagaaaccttcatgttctcaactttcaatacatcaatttaaaatattgattaaatacgaaaatgttatcatcctccatcaaaaatgcccaataaaacaagaattgttaagaaaattatgatatatccatggcagaatattattagtgtagtcattcagcactgtgcttctgaagattgtttaataatatggagacttttggccaggcacggtggctcatgccggtaattccagcactttgggaggccaaggcgggtggatcacttgaggtcaggacttcgagaccagcctgaccaacatagagaaacactgtctgtactaaaaatacaaaattagttgggcgtggtggcgcacgcctgtaatcccagctactggggaggctgaggcaggagaatcgcttgaacccgggaggcggaggttgcggtgagccgagacagtgccattgcattccagcctgggcaacaagaatgaaactccgtttcaaaaaaaaaaagagacttttataattaaatggagaggcagagtataaaatttaatctcaactgtgcactaagtatgcagcgaaaaggacccaaaagaaggtttgaggttgtggatattttttcatttgacttttctgactgtaaaggttttgtgaggctgtattcctttttaaaagctcataagggccaggcgtggtggctcacgcctgtaaccccagcactttgggaggccacagcaggcgcatcacgaggtcaggagaacgagaccatcctggctaacacggtgaaacctgtctatactaacaatacaaaaaattagccgggcgtggtggcgggcgcctgcactcccagctactggggaggctgaggcaggaaaatggcgtgaacccgggaggcagagcttgcagtgagccaagatggcaccactgcactccagcctgggcgacagtacaagactctctcaaaaaacaaaacaaaactcaactaaacaaaatctcataaaacattacagagctgtctccaagtactttagcatgttgattctcttaatgccccaggttaatattcccatgaagtccttagcagtcaactcatttacagagcctcagctgtggttccggtctctgctggttattgcttgtgctgcagggcagaaaacaaactgaacagtgtataatctaggtggactgatttggttggaaattattttactcccacaagaagagaaataaaatcaaataatatagatttttttcaaccaatacattcttaaagtcttctatttccatccttctgcttaaggctaaagtgatctactttcagctgtattttttatccaggtaataatattatcattttttttaagtgaaagcctcactgaacaaaattaaaacacacaagcaaaagtcaaaaggcaagtggtacatttcagccttctttcttagactattcagaaaaattccagagttaaaacattcagcttcattttatatatcctagcaatgctagcaattggtctaattctagaatcaattgcttttctattctaaatataaagtaaatattaaaattatatatttggacatgttgtgaattttagcttcccctctcaacccctcatttttgagttccagataaatatgtgaactacactaacgtgaacagctagctcaacagaatgaactacattcatgctatagtaccccagagtgaacttaaatttgggaaaactaacttttctgatagcaactacagtaaaatacaccatataaatgttcgattttaaggagaaaccacctatctctgtgagaaaccaagtgtttaaaaaacaagtctgatacaaaatgataccatttttgaaactcccctgtgggttcctcatatcctaaggtgaaagttataaagttgaagatgaaaagctgactggcctgaaactcccctgtggtttcctcatattctaaagtgaaatcaacacgttaagtgggtgtgtagacatttacacataaagctcacagtacaaaaatgaccccactaacaagctccttttataaaaccattttaatttagaaagcttattctatatttagcttaggctgaattcttctcttcacctccccttcctcaaaagaatgcacagaaaaatatcattcaggttaataagagcagtgagccgagactccagcctggctctgcttagtaaactgtaggtgtggatttagaaggcatactttctcctaaacccttctatgaacatgtacttccccgtccccttaagttcagtaagtttaccactcaaataattactctctcaaactacctctttcaagcttaaaagggcactaatgcggttattctaaactgatgaataaagctcactttctaccggctttccatttgaccaagtctgtattacttaaaacaaaacaccctaactcctaaaagccatttcttcctttaaaccattttatcccacttgcgacgtccccgcagacacagacttggaattgcttacgtgtagtccgtgttattctttcctacatggatgggttgttttcagttttgcttgcagtatttctggcatttcccgttacaacatcctgctctgccagcatcttcagggcaaaggttgggggcctagcccagctcccagcggcaagtacactaggctctaacttcgcttgtcctctctgcaggccctgccgaagctcccgctggtttcccgcagcgatcccgcgcaggtgagggtactggggagcccgtggccttctccgcccgccggctcctccccatcagccgtcagccagggctctcggcgccggggaagcctcccaccgggtcccaggccacccaagcgcggtcaaacgccggcggcccggcctcgcttacctgacgcagccgcgcgtccgcctcgacccatcaggcgcgcagggcccgctcccgaaactcgcgcgggctctcgcagtcggccgcgcggccgttagccgcgaagagagcgtcgcgcacggtggcgcagccacagccgtgggccgccgcgcccaggtagcgctccagctgcccgcaaagctcctgcagtgccgcctcgccggggcccacgcgcgccggccacagcagcgcccaccgcccgagccccagacctcaggccccgccgccgcccacgtccagctccggcggcagccgtgggaagcagtgttccagaggcggccacagcgccgctagctgccggcgcgcgccgcggaaccccgcggccgagagccggccggcccagctgggcggggacacggcggcctcgggcttgtgctccagccccagccgggcccctcgcgccgctgcggctgctgcgcggtgcggtcgtgacaagtcacagcaaacttgccctccgcgccgttccaagccaccaggaagcgcaaccggtgcccctggggatcggcgaagaggccctcccggagcggcgcccagccctccaggctgtcgggctgctcgtcctccatggccgtcggcggcagcggccctagggcttggcgggcgcgggcctgacctcgtcgcaccgcctgtcaggggacagtcccaggtgaagcatttttcgctccacaattggtattttaacaatatgaatgaaaaaaaaaacctcaggtgttttgatagaaataacagacgtgcctaggaatcatcttccttgaagggagaggagggtcttattgaacttgaaaaaactaaataagcaaaattgatacataaggacacccttctctttacccttacctattcttaacaactttaattcatttctgacactgtcaccaactgaaaaacggtccaactaaaaaaaaaatcataaaggtgagaaaaattgtgacgtgttctatcctaatccaatatatctaaaccaattttactgatagagaaaatatattaagtgaatgatgtaaatacattaatataggtaacaactctttgaaagtaaagtttgcacataacatgaaatacatagagaattactgccgtctcgaaggagagaacccttgatggggagtggtagtcaaaaaggtgtacgagcaagtcatctgttgcaaggtgatgggaggagatatttttgcaggcattcaatatcagtcagaggttttaatgatttttgttttttatcttgagagttggagactagaagatctaaaataggaaaattttggcatatccatagatagaatggaagctcttcgccaaaaaataacgtgctccaagtcatgaaaaatagcacacatgcacaattaactacagagttacacaagatggtgtcttttcattcgattttatttgaactcttattcttctctatcttttacgctttgtatccttgttaattaactcttccattttttcctcatcctatgaggcactttaaacattttattcaataactcttaaggcaatttttacaattctattcacatataaaattgtcataagcatgttttgtgagtgaaaaattctaatttgtaatgcatatcaagtgaaaagcctcagttcagcactcgtcatatccaaaatctgtgttatataataatgtaaaagacatattttcacacatgtagctcaaatgagattcttacttaacatttctctctctttttttttttttttttgagatggagtctcgctctgttgcccaggctggagtgcagtggcgcaatctcagctcactgcaagctctgcctcctgggttcatgccattctcctgtttcagcctcccaagtagctgggactacaggtgcccgccaccacgcccggctaattttttgtatttttagtagagacggggtttcacagtgttagccaggatggtctcgatctcctgacctcgtgatccgcttgtctctgcctcccaaagtgctgggattacaggcgtgagccaccacgcccggcctacattttacaaaatttaactcaatcttttattttaaaaaatgtgcatatactgcctgttcaagtacttaatctttttatttattatttgaaattggaggtccatctttttagattgttagaaggtcttcacgtatttgaatgagttattaagttgatacaaccattttggaaaaataattatcattatctactacatttaaacacataatatatgaccagcagtttcaacagaaacacctggatattcatcaggatagaacggattggaaagctccatattcattcaacagggtgctacacaaaacaaaaaggaatgaatcactggtccataacataaacagatttcacaaatgtaattttgagtgaaataagccagaaaaaaataaataccgtatgcttccatttatatgaagacaaagataggcaatattaatctatggtaacatatgagactgacttctttttctcagcatcagctgagagcctgaaaaatatttttctggggtgctaaaaaagtgccagatcttaaaaatatttgtacaaaagataataatttttttatataaataggtacaaaacacaaatatgtacaaaaatgtatttataaatatgttaaacaagattactatttatacttcaatataatttttttcacttttgttgacattagtaaaccatcacacttaataaacagccatttggaattgttcttgatttaggtatttccttgattaaataccaagtaggaacataccttgattctaaaatataaagaatattattccatgaaagtttccatgaaaactatcttgcattctaaaatatttttaaaagtacttattttcaaagttcagtttcctattttaaacaaaagttgagctaaattacatataagctagtccccagaatattcagtaaatatcaaatgaaggtgtgaaagttaaagatttcaattttttactagttaatttgcagtgctctattattttgcttaataaacaattttatgctagaaataagcagatttccctattcacattatctttaccaagagcacttaaataaataccattgattacttgcaaaatacagattgtagattcagagctcaaaactaaccctctgaggatgtaattcaattaaaacaacccatagttgtgaattcacctcaccagtgtccctaagacaagaagctctttctcacatcaaagtgaattattttaattcactttggatgttaggaatatcctaactcctttgtaattaaaaaaaaaaaaacaaaacttctgatgcttctttatatcttaacaatcatgaggtctataaaaatatgaacacagaagtttgggtcagttcaatgactgaactaaaacattatttcccaacatgtccatgttgtacaagatgatggggttgttatctgtgatgccattgcaaagatcttgatggttccaaaacactaagcatcacataagccatgttatagctgtcgccccaaatttaccaaaccatttggattaaaactctcagtaaggacctctgaggcacaaagatctatgagtaactccttaacccctttgctcttactcttcaggtacaatttcaaattttcacctttccctttctgcactgaccttgggaaagtcactttatctctgtgatctaattttccacatcaataatgtatctatacttggcatagagagttatgagaataaaataataacatatatgggcaatttctgtgaataccaattgtacaggtggatttttaaataatagatttagggccgggcgcagtgactcacacctgtaataccatcactttgggaggccgaagcgggtggatcacctgaggtcaggagtttaagaccagcctgaccaacaaggtgaaataccgtctctactaaaaatacaaaaattagccaggtgtggtggcgggcacctgtagtcccagctactcaggagggtgagacaggagaattgcttgaacccacaaggcggaggttgcagtaggccgagatcacgccactgcactccagcctgggcgatgaagcgagacaccatgtaaaaaacaaacaaaccaataaatgaaatatatttaggaaaactattataagaaaaaaattgaaagcattaagaactctattatggactgaacaaaaaaaggagaattggtaccataccttggtaagtttattttaataagcccaatttctattagttcttcagtgtttcctcttgctccgtgaatgtatgttccttgcctctatcttatcccattttttctattgttaacagagagttgtcgcaagttctattctcaatgcctattgcattgggcaatagatgactctggttcccaactcagaaaaacctcatttttaagaaacgtttgagctttgactttgatctcattcagaatattttggttcaaaagttttttgtttttttgttttttttgagacggagtctcgctttgtcgcccaggctggagtgcaatggcgcgatctcggctcactgcaagctccgcctcccgggttcacgccattctcctgcatcagcctccctagtagctgggactgcaggcgtctgccaccacgcccggctaatttttttttgtatttttagtagagacagggttccaccatgttagccaggatggtctcaaatctcctgatcttgtgatccgcccgtctcggcctcccacagtgctggggttacaggtgtgagccaccacgcctggcccaagagtcttaagtttgtgtaaataagcacctttgaaaactacatctacaaatgggaatatggaataaaaaggacaagccaaaggttatggaacaaaataaaacatgaagaaagagaaatagaaacacaatattactatatacaatatagtaatatattttaaaatacaaaaaacgctagcaaaaaaagcaatatgtaaacaaaagaattggagtaaaataatagaatttgaaacagcacaatctgctgaaaatatacaaaagacaaattagggtattcctgagctcactgtttataatattagaacatgtatataaaaaggaaaagtgactttaaaatgtctgggggccaaggaatatatagtttgttacattttatttacaaacagtttctttgactagggaatcaatttaaattttctgttttggaaataatataaatatatctttattttagactttttgctgtaaagtttcttaaatatttacaactttaggataatcagtgtacatttcaatatataatgtcctaaaaatcaaacagctaccaaacattgaattgaagttctgacttatataaatcatttgcataaaaactgatcattaaaaacagtatctaatgaacattttggccccaatattaattaaaactgaaatgatagcattacaagctaaagattaatttcaatgacatgtcattcaaccattttgacataattgacttataataatctaaaattgactatttttatgacatatttgacctaaatgaagagaaaaaagctttgactcattcttaattactctttctaaccaattgatggccaataactgaaattaatttcaaaccattttttgttattttaatcttttaaacatgttttactttcagtgattcattttctaacattcatagccaaagcccaggctctacccatctttgtctaccttaatgactttgtcaattgttggcatacactgggtcttaaaaacttgtgtttcttccgaattaattaatgaagtagaattgctcttatagggtttcatataccattacctccaaaagagtacatcagaagtattagaaaatactgatatttataaacagatatttatcttatgatacaaagagctagagctgttttattttctgtaaaactaagaataacttcttgataacgtagctttacaaaaagaaaacccaacacatttccataaataattctctgaaataactatgtgagtttgtgtctttttatatacatgtagatatacatatacttacacatctatacatatatatgtaacataaaggatatgaacattaggactgtttaatgtctatttgtcttggaaagaaaaatatacttaaaaatatttcttaattgggatttgtaatcgtaccaacttaattgataaacttggcaactgcttttatgttctgtctccttccataaatttttcaaaatactaattcaacaaagaaaaagctctaattttcattggaaataatttatatacttgtttagagcagagaaaaattaagaaaaactttgaaatggtctcaaaaaattgctaaatattttcaatggaaaactaaatgttagtttagctgattgtatggggtttctgaacctttcactttttgtttgttttacctatttcacaactgtgtaaattgccaataattcctgtccatgaaaatgcaaattatccagtgtagatatatttgaccatcaccctatggatattggctagttttgcctttattaagcaaattcatttcagcctgaatgtctgcctatatattctctgctctttgtattctcctttgaacccgttaaaacatcctgtggcactcttatttattaatcagttaaataaaatcatgaacatatattcattttacatttgtatgagaaccattatttttcttttctttaaaaaaattaattatcctttgacattgggttgacattttcttaagacatgccataaacagaggatatcaagtttctcaatgtcagttctagaggaaaaaaaattccttataaaaatttaacctcatgtgtaacagtttccattcccatagcaatgacatttgatatacattgtatatattaatctgggaatgatgtaaggttccaagtataattttatcagtgaactcaactacttgattactttcacttatttaaatatctagttcaatgttgtccagtggcattgtggatttaggtaattttaccaggcagccgttcaatttctgcactttctatttgcccatgcagaacataacacattttataagtcaaggtataggcatctggtggcataattttaatttgttatcaaataaaagcctcatcaaatttgtctagaaaataactcattatttactttattttaggactgtatcactatgtaatgagatacaaatatatgtaaatgtaagtgcctaagaggcatgcagagagcctaagatgtatgcagtatgcctaacaggaatgcagagagcttcattttcattgtcagctgctcagttgtttctcaggaaagaaatgtggccaacggacaccatttaagagatatatagcaacaagttcagaaaattctcataaatgggagtggctaatgcatagacaatagcattgacctttgatccatatatatatatatataaaatatacctcaaatacatttggatcaatttaattgtgagtgctataaactacaaatgaaagtaaaaaagcaaacctgttggtattttagaagaatgaaagattattaactcatggcctgtatgtgtttggaatgagaaggacgtacatagctttctttggacggggtggaattgaaattgtgatttacagtgactaaaacctgactgctttcacatttttttttcactgttgggggtgaaattcttgattgatttgtgcattgggaactttttttttttttttggagacagagtctcgctttgtagccaaggctggagtgcagtggcgggatctcggctcactgcaaactccaccttctgggttcacaccatcctcctgcctcagcctcccaagtagctgggactacaagcgggcgccaccacgcctggcaaattttttgtatttttagtagagacggggtttcaccgtgttagccaggatggccaggatggtctcaacctcctgaccctgtgatccacctgccttggccttccaaagtgctgggattacaggtgtgcgcctgcctgagccactgtgcctggatagagaatgactccttatgtgacatgcagaaaatattttgtgtcattcgtggtacatttatcatattttctataggtttgtactatgttgctccacttcttagaattccaagtagttcaaagccagcagggactggtatattatagcatatttaacctaagcaactctaaaagctaacgaaaccaagtatctacaaactttagccatagctaccatcaacatgaagaatgtaataggcaaaatgttttacatgctgaatatgcactactgaattctgtatatattttttgcagtttcaatttaaaagtatactagttagatatttcatctataccctggtatagtaataaaaattcagatactgctcaacgaggaagcacattttcaaagcaacagacctgaaaactagtattttatttgatattttaaatgcttatttcattttctggttaaagatgtttgtgaaggtaaaatttaaaatagatactttatgttattctagtatataacattgaaattaaatttttagtaaatgtagaaaaggaaagtctgaagcattgactgagaaagatttagtaaatggagaattttgactattaaacatcccattttaacaaaaatatgcataaaatattcttaggatgatttaattaaccttttaataaatacgaaagacattatgaaaaaattaaagaatacatcacattgcagaatcaaaagtaataaaaatcactcaaattctactgctcagaaatgaaaataattgctgaacattaggtggcagtatttcagacattcctatataaatatacttgaatgaggcccagagcagtggctcacgcctgtaatcccagcacttttggaggccgaggcgggcggatcaggaggtcaggagatcgagatcatcctggctaacacagtgaaaccccgtctctactaaaaatacaaaaaaattagccgggcttggtggcaggcgcctgtagtcccagctactcgggaggctgaggcaggataatggcatgaaccccggaggcggagcctgcagtgagtggagatcccgccactgcactccatcctgggcgaaagagcaagactccgtctcaaaataaaaatataaataaataaatacacacatgcattcttcatttataaaatacatttaatatttttaaataaataaaagtcaaaataaaactgataaaatgactgtagttatttgtatgaatatatgcatgtgtgtacagatgcattaagaaatcttaatcttcaaaatgatgaacattttagaagaaatactaagaataatgagtttgggatctgtatcatgctctctttttctgtttttttgagacggagtctcgctctgtcgcccaggctggagtgcagtggcacgatgtcagctcactgcaagctccgcctgccgggttcacgccattctcctgcctcagcctcccgggtaggtgggagggactacaggcgcccgccaccacgcccggctaatttttcgtatttttagtagagacggggtttcaccgtgttagccaggatggtctcaatgtcctgaccttgtgatctgcccgcctcggcttcccagagtgctgggattacaggctgagccaccgcgccctgccctgggatctgtatctttctaagtaggtgattcagtatctaatgagaaaattatcacttaaaaattcaaaatgttttagtttgttgttattattattattatttgtattatttttaaagatggggtcttcttatggtgcccaggctaatcttgttaatatttttatattgtcatggtgtcttaggcagctcaagctgccgtaacagaataccagagactggtgtcttaagcagacatttatttctcacagttttggaggctgggaaatcctccacaaggtgccggcagattcagtccctggtgaaagcccccttcctagactacaggctcctgccttctgacaatgtcttcacatggcacaaaatagagaaagacagagagctgtggtctcagtttctcttcctataagaacactaatcccatcatggagatgcacatgatcttaaccagataaattttttttggatattttgaactgatcaaataactcacattgattcaaaatatcacagttattaaaactcaggcacaaaatcaagttagttcatcagtaattgaggcagataattttaaatcaaaatatagctacacaaaacaccatttcctaattatcttagactttaaaagtagttagaggaagagaaagctcatctctgtattacagtataacgggtttcccatcctaggtgtcttaatctatttgaacagctataacaaaataccataaattggtagattataggtaatagaaatttgttgttcacagttctggagggcgggaagtcctagatcaaagtgccgtaagatttggtgaggacctgcttcttgattcatgaattgccatctcttccctgcatcctcacttggtgaaaggggcaggagtctctcgggactcttttataagtgcactaatcccattcatgagggctctaccgtcatgatctaatcccctccctctaaggccccacctgcaaatatcatcatatgggtgttacttttcaacagctgaattgtggggggcaccatcattcagcgtacagcactgtgaaatccctaatatcgggttttctttttattttattttatttttgagatggagtctcgctctctcacccaggctggagtgcagttgtgtgatctcggctcactgcaagctccgcctcccgggttcacgccattctcctgcctcagcctctggagtagctgggactacaggcgcccgctaccacgcccggctaatattttttgtatttttagtagagatcaccgcacctggcccctagatgaatatttgaataaaagttgtatgtatgatgataaaacaacaagaaactgaatttttgcagaaagtaaaaataaaacttgtcactctttatataggcaaatcagagactatacttgaggttttagaaaagacatcagtatgttccatataaagcatgtactgggaccccgtcagtctttttcaccatataatatcagtgtttttaatagtacctgggatggctgggcgtggtggcttacgccgtaatcccagcactttggaaggccgaggagggaggatcacgaggtcaggagatcgaaaccatcctgcctaatacggtgaaactccgtctctactaaaaataacaaaaaaattagccgggcgtggtggcgggcgcctgtagtcccagctactccggaggctgaggccggagaaaggcgtgaacccgggaggcggagcttgcagtgagcggacatcgtgccactgcactccagccagggcgacagagcaagactccatctcaaaaaaaaaaaaaaaaaaaaaaaaaaaaagtacctgggacatgatatgaactcaatgactatttattgaatgaattacttgaacaagtttatgcaagaaattgacataaaattaaacattgtctccttataccatatagtgtctacaaaaactaagttgatacagaacctgtattctaacatgattaaatttgagccaagtacatttctctcttaagaatttataagtttataaagaaatcagggcctgggaactgaatcattaatgaaagatctcaaaggcaatattcttttcattgtaattaatattaagtcgttaaagtaataataaataactaacatttaggttcctgaaaaaaatggttaaattgaacatcaaatagtttgcatttatatcacactgtacaatttatattttttatgctgctttactgtaagatttcattgaacaaatgcatcttatgatttcaaggtaaggtattcaaatatgcctttttaaaatgtaatgctgtattagtgattttaaaatatgtaaaaaaaatgtgtgggaaatactagaaatgttatttgaaattaaccaattctgggtttgcttattttttttttttattttatttgccaaactgagaacaacagcctttacacattttctatttttctggacttgattcttaggaactttaattttgcacttttgcattcctctataaatgttaatgtcttagccaatgacatttttctagataaattcaaaagcttaacctaagtaatgtaatggtggcatttatgaaattgactcctggttctctctttaaattctttttattgtttatttctatggcaccattacactatgctatcacattgttcttgttttattccccatgtttaaaaagctgtatattctttgctgaatcttaaaggtcactttgaaacctcaagaccatgactgaaatacagtgaagattaaagataaaaaggagaaaaaaggttaaattataaaacctctaatatcattactcatatatatgatatacacagagatgcatcacctaggtcctccctgagagctgtgtcagtagacaggactcagctgtgagccccttcagacgtcacctcagctgcagagcttccccctgcctaaggtcctgaggttcccagttgtggtgcatatgcaatgactgattgaggtgaggcaaggaggcaggtgaaagaggtggggaggggacttggggcctataaagactcagtcatgtcattgcaatgtgaaaggatgccagtgggccattttatcttcaaagtcccctgtgagatgagccaaagctgtggtccaggacttcttttcagcccagctttttccctttccctcaatccagcttccttcttctccttttcacagtgccttggattcaagggcactccctagtatatatctccatgtccaagtctgcttactagagaacattgtatcatgaatgataccattcttcaaaaatatggggtactttgagtgaaaggagtggaacggtatagaagaacagctttggtagagtagttagaatagaagctactctacattgggttgatgcatgaatgggatattaggaagtaaagtagcaaattgaaaactcctttcgaaagaagagagttagaaaagggtcagcaagatagtaattggggcctggctgtgatggatcacgcctgtaatcccagcactttgggaggctaagatgggaggatcacttgaggtcaggatttcaagaccagcctggtcaatgtagcgagaccccatctctttaaaaaaatgtagttggaagctagagaatagcataacaaaaaagagggtgattttagaagacaaaagggcccactggagctctctcacattggagtgaaattctgaaattaccctctttttggttatgtcattctacctcaatcattttgcctcaatcatgtttacaggcaaaataagagatagagaagtggaaagggctgaaggcagagatacgagacacaataacaaatggggaaagatacaagatacaatgaaaggcatgagctagatcaattctacaagtgaaaaattatgcaagtgaaaaaattacaaggtgagaggaaggatgactcatcacccaattataggtaagtttataggagggtgggactggctacataaaggtagatgatactttatgtccttattttcattaaagagaatatgtcatttcctgaaaatgaaagatgtgggtgtgaatagagagttggcaaaatttggtatttatttgaaatcggcatttatttgggaagataatgtagggtaactaatccacttagatgataaatacttattaactataaactgtgtaccaggtactttgctataatataaaggcaatggaaaaaccaagattcagtcttgatttgacatccttaacatttacagtgtcgtggtggaaactatgtaaagaatccagtgtgatagaaggtggtagatgtggaaacaggaggtttagaaaaagctccaggacacattgctgacacatctaactcaggatcagggcatttaagaaagcatcacactctccctcaatctctctattctgtctttccatggaatccttttaacaaagtatcaagatggccctcagcactaaggaagaagtgttatttgaaagcatgtttttgaatagttgcatttatctaaacagaatttttcactcctgtgtggattttgcttggaattggtatattctggcattccatgttgtaaagcacttgaggtgcttaagagatatttggttggccgggtgcagtggccgaggtggttggatcacctgaggtcaggagttcgagaccagcctggccaacatggtgaaactctgtctctacttaaaatacaaaacttagctgggcatgttggcaggtgcctgtaatcccagctacttgggaggctgaggcgggataattgtttgaacctgggaggcagaggttgcagtgagccaagattgcaccactgcactccagcctagggaacagagcaagactccgtctcaaaagaaaaaaaaaaagaaggagagatatttggtaaataactgaggcaaaggtggaagaaaatagtgttctacaggaggtgaaataatgtgtgaagagaaaataaaaattttaaagaactaaaagaatcaggtattgaagtcaaaggtgagagggccactgaaattcaaaaatacaatgtgaataactacagaagatgtcatcattcctgatgaggcaatgaatgtgggtgcctaaattagagtagaaatacatgttattgaagataaggagatcaaaaggtgtaaggccagggtgttgaatgtattttgcacaaatgcgctaacgttacccagaatgttggcagggggaaaaacatctgatggcctgtagccagagttttccttaaaaacgcagacgtgtcctcctggaaaacagacatctttgaaaaaatgaaggaaattagggtctcacagcatgactctcatggagatggtgaaggactgatttgagagcagccacgcagagttaggacaatgccagcaacatctgacccatgtacatgaagctccagataacttaggtgattgctttaatgcaaaaggccacacagtgtgaattcgtgagagactatcttttatattccagaggttggaatggaataattcactcatttgaaaggcttgctggatatcctctatttcagggctctccaaacccatactagtccatggctgttaggaactgggctccacagcaggaggtgagtggcggctgagtgagcgaagcttcatctgtatttacagctgctcctcatggctcatgttaccccctgagctcctcctcctgtcagatcagcagcagcgttagattctcacaggagcatgaaccctattgtgaactaagcatgcaagggatctaggttgtgtgctccttatgagaatctaatgactgatgatctgtcactgtctcccattgcccccagctgggaacatctagttgcaggaaaacaagctcagggctcccagggattctacattatggtcagtcgtataactatttcattatatgttacaaagtaatactaatagaaataaagtgcacaataaatgtaatgggcttgaatcattctgaaaccatccccaccaccaccagctctgtgaaaaaaattgtcttccacaaaaccagtccttgatgccaaaaaggttggggaccactgctctatttctcttcactgcttagagaatctgttcttccactcatgatctacaaggattaaatgtttcaaacagttcaagtcttcaaaatatgttttttgtaaacttgagtttttagaaatcattcacagtatccatattatattttatttgctgcaatgccctatacatttcccatataatgctcttgaatatacttttacaacttcagtaactttaccctttactgaatctcaatctgtctctcaatttctctctctcagcaaatctaaacaaaagagaaacatattgacttgtgctatggtctaaatgtttgtgtctctaaaattcatgtgttgaaacttaatctccaatgcaatagtattaagagatgaaggctttggaatgtgactggcagagccctcatgaatgggattggtgccttcataaaagaggcctccaaaatctccctagccccttccaccaagtaaggacgcacagaagtcaccatctatgaagtagagagcaagctctcgccagataccaaatctgctgacacttcagtcttaaactcccaccctccagaactgtgagcaataaatttctgttttatagttgtctaaattatcctgtctaaggtgtttttttatagtaatgtgaatggactaagacaacttgaaaatgcaaggtaccacaccaataacaaggaaaatactcatgttttgtaacatttattttataccaaagatatgccaattactgtatacaaatatatgccaaatgttgggtaaaatactttacataaattatattaatcctgaaaacaacctgaaggtagatactgttgtctgcatttaaagatgaggacgtggggcttgaattaagtaacttacctcacatctcatcatgctaaatggcaaagctgggattcaaaccctgctcagtcggactcccatcaggctgctcttagcctggttatattttgaagaaaagaagttcagaaacttatccatagacatggccaggtagggccagagtccagactcaactgactctcagccaagaccagcctcaactcttccattttacctccagcctgaacagcttaaacattttttctcttgccatcttattagaatacataatgcctataatgatgggatccaaatgatatagcatgacaacactctggtttaaaaaaggtgaaatgtaatttttttttttaattttaagttctgggatacatgtgcaggacgtgcaggtttgttacataggtaaacgtgtgtcatggtggtttgctacccctatcaacctatcacctaggttttaaggcccccatgcactagctatttatcctgatgctctccttccccccagccccccagtaggtcccagtgtgttttgttcccctccctgtgtgcttgtgttctcattattcagcttccacttagaagtgagaacatgcggtgtttggttttctgttcctgtgttagtttgctaaggacaatggcttccagctccatctatgtccctgcaaaggatatgatcttgctcctttctatgactgcatagtattccatggtgtataggtaccacattttctttttctagtctatcattgatgggcatttgggttgattccatgtctgtgctattgtgaatagtgaagcaaaaaacagatgcaataggaatgcttttacactgttggtgggaatgtaaattagttcaaccattgtggaagacagtgtggcaattcctaaaagacctagaaccagaattgccatttcacccagcaatctcatttctgggtatatactcataggaatataaatcattctattataatgaaacataatgtaaaaatacctcgagtgtatttgtattttggtaatatctgaataagacataaaatataatgcacacatctttatatcgttttatccatatctctctttctttaaatccttctggttaaaatttgtcattgcctcctgactatgtatatattttttcttttctggaagaaagctcacctaggccttactcaaatgcatgttctcaatctttacctaccacccctcctgcctttttgttccagtttcctcttatcattgtactgatgtggagatacgaaagagaatatcactgtcagccaccagcagtgccttttcagagaagagcaatggggaagaaattgagcagacaaagccagaatccccattagcaaacagaaagagggagctcaggataaccacatacattaataattcttgccccgcaaagggaagctctgtaaaataagttgtattacatctgtacatagcagtactttaaatataactctagcttaagtattttaagcatctccgtgatatgaacctaagggaataaactcaataaatcaatatttataagctctgttcacttatgtcttgtggtttcagccactgatttcagaatatgcatgaaaaatatatttcttctgaatatttgatttcatgatcccaagtagacacatctctgtattgggtttcaacaagtccacaaaagttaaatacctacttttagccagctttgattttcagaagtttaattctgacatttagtgatatacaatatgtaaaacaacctggcactatatctgttatatcataagtacttggcaaatatttcagtttactctttctcataattgaataatggctcaatagtaaaactctgtagggaaaaatttaacctcttatttatcaattacaaatagtttaagacagataatacccctttccttgttagctttaatgctgaatcattaaaattgtgagcaatgtatttattttgaggaaactattttttactaaggattttgttttttttttagaattttatgagtcttcaaaataactagaaaatcttaaagtgttaccaaacagaagtggacatttaataaacacctcaactttaatacttacagaaaatcatttgaaggctgtcactcctctgggtattataaattttagccttggtcaaatcaaatcaccaggaggctacaaacttgaactacactgccttagtctccaacagtttctttccttgaattaagttttcgggccatgctctactccttttaataaaagaacaatacaacaaatagtcatatgaaatccattttgttgcctaatacaaaaatattgttgaagagtatcataattcaatggcccatatatataaaatgtctcagcaaatgcacttatgtcataattcagtactaggaaatgatttccttcaggcaagctcccccttaattttttttttttttttttgagacggagtcttgctctattgcccaggctggagtgcagtggcaccatcctggctcactgcaagctccaccacctgggttcacgccattgtcctgcctcagtctcctgagtagctgggactacaggcgcccgccaccacgcccggctaattttttgtatttttagtagagacagggtttcaccgtgtaagccaggatggtctcgatctcctgacctcgtgatccgcccgccttggcctcccagagtgctgggattacaggcgtgagccaccgtgcccggcccctccccattaattaaggtgagaaatgcataaatgatgatggtagtcattggtgcaccagttacgaaagagtgaggccgggtaactggatgacacctgcacagggctctgaggtctcaaggaaaatgacaggtgtttgtgtattccaaaaatgtggacatgatggcatgaggcccaatgaagaaggggtagattatgaatggtgttatcctgaacataaggagactaagatagtgtagttttaaaaatggcagcatgaaaaaaggtgaatgctaaccccaccccaccttatggtaagtgtctgaagaataatctttctagggactactagtgggtattcttaaaggacagaggcagctttctgtttgagtaggaaggtattggaagcagtatatgaaggaataaaaatataaaagagagaaatattggagcaagagtgggaagtatggttaaagataaagaaacggcagggcactttagggaaatatggtatgagacggaaaagacgcatttttgagtgatgaaaatactaatcatggctaacacttacatagcatttatcttatgtcaagcatttacgtgtgttaactgttatgatgctcacattaaccccaggaggtcaggcctatcactttacaggaagtttaagcaacttctgaaatattaacaattcttctgaattgcttctctggtgacaggaataagagtcgcagtagcatcaacttgctaaaaagtttaaaatggtgctcagaataaaggtattttactgctttttgagactcattgtaaaatggcttgaaatgtctttgccctgaatctctgccagtgggaaattggatgagttgctaaagaatatggaattaattatccaaaaacactttagatatttctctttgtatagggtattgtaaatggtctttagctaattataatttaatatctcatttgtctctctcatacataggtatatatgatatatacacgtgtatgtgtacaattcaatacatctatgtgtctatgtagctacctatgtatgcatgaatgtatgtatgtatctgcctatctattaatctatctctatgtatctacctacctatctatatctgtgtctatcaacttcaggaatgcttggcattcttctaacctctgcggggtatttagggattaggcgatgatgatagatttccagcttcatttctttttaaaatcttttattcttcttgctcattttccttttcctgtccctaaaggacagtttctcctcaatttaggacttcttccttttgctctcttatcatttgcacactttctgttctcagccagaacatcccttttgtgcactgtacaacctgttgacactgtcacagttgccacttgatcattgcagataaaggaggaagtagcaattctggaatgggtggcttatctcttggctttataactggatatcttcatctgccattcagtcactcttttttattatggagacatgttttctgggaaaatgctaccatgaagcaggaccaatctccagttcaaggcacctcttgatttgctcattccaaagcatcccctcttaggaattagggctcagatcatggggtcatctattctgtaagtaaaaggctgacaaaaagtctgttacttcactgctctttacattattagggtaatattaacaatggaaatccagtttgttcaataaaacaagtgtcgatgaagagtcaaactcggtaaaatattttaagagacttattctgagccaaatatgagtgaccatggcacatgacacagccctaaggagatcctgagaacacgtgcccaaggtggtcagggtgcaggttagttttatacattttagggagacatgagacatcaatcaaatacatttaagaaacacattggtttggttcagaaaggcggaacaatttaaagcagggattggggggggctttcaggctataggtaaatttaaacattttccaattgacaattggtttagtattttccaattgacaattggtttagtttgtctaaaaacctgggatcaaaggaaaggatatgttcaggttaagctaaaagattgtggataccaaggttcttctgaagtcttatagtggctgcccttagagataatagatgacaaatatttcctattcagacctttaaaaggtgcttgacttttactaatttcttcaggattgggagggcttggaaggaaaagatctagttatgtcaatagagattctttacagatgcatatgtcccccaacaaagggcagttttgcaggaccatttcaaaatatggcaaagaaacttgcttttgggataaaattttttttactttcttctttgtcacataatgttatgccagagtcagattgcaaagtaagccatgatatatagggttaaataaaatccatctgatgagaatttatggttagtaggggatgactccccagaccccttagataggaatttgggcaaaataaaaaaatcagagcttagtcttcacaagttattgaaaaacaatgagttaccaattttatttatttatattctttcagtggtcttcaacaggtggctcatgaattcacatatttgacaattttaatgtgaaataaatttaagatatttcaacaacaatcatataggaaaagatagataaataagaaactataaaaattatactttcaaacctttccctatctaagacacagggtttatctgatctcacatagatattggacatacgatttaatttttaaaattaatttttctcactttagaaaattggcatcttgaggccgggcgcagtggctcacacctgtaatcccagcactatgggaggccaaggcaggcggatcacgagatcaggagatcaagaccatcctggctaacgcggtgaaaccctatctctactaaaaatacaaaaaattagccaggcgtggtggtgggcgcctgtagtcccagctactagggaggctgaggcaggagaatggcgtgaacccaggaggcggagcttgcagtgagcggagatcgtgctactgcactccagcctgggcaacagagcgagattctgtctcaaaaaaaaaaaaaagaagaaaagaaaattggcatcttgaaacaaaagaaagtgtctgctttccccttaaagaatcataaagaaatataatcaattagactcagatagcctagaatttaaagcttaatcaattttattgattggcttcaagaattttattgaaatgtcatatatttataaattaagactaagatgatacatatactatctactgattttaaaatacaacaaatcatttaactaaataaaattaaagattgtagtcttttaaacttaccaaccagaaataataagccagtgaaataaaagatgttccaatagagaaatcctttgtcattatatgacatacattttaatatgttacacagataatctgtgtatttaaaattgaatgataaaaattatttgcaacatttaactgaaaaatttttattcagaatttatcttgagacttgacatgtattaatataattaatgtaccttataagtaaatattgattatattaaatttttagaattgggtcgaatgtgtatctcctctcctctgataacttagttcattctatgaaatggtgctagagactaagaaatacagaggttctgttatcaagtgtcatgaacatcaagtgcctttttctccactaatgttagaatgcctctccaattatcctctttagtaaactgtgagctgaaaatagtgaagtctgatattgcaagcaatgtctccagtataaagtttgcttgagatgagaatcttatctaagaacatttttcttgtcacataaagtatgtcacacggtggcatattcccacttaaagttaacgtgtactaatataaaggcctcagcggaatgtattaagtggatttcttttggcattgggtaaaggaatctttcaaggattctgtggatatacaaacaagaaacaaatttcaaaagaggcatatgcacaaaatttttataacctgttagaatcatgatctggactaaacacaaataagtgaaccgaagtacaacacaatacaaagcaaaaataaaaaataaacaggaaatttaattctatacgatgcagaaactatgtgccaatactcagtgtaaacatacactattaggaggacgttgctgccacacaagcagatggcagagtttaagcaaagctgaagaagttaggtagtggcgtgcggagggatcactttgattattggcgtagttcctaccctcctattattctggttaccatacattagtgaggtgtctccaatgggtttcgagggttacaaataccttcctgcatattagtctaccttccttagaacttcttaagatgggccattgtctcgtgatactcaataattcaggaaaatcaataattgggattaaaataaaccaattaattacatacttctttatcacagtgtgacataaacatacattttcagacaagttttcattactgggcaactatgatatctacccaatgttgtggccaaagttggaatattcacagttcccccatacttatgccctccgtgttttggttttccagatacatgctgttgcttgtacttcaaatacactttccctatatctctgtcaattcacgtctttctcaaaaagaacagagaagtcaaatggctcctctactaaacctctaaacatatatgatttctcctgtcttgacatttttaccaattcctgttctcattataagctatggtatccgactttcacttctcttcctctaacacccctggctttcttaccccattgtctacatagctcaacttcttgcaagttgtccattcttgctctctcctctgtctacagcgatttgccttctgctcccactgttcacaaaacttctgtcctccatgtattcatttacaatgttttagccttgggctgaccatacaccagctgttcacaaaatttatgttgaactgaatgacactcgaatcaataaatacaggaaaaaaggggaacagaaggggaagcaaacaacatccttcttcacatgatggcagaaggagaaatacagagcaaagagagaaaagacccatataaaaccatcagatctcacgagaactcactatcacgagagcagcagcatgggggtaacagcccccatgattcagttacctcccactgggtccctcccacgacacatggggattacggtaactacaattcaagatgtgattagggtggggacacagccaaactagatcagtgctgcaactgacttcactgtaaatgagtttacaatgggtaactccatattatctgaaccaaacagcatagagagacctcaagaagagtaaagaaatctttgtctcacgtacatggtataccatcaataatgaaactgaggaagattcacggagggaagtcaccaccctgcagcaggcaattatatctaaaccagtgagatatgaacagtgcaaagaagaactagaacaaagatactgtctggcatagaaagtccagtattaaagacacagaaggccctacatttgtccagtaaagccatgcttgattaatgccttggaaaccctggagactggatcagaaatctgtatataaaatggttcttcctggataaagttgagagaaaaagaaagcttattgtgttcaagtagaaactgggataagctgtgggccatctggcttttctgttgcaaaaaccagggcttaaatctacatctttctatagtcatgaatgagcaaactgatgttgaacaatcatctaacaacgaaatatttaggattcaaaaagaatgtacttatgaaaagaatgtaacacaagaaatctgaaaattagaaaatttcccctttttacactaaaaaagacagaagagccatgactttttaaaaaactggagcagtaagcttgtagtgggaaaagtgatggtgagaaatgcaggcatagaaaggaagcaggtttaagtaagaagagaaaacacaaggaaatccaaaatcccaaataaaataattttgccttaaattttattatgtttaatagtagactgctgttttcttttgtcaattgctgtcagataagttttgctcttttgatttattttaaaagtaacattaactcttggttgggcatagtggttcatgcctgtaatcccagcactttgggaggccgaggtgggcagatcgcttgaggccaggaattcaagaccagtctggccaacatagaggaaccctgtctactacaaaataaaaaaaattagtcggctatggtggcacatgcctgtaatcccaactactcaggaggctgaggcacgagaatcacttaagcgtgggaggtgggggttgcaatgacatcaccacagcctgggcaacagggggagactgtctcaaaaaaaaaaaaaattagtggccgagcatggtggcttatgtctgtaatctcagcactctgggaggctgaaatgggtggatcacaaggtcaggagttcaagaccagcctggccaatatggtgaaaccccatcactactaaaaatacaaaaattagctgggcatggtggtgaatgcctgtagtcccagatacttgggaaactgaggcagaagactcgctcgaacccaggagacggaggttgcagtgagccgagatcgcaccactgcactccagcctgggcacagacagagagtccgttacaaaaaaaataataataataaaaataaaattagcaaaaaattagccaaaaattctttaaaaataaatataaatatatttatatatacattttattcattcattttatatacattttattcattcattaataaaatcactttattaatcattcaataaaatgaattcattatatataatgaatgaataaaacgtatttttccattagggatttaaaaggagcattggataaattaaaaattttttttgtcttttcttttgaaaaaaatataaatttaatgatgtatttttggactttgattaaaaataattcaattttatctgtcagcataaatattagaaatactcagagaaatttagcagaaggataagcatcattttgtaatgacaataattaagtagggctgcataagtggaagaatggacatataaatgccttttttttttttttttgagacggagtcttcgctgtgtcgcccaggctggagtgcagaggtgctatctatgctcactgtaagctccgcctcccgggttcacctcattcttctgcctcagcctccggactggctggtactacaggtgcccaccggctgattttttgtatttttttagtagagatgggatttcacagtgttacccaggatggtcttaatctcctgacctcgtgatccgcccgcgtcggcctccaaaattgctgggattacaggcgtgagccaccgcgcctagccagattttttttttttttcagaggctccctctgtagcccaagctggagtgtagtggcgcgatctcggctcactgcagcctccgcctcccgggttcaagcaattctcctgcctcggcctcctaagtagctgggactacaggcacgcaccactacgcctgtctaatttttgtatttttaatagagacagggtttcaccatgttggcctaggatggtcttgatctgacttcgtcatctgcccgcctctgcctctcaaagtgctgggattacaggcacgagccaccgcagccggccgacagactttatttcatctgtaaagttctataatgtcattcacaataaaataaaaagatattatgcaaaccaaacaaaattttgcaagatatgtgatacactatacatagaaaattcttgcatatcagtaagaaaataactataaatagataaaatccatgaatagtaacaaaagtataggatattagagaaaaagtatttgacagaatgaaagaaaaaaatggttgttttaggatcagtggtctgagatgcattcatgtgttacttcattagcttgtatgtatttaatatattctatatgtgttcaacaattgatgcagattcaaaaacaaaaaaaagttcctttagtaaggagatacacaacaacaaaaatttcctataaaagtggattacaataatgaaagtatctagaaatctaattttaaaaagtggtactcattatctgggatcatctgggaagaactcatttaacagaccatttgcgtagacacttgaggatgaagataaattttcaggcagattaataacaatggggagagttttcaaggcagaggagatgacttttataaaacgaggaaagcatgaagtttatatagcttgaaaagtgtgttgtattcaggtagtaatgcactgactccatcactcttgcattttgtttgtttgttttgaggcggagtctcgccctgtcgcccagactggagtgcagtggcgcgatctcggctcactgcaagctccgcctcccgggttcacgccattctcctgcctcagcctccagagtagctgggactacaggcgcccgccaccacgcctggctaatttttttgtatttttcttagtagagacggggtttcaccgtgttagccaggatggtcttgatctcctgacttcgtgatctgcccgcctcggcctcccaaagtgctgggattacaggcgtgagcccccgcgcccggccacactcttgcattttttattgtaggctctgaggaaaggtctgcttccacgtgtgttcagattgttatacacacttagttccttgagtgggtattattgcagtccccatttccttgctggccgtcagctgggaccagcctttcctcctagagactgtccctgttccttcttatgcttttttcatgggcctttccagcagcacgaacatttcaaatatctctgcctttccctcctgccccgtctctcagaaatcaactgcacatggtctcagcttttaagggctcatagtgattagattggactcatatacggtcctcattttaatattcataattctaactgcaaagtctcttttgtcaggtaatacagaatattcaggtctcaaggattaaagtgtgagcatctttgggggtttttattctgcttacaacatttacctagagtataaattcaagacataaggcagaatcttatgagaaaaagaaagtactattttgaacatacctgtggcaatcctaaatgggaattagattcagatttggcagttcttgataaaagtcaaggctgaagaaataatttggtagtcatcatgttatacattttgtaaatgaagccattattatatatgagagggttagcattcacccagggagacttcaagtcagtttacaaagttaatattctatggcacgttcaatagtagcaccaccttttattcaattggatagtagcctggggtgaagattaaaaagaaagaaatataactatctctatatggagatgccatgaggtataaagaatttgtatatagatatacatggaaaaatatttatgcatacaggaaatcctaaggaatccacacacgcacgcacacacgcacgcacacatgcacacattaagatgataaagctgtgatatttttaggcataactttgtagtaagatgttacatcaggaacaggaaactactatagcaaagcacccagaatggtctaaatagtcttgaaacagaaaattttctaccaaactgtattaattcggtgttgcattagcataaagatagacatataaatttaatgaaataatattgagcattaatcaataaaccttatatttatgagcaattgatttttaaaaggatgccaagaaaattcaaaggggaaatagtagtcttgtcaacaaatagtgttgggacaactgtacatatgcatgcaaacaaacgaagttggattctgaccttaccttacacacaaagttgatcaaaacctaaatgtaagacctagaagtaaaaaactcatagaagaaaacataagcaaaatcttcatgaccttagattaaacaatggtttcttagatatagcaccaaattacaagcaacaaaagaaaaaaaagggggctatattatgcttaattaaaactaaattttttcttcaaaagaaaaagccaaggaagtgaaaagacaacctacagaatgggagaacaattttgcaaatcatacatcttctaaaagacttgtattcagaatatgtatcttacaactcaataataaaaaaacatataacctatttttaaaatggagaaatgatttgagtagaaaattctccaaaaaagatacacaataggcaagaagcacatgaaaagatactcaacattattggtcatttgagaaatgtgaatcaaaaccaccaggagataccatttcatactatgatcaaaaagaaaataacaaatatgtttgagaatgtggaaacaatcccacataaattgctggtgggaacgcaaaacgatgcagccatggtaggaacaattttgcagttgcactttgggaggccaaggtgggaggatcacctgaggtcaagagtttgagtccagcctggccaacacagtgaaaacccatctctactaaaaacacaaaaattacccaggcgtggtggcaggcacctgtaattccagctactcatgaggctgaggcaggagaattgctcgaacctaggaggcggaggttgcagtgagctgagaccacgccactgcactccagcctgggcgacagagtgagactctgtctcagaaaaaaaaagaaaaagaaagaaagaaaagaaaaaaaagttaaacagtgttatcaaatgactggacaattctactccttaggaatatctcccaaagaatgaaaaacatgtctacaaagaacctggacacaaatgtttatagcaacattatttgtaatggccataaagacaatgcaaatgtccatcaattgatgaatggataatcaaaaagtggtatatccatacaatggaatataatttagccataaaaggaatgaactactgatacatgatacaggtatgaatcatgaaaacattaagtgaaaaatgccagacacaaaatgtcacatattctataatcctacttatatgaaatgcccagaaaaagcaaatctatagagacagaaggtagatcagtgattgccaggggctagagagaagagcaaacaaggactggctaataagagacacaggatttttttgttgttgttcagtgatgaaattattctggaatttgcaatgattataccataaccttctgaatatactaatcactgagctgcatccttgttaaggacaaatattatggtgtatgaattatatcttaattttaaaaagtacagtaaagtaaaaaccaattgtgtttcaataataaaatattattttaatatcactatattaacaatatggaagaaaatctcatctcaatggatgcagaatatattttttaatattgcaaacaatagaatggaatgtatttaatctggtgaaagataatcataaaatcttacaaaaatattataattaataaggaaatatggaaagctttccttatgggatcagaaaaaaaattccctagtcagttcaataagaaaaaaaaagtaagaattagcaagaaagaaatacacaggtcattatttgctaaggacattattgtatatgtagaatatctaaaataaaatattagaacgaataactaaatatagctatcaggatcactggttacaatatgagcacataaaagtctattttatttccttacactaccaataaccaattacaaaataaaattttataaatatatcatttagaatcaatattttgttaacttcataaaattaactggaaagtttttctttttaaatatattttcaaaaattgaagaattcttcaagtcagttaaatggttttaaatatttctggcctgcaacaacaaggttaaatctgcatgtgataatggatctctctactgatattagagctatcccattattgaaaaccatttttagatataaatggcaggcacctaagaatgacttaatttcctgtggtgttcctttaaaacaattttccaaaacaggcaaatcttgctctctccctctctctttctctttaaaaagtaacacaggcttatttttaaagttgcaatcaaaacagacaggtaaaaagtagaaaattaaaatgacccatcaggcttgtcttaaaattaactactgataatattttggtatatgtcctcatatgttttagtgtattttttcaggtttgttctatcaaaacctaatttaacaaaatctgagcaaatcatccacttcctttcctaatatccttttatactgtgtgtttatacatgtggttatgaatatatgttcacaagtgagggtatatatacacatacacacatacatgtgtgagatagagacataggcagaggcagacagaaaggcagagaatagctaggaaagttgagctcaatttaatattgtaattataatatgcatgctattttaaaattgctttcatttctgaatttagacagcatatagaacttgataaatacagtaattagaaatccgagagttatttgcatacttacacatctgaagtatcttcctatgtacagataaacattaaccacaattatctacacatgttgcttaaattttttcctccagctgtcatgttaaagccatgattgacacttgtttgcatactatttgagaatttaatatttggttgaaattctctgatcctaaaacatactgcttggaaatacacattttgttttcatacacatgagatgttgcatgcataccgaaattaaagaattacaattagttggtacccagcttgcatccttaagcaatctttgtaaatactatttttcttattaacgctgctttctgttctcattaagtttcaacagagtactctcagtaatttaaaacatattgttccttcagttaaataggcaatttccctctcaacaaatgcctggaccttaaagtaaggtgtggaaatggacaaaatagtcccaaatattttaaccagcaatataaacttttgcaatgcttttataggatgtttaaaataacaagaaagacttggttctcgtgattttcaccaacggtggttacaaacagtcttcttctttactatgtttgaatggcatatttcacttcacatatcctttacttgctgctagagccttaatattgctagggggaaaagcttacctagctccgtgtttgtaaatgtcagctagccaaaagatatttggaaacctataaatgttcgcctttctaacatttgcttaaagctatctggaattaacgttctcctctttcctcttctctcacctcaagaaaaaaaaatctgtatacagaagttgacacaaaatatattaaataaggctggtattcagccctcttgcattcaagcaagaattacccatgtatgtaaaacagaagaaaatgtcttgatagtattctgtacccgtgctgtcaaactaccctttgatatgtctgcaattttctcagtaaaacacattttgtttattttggattaggagcaagctcttgcatgtctaccaggatttattagcctggtaaagaagcagcactacacagaaacaacgaatataatgtgctctttgctatggttttaaggtccccttcaaactcatgtgaaatgtaattgccattgaaacagtattaagaggtgggggctttaagaagtcatgcaggctgttgtcggtttttttcttccaggttttttctatcaaaacctaatttaacaacatctgagcaaatcatccccttcctttcctaatatcctcattttcactactctctccttcagccgcaatgatccattccatcatctaacattaatttagtaaagatttactaaatcccttctctgtacaaatcattttataggatctgagtaaagatacagtgattagcatatggcagcccttgtcctttaacatggcaagaacaacttttcctattttcaagagcttgagtattctgtcactaacagatctaaaactatccaagtttacctggccaactttttcccttaaacttctgcctcccttttacaaaacttcaaaaaaaaagaattccaaatttaatcatgctgttaaaacagattttcacatcatcccgtagttacataaagggcagtctccttagctcatacttaaaatcatatcttttcaacccttgagtattgttaccattacctcaaacgatcatacagctactgtctttcaggttattcacaatacaataatttgaatatgcaaaaacaccacagaatttaaatgaaaagtaactaacgcaccctactcccctcaaaaatcaattaataaaatttgtaatttcaacaaatatttttgaatatttacaaatcagaaacaaaaatggctaactggaaacacaaaacagataaaagatttggtaaattaacccaacatgcaattttgaaaaatgtaaatttaatttttacttaataagtgatttctcaaaaagtaacattaataaagggcattgtcagaaattttgagtcttttaagagtgaaaacatctgtttgaactaaaactaggagacacagaatgataagaacatatgaagttttagctaaatatccatgaattacaaggttattctctgttggtttggagtactcatttacacactaatactcagctttaggaatttagggctcattaactttgctaaacatggaatttagggtttttttaaaaactacttatttcttcactatttttatatccaagtatactcttctcattactcacaaaggacaaatcttcaccaagcccctgcccctacagtcaggatagtaatttcattcaagcatcccttgaaagcaattatttatgctcgctgcagaaattagggtaaatttgttgtggtcccatttattttctggagattggcgattacatgtaaaataatttgaacgcttgatagatagactcataaatatttggttaatacaagtaaagcagggggaggccaggcgcggtggctcacgcctgtaatcccagcactttgggaggccaaagtgggtggatcacaaggtcaggagaccgagaccatcttggcttacacggtgaaaccccgtttctactaaaaatacaaaaaatattagcagggcgtggtggcgggtgcctgtagtcccagcaacttgggaggctgaggcaggagaatggcttgaaccagggaggcggagcttgcagtgagctgagattgtgccactgcactccagcctggggaacagagcgggactccgtctcaaaaaaaaaaaaaaatggagctgggggggccgggcgcggtggctcacgcctgtaatcccagcactttgggaggccgaagcaggcagatcacgaggtcaggaaatcgagaccatcctggctaacatggtaaaaccccgtctctactaaaaatacaaaaaattagctgggtgtggtggcgggcgcctgtagtcccagttactgcgggaggctgaggcaggagaatggcgtgaacccaggaggcagagattgcagtgagctgagatagccccgctgcactccagcctgggcaacaaagggagactctgtctaaaaaaaaaaaaaaagtagttattttcttcttcatccctttcagtgtggccactatttataatgcagtttggttcattagtgtttgtattccaaaaacaccctcagccttcctatcctagttttaatgaattattagtgtgaaacataataagggtcggagctatacagaaaggtctactcagaggtgctttgttccctcctattctgttcccaccactcctactttccactactttttccactgaccctgtgagcatcatatttattgttaatggcagttacatttttaccaagtgcttactatctgtaggcacttggtgtgtattgcttcttctggtgttcacagcaacctcttgaggtaggcactattattatccaccccaccccgccccgttttttgagacagagtctcactctgttgcccaggctggagtgcagtggtgcgatctcagctcactgcaacctctgcctcccaggttcaagcaattctcctgcctccgcttcccaagtagctgcaagtacaggtgcgagccaccacacccatctaattttgtatttttagcaggggtggggttttgccatgttggccaggctggtctcaaactcctgacctcaggtgatccccattttttagatgagaaagcagagtcccagagagcataaggagcttgtccagagtggcatctctgatgcataaccagtactcaaaccagtatttttctgacaccaaggcctgtgtgtaaactgtaaaagggctgtttggtacctgctttcctaaagttgtctgatcccttctcagtccaggtcttcctgaagcttggcacttctgaagtcacctttctgaaaacattctggtaactgttagatcccttgttgtagctattcatatgttctgtgtggttaaacaaggttcacagtgggccacctggcctttggaacttggctgaagaggctgccttcagttcatcctccccacccccattttcaaaacatgggtttccatgtgttagttgtaaattaggaaacataaccatgttttgaggcttcatagaaaacaaacgtctggggtcacacaggttaaaggaggaaccaaattcagcactatcactgttctattcagcaggcaattctggggccttcctgtgtctcaggttctgtactagttgtttcaggactttgggataaacacaaactatccctgccctcagggggattaaggtcaggtgtacaaatgactctaatgcgaggcaaggctggattcagtgctggaagaggagggcatacctaatgctatgggaattcaaagaggaaatgatcagaatgaggagggagagatgggtcattccaggagaagcttcagggaaaagcaacacttgaaatgagactttggagagtgagggaggtttgggcagatggatagagaggatgcaaggccaggggaaaggtttgagccagaaagtcggcttgggcaagtgcatgggtaaaaaaagaaaatccactttgggaggccgaggcaggagttggagactagcctggcccacatggtgaaaccctgtctctcataaaaatacaaaaattagctgggcatgatggtgggcacctgtaattccagctactcgggaggctgaggcaggagaatcacttgaacccaggaggcagagattgcagtgagctgagatcacaccactgcactccagcctgggcaacaagagtaaaacttcatcaaaaaaaaaaaaaagaaagaaagaaaatcacaaggcagtgtggggaatggtgagtaatctaatttggttgttgcagagaggatgtagaaggaagtgacgagagaaagccagacaggtggcttggggtcatcttaagggcctttgtgccagttaggatgttccagactttagtcaggctgcccagctcagactggctcagacaatgagggggtttattggtcatgtaattgggaagtccagaggttctaggactacagaaaattattatttagtattagtttgacagcaacaccttctgttttctgggagcaggagatgcttgtcaagctgtaggtcactgagttgaatattagcctgctttattaaattgccaagggcacggtaattgttgagaggggagaagtacacaggaaaaaaacatgaccagcttagaaacgtcaaatgattatgacgttgttataaagtattataattctttgagcgtctactataagtagagaaacttgagttccaggttgtgggcttggttccgccaacaatcaggaacgtggttttgcatgaagcccttctttcttctataatcttcagtgtcctcacctgcaaaatgaggcctttatatatatatatatatatatatatatatatatatatatatatatatttttttttttttttttttttttttttttttttgagacggagtctcgctctgtcgcccaggctggagttcagtggtacaatctctgttcactgcaaactccccctcctgggttcacaccattctcctgcctcagcctcccgagtagctgggaccacaggcacctgccaccacgcccagctaattttttgtgtttttagtagagatggggtttcaccgtgttagccaggatggtctcgatctcctgatctcgtgatctgcccgcctcagcctcccaaagtgctaggattacaggtgtgagccatcacgcccggccaaggcctttattatattacggttcctactgttttttaaaatacttttattaagtccaacatttttattaagatcattgcttttatacatgcctatttatgaaaggggtttttgagtgtttaccactttttattagaaatagagacagtaagaatgtttgacttaattgacacaggcataattgaatgggtataaatggcatgccatagaaagagaaaattaagttgagctactctgttggtttcactgatgaggggatacatcattcaaacagccaggaattaaatccgtccaactcacaaatggggaaaccagctgtgtctgtacccatggccagccagattgaacacaaatcaggaaagtcagtaacttttcctcagttctgagggacttcagtggctgcggttcattttccttttgcttctgaaacagtgcaagttgatgctcgcctggacagagcggcagtgagtggtggcatctgaaggccaggtctctgttgagatgactacacgtcgtctcccagtgcccaatgcatagaaaagatacactactaagtgtgagatcctcagtgaaaaataaaatctggggttgaatcatcatgggggatactgcatactctgtttcccccctgcagatttccaatgctcattagtttatagagactctgagaattcctacagcaaaggcacctgccgaggtatttacaaactagtttagctaaaccagactttcaacaattggttactaaagaccactcaaagtctgtcaacactctgtcatctctacgtaatgatagaaacatagaaattcagggtaaatgtttagaaatttctatagaaacttgacattctcccagcatctgtatgtgacatcaggggacttgtctcaatgagcagttacagaccaactgaggttttgtcagactcaatggaaagatgcagaggctgtgagctgcaaacgagtcacatgcacaaggaccacattgcaagctgcgttctttaaggttagtttatcaactatagtataatctcacacatctgaaaaataggaacatctattctataaagtcttatatttgcaataattttaattttaaatcaagccaatgttagcattattagtgaaaacaaaagaaagttgtattatttattattaaacctaatttgagagtgaaataaattgtattaatttttttaaccaataaaagatgcaccttgtaaaccaagagatgattatgaaagtgattctgaggacatgaagaccaaaggagtttgtcctcgttttactcagaagtactatttctaatggacagatgatccctgacatacaatggtttgacttataattttttgactttatgatggtgtgaaagtgatatgcattcagcagaaaccatacttcagtattcaataaattacatgagatattcaacactttaaagtgggtttgtgagagataatttttgcccaatggaaggtgaatgtaaattttctgagaatgtttaaggtaagctaggctaagctatgatgttagtttaggtgtattaaatgcattttaatttaatttaatttaattttatgttttgagacagtgtgttttgttcttgtcacccaggctggagtgcaatggcatgatctcggctcactgcaacctctgcctcttgggttcaagcgattttcttgcctcagccttcccagtagctgggattacaggtgcgcaccaacatgcctggctaatttttgtatttttagtagagacagggtttcaccatgttggccaggctggtctcgaactcccgacctcaggtgatccacccgcctcagcctcccagagttgggattacaggctgagccactgcatccggccttaaatgcatttttggcttgtattttcaactgatgatgagctataactcctttgtgagttgaggatcatctgtcttgaatttggttttacaggcataactgaaggtgaaaggacagaatcaccgtgtgttactggcacaggtgcatcggctagtgaagaaagaagacattcaaactgtaagttgcattcacgtgggaagcacaaagaattaaattcaaaacaatgaaacattagagaaaagcatggagttaaaacacaacagaatcagatgtttactatttctcattttaacactagtgctttgcgggcttctaataaagttgtactccaggaggctaagactgaaaagtgacactagtgaaaaatagcattgaaatagttccgtagaaaagttgggtgaatgtggggcaaagatgccactaaactttaattttccatcgacacacaaattcaaagttttccagagctggcaagtaaaatggaagatccactcacaggacacatgcagcgtgtgaggggaatgcttttcagcacttcttgatggatgcacaaataatgccaacgtggtaaatgtctttggtaaacgtgcaatggaatgtagtggttgtgtgaaggaagaattttgttttcagcttcatttttgataaacacaagcagctctggactgtgtgaaaccatggagcactgcacagttaacagaggtggtttggagttttttagctttgcataagaggatgttctgatgcagaatctacagtgacaggaaaccgttctggacaagttacagaattaaggagcttgtgccgggatggaaataaatcaatgacttctgtctttgagaaggtttttctctgctcctctgtgatggttaatttttttttttttttttttttttttttgagatggagtctcgctctgtcccccaggctggagtgcagtggcgccatctcggctcactgcaagctctgcctcccgggttcatgccattctcctgcctcagcctcccaagtagctgggagtacaggtgcctgcggctaattttgtgtattttttagtagagccaggtttcaccatgttggccaggatggtctcgatctcctgaccttgtgatccacccgccttggcctcccaaagtgctgggattacaggcatgagctaccatgccccacctttttttttccttttctttcttttttctttctttctttctttttttttttttgttagtccttccctccagtgtcatggagataattggaaaatgttttagagcaaaaaagtttatttctccttcttgttgttagcaaagaaatttatttttccttcttgttatttattggccttggagacatacaccaaatagctcattctacttctgaaattttgttttgatttccctggccctccccacgaagtatttcagattagcagggagtcaagtattgtctgtctatctgtgaataaaatatttcaggctgcttttgcataatatacatgctcttgcctttacgagtcacactcacatcttctggttttgtaaaacaccaggtaaagaagaaaacaatgtttctgaattctgctttatcagcccagtagagaactcttcccttccctgaactgagggctacatctaaggggttgaaacagggccagtttacagtgattataaatcaaatgcctgaagatgctaagcttaggacagtgtttgctgtacaactttgataactgaacatttttaaagctgaaaatgtgactgtgtgtgtatatgtggcatattatccttagatgatccttacttcgattattaagaattttttcccctagtaatcttcaactgtctcaatattcagcaggaaccccttggagacaaagatcagtacgaatttggaacacctattgacaaaatgaatgtaatttaatttaggacagtagtaaagtcaaccacttttaggtgttgatgctgctgaaagtatatataagtgcagagatgacatccagaacttgtcatgaatattacaaaaaggtctctaagggctttatggaggtctgtaaattgacttcatgtgaaagagtgtaagaagtgaaaatgtgaagcatgactggagagccagagtgataaagcaagggtccctttttccagatcctttgtaacagtgtcatgtgacctcttctagatcattctgaaagacaatgccagctcggaacctaggaaagcatccagtgggtttctgcatgttaggtggttcaaatcctcattagcacctttgttttctctgcctcagtttgcttacagtgatgttctcagtagctgtaattgctgtctgtctttgaatatttaagcatttttttttagatcacagggtatatgtgcatttttattttaccaagtgttagaatttttaccctgcctttgtgggctctgggttagctacttggttgtttcatcgtaaaatgattagcaggaaaaactgtgtgtgtgtgtatgtgtgtgtgtgtgtgtgtgtgtgtgtattttaagtttcttaattgggttgggacatgtaaaccatttagaacagtgcctgctgcataccacatccccatcagtattcacgtctctcatattctaccctcacacttgattgatagtttgcttgattatgtatttctaggttgaggataattttaccttagaatttcaaagtctgtactgttgtcttctaaccagtcatggtggtgaagcctcatgccatcctgagtttcacttgtttatgcatgactttctccctggaagctttaggagttcgtcttttccttggtgagctgaaatagcacaacagtgtacttagtgtgggtcttttttcattcattatgctgggtacaccaaatgaacaggcctatggataggctctttcaaagttggagtcttgaatcttgtcatatttttgttgttaactttctcttttccattttatttgttcattttgaagtgtctgttaattggattttagacctcttgtcttgagtcttgtatctcctgttatttctaaatttttttaaaattttaagttctggaatatttccttatctttcgactttcaggaaattttatttggactgtcataactttaagttttgttttggttatttattgttgtttaaccaattatcccaaaacttaatggcataaaactacacatctgtctatctgtcactactgtatggattacctggggctagctggacagtttttctgctggtctcattttgcagctttcactgtgtggttaaacagtgtcagggactggtcatctggatgctcagctgcagtggaatgtccgagacggcttcttcacccacaggtctgctgccttggtaattcttgatgtggcctttctctctgcatagcatctcatcctctcggatctcttcatgtggcttttctttctccaagaaggtagtcaattcttatttttggcttccagaagcacagaaatggagctgccaggagttcttaaggcttagacctggaacaggtccagtgtcatttctaccacatgctataggttaaagtgagtgttggggccaacccagattgactatgggatgggcctgtctaaggacatgatgacaggaggtatggctcattggagaccaactcccaagatgaagcatgagttctaagaactttttcttctctgattatttcttattcatattgttttgttttatgcatgtaatatattcacaagtgtctttatgaagtgattttgatactctttgtcttctccctggcatctccttgttctttaataatttttttccttggtttattttggtcttatttttctttttaaagcctttccttaaatatctattctatgttgcttatcatttgttgtctttttttttttttttttttttttgagacccagtttcgctcttgttgcctaggctggagtacaatgatgtgatctcggctcaccacagcgtctgcctccaaggttcaagcggttctcctgcctcagcctcccaagtggctgggattacaggcatgtgctaccacgcccagctaatttgtgtatttttagtagagatgggatttctccatgttggtcagtctggtctggaactcccaacctcaggtgatccacccaccttggcctcccaaagtgctgggattacagacatgagccaccacgcctgacctgtaatcttttttccattcctttatttgttcattcatatttgagagaggtactaaaagactgggagccggggtgtggtggctcacacctataatctcagtgctttgggagaccaaagtgggaggatcacttgagcccaggagctcaagactagtttgggcaacatagtgagaccccacctttaaaaaaaaaaatagctaggtgtggtgacacccatctgcagtcccagctactcgggaggctgaggcaggaggattgcttgagcccaggaggttgaggctgcagtgagctctgatcatgccactgcattcctgcattccagcctgggcgaaagagcaagaccctgtctcaaaaaaaataaataaataaaaataaaaataaataaaaattgattgggagttctttgtggccaagacttgtcaactgatagctttaaggggaatgtatgctgattcctaattgttatcctccatccctctatcttatctcctggtgcaatcataaatgatggctggatgactactccattcctctggatgtaaaatctacattctcttgcctgaggtggatacgtttgcttgggttctgtttaaggagatggggccagcagtgtgtttcagggcctgtgaaatgtgttctctatccgggcttttgcttaatctctgttttcagtcttgcctatcagtcccactgtcgggggtacctcgtgtctgagtctagaacctttccaggttgctgtgggacagattagcctccttgtcctcagtatccccctgacctccacctttgttgctttgctccatgaattaaccattttccatgtactgtcattgtgtaatgaagatgaattctcttctgttggtaaccccattccttttttgtaattgtgtgcttatacaatgtttattcttcactgtatttctattggagcctcaggacaaagagcagatggtgagaatctatgttcagtgttaagttttccttctgtaagacatgtgcaacttgtgtttttcactgaatagatcatggacttaatgcatatagagctactttgtttttcatgattgtgccttcaattatatgtagaaatataatttgtgaattgcctgatgaaattttcataattttgaattgtctttgcattcctataataaacactgttagaatggctatggtaatgttttatttttgcattcttctgtattaaataagattatagttttgtttgtttcctttaaggctgttatttcatttcagtatcaagggtatgcagggctgagttgggaagctttacatcttttttctaagatctaggatgtagatctggtttacacagtaattttcaactgcaggagtattttgcctcctatgggacgtttggaaatatctggagacatttttgtggtcacaactggtcatggtcgggaggtcttattggcattctgtgggtagagggaatgttactaaatgcccgacaacacaccaggagaaccctccacaaagaattatctggcccaatatatcaatattgctgaggctgacaaattctggtttaaataaatatccaatttggaggatgagtctttgtctttttccttcttctgcatattggtctccagatttcccacttcttcagttagttttcgtaactgtaggttcttaaaaaaaaatgagcactttggccgggtgcgacggctcatgcctgtaatcccagcactttgggaggccgaggcgggtggatcacgaggtcaggagattgagaccatcctggctaacatggtgaaaccccgtctctactaagccaaaatacaaaaaattagccaggcgtggtggcgggcgcctgtagtcccagctactcaggaggttgaggcaggagaatgttgtgaacccgggaggtggagcttgcagtgagccaagatcacgccactgcactccagcgtgggtgacagagcgagactccgtctcaaaaaaaaaaaaaaaaaaaaaatgaacatgtcatccatacttctaaggtgttgtaaagatgtgtaaagttttcactttttgcatcatattcacatgtggctatatgcccttttctcttcaaagttttctttatcttgattacttatcagaggtttgactgttttattttcctcagtcttttgaaagaatcctccttcagttttattttttaaatctagtggtttttctttttcctttttccttatgtcttaattatttccccctttttgtttgttttgcttttcctagtttagtggatcaatgtaatttaaattgctttttaaacaaacatgtaagggtatacattttcgttgggtgctgtttgactttgttgcacaagttttaaaatctattttttaatagtttgtattttctaaattattttattgcatcttttgttcacattgctcttactattaattttttatttttattaataaataaataaattaattaattaattgagatggagtcttgctctgtagcccaggctggagtgcagcagcatgatcttggctcactgcaagctccacctcgggggttcatgtcattctcctgcctcagcctcccaagtagctgagactacagctgcctgccaccacatccggccttttttgtatttttagtagagatggggtttcaccgtgttagccaggatggtctcgatctcctgacgtcatgatccacccaccttgggctctcaaagtcctggaattacaggcatgagccactgcacccggcccaaaagctttgtgtttttacagatattagacatgtttcttgtttaagaaaaaaaatcttaacgaaaacgtaggagaataagagaaacatttttccaaaaaagagaaatcattgtgattattttatcttattagaatgttggataatatagtctgcttcattaatcatcaagcatgctatgcattttccatttttataggatctgtatctcagttaagataatactggtaatttttatactgtaatcaaagatgaaaaatgtaggccaaaatcatagaccttgcatagaagctggataatgaagacagctatagagaaaaacacagatacacacacacggacacacatatatatataaagtatacacacatatattttttaaagttttaaagctgttaaagcaaaagctggcccctcttctcttccagagtgggaggcctctcccctctcttagagtgggtgcggagagcggtcgcatgggcagctttccttgtgagccacagggccctctggacacgctgctgtctggccacgccccctttccctttcatctttctcattgaccaatgggcttggagcattaaggccacgcccctattccgcattctactggggccctggttacgcctcctctggctcagtcacacagctgcctggaaggtgactggaggccttgatcggttctcattgcgattttgctgctgtggccccaaccctgcctccctccccaccctgcgatggcagaagaaactcaacacaacaaattggctgcagccaagaaaaaggtaaaaacgcactaggtcatagcccctcaacccagccacagatcccctctgatgacaagacccctgccagagtctatacgactcctgaggcacactggactgttccccccaaccccggtgccttgggctacccccatcaaagttttgtcagtcagccccaccccttcagaaagcagcccagtccttgccctcgccaatcaccccagggtgactttgggtgggtgactcctgggacttcccgctccgttactgggccctcatctcctgccgccccaagcttgatctccctgggctctttgggctctcatctccaaggagccaggccccaccctcgccaatcatccctgggtgactttgggctggtgactcctgggactccctgctgcagactctgccctcccctcctgctgcctcaaggtcgacctccctgggttctttgtgctggcgtctccaaggagctgggtcccaaccctgtgcttccctcccccatcgtggagcggcgacttagacatggtgctgacacggtccctccccctgaccaggaggattggaatgttgtgatgtcacagcccacctagtaactgccgttactgcaagactggcctttgatcttatgacccagtcccctaagcgttctcaccccgtttctggttcctctggtcacaggacaaatttccagctggaaggggaatggagactatgggacctaggagcaagaggttccaggctgcctcactcccttacagatgttgacggtgggaaaagcctacacttcccccatgaactcaaaacattgacagtatctctgggtggcaatgagagaatgggtttggtttggttttctcccaggcttctactttccagagagattttaacattttttttctgagttctccacctcatattctaattctccatggttctgggaccagactctccttcagtcagtggtctctgaagtgacatttgctcatcttctgtggaatagatcttgggaaactgaacttgacaccttgaatcttcctcatattatctcaaccttgggtactttgagtgccacaggataaatgtgggacatctttctgaagcatcagtttcccttgattctcttgagatcaagagaaaaaacatgaatatacttagggatgacagtcacataggtttctaagagtataccagccctctctctgaaatgaggcttgggttgtcctctttctgatgaattctgatttaagagaaaggctgccttctgccgtgaggacacattgatataaaagtttgagaggtactggtgcacttcttcacactaacagacgtgtgaggatgtatgactctaaaccacatggcatacagttcctgcctacttaatgtttacttttctacctctgcctctggttttggtccctggcagctgctgattcttggcaaaacctcagagcttggagtcagaagactgagtttcaaagtgccagtattgcctttttctttttttttttctagccatgatatcaatccttctcagtcactaaatgagtgtgacaacaccttgtacagttgttggtgtcattaaatcagatagtgtgtaagtgtattttgtaaaaactgtaaaggaggatgtggctgtaggggctgacggttctcatgagtattactgctcttctttccaacagttaaaagaatattggcagaaaaacagccctagagttccagcaggagcgaacaggaacaggaaaacaaatggcagtatccctcagacagccacttctggtggttgccagccacctggggatgtgagtcttggctgaccaggcttctggggacagggggcccaaggggcaatagagggtaattgttaagattgtggatggactgctgggtacgggttaagaattctggctttagccgggtgtggtggcccacgcctgtaatcctagcactttgggaggccaaggcaggcggatcatgacgtcaggagatcgagaccatcctggttaacacggtgaaaccctgtctctactaaaaatacaaaaacattagccaagcgtggtggcgtgtgcctgtagtcccagctactcagaaggctgaggcaagagaatggtgtgaacctgggaggtggagcttgcagtagccaagattatgccaccgcactccagcctggtgacagagcaagactctgtctcaaagaaaaaaaaaaaaaaggaattctgggtttgaatcctgcctctccatctgctctgctagggatatgatttagggcaagttgctagacctcatcgggcctctcttttcacatctgtataatagaggtgttattgtttcacttccatttgtgaaattttcatgagatttgttattgttgtttttatgttaatccctagtacatggcctgctgtaaacactcaggacacccaggatatggtctttgctgtttgattttcctcatccccagtctcaaggggaagccaggacaatgagaacagccacttgccatcaggagtcactgaaagggccccaggatgggatggtggggagataagaaccatgagagaagttggcacaaaggagttatgggacaaagggtccaagataggcagaaaagaaaatgttgccagttgatggggaagaaaggaagtcagagggctcagacactgtgggggacagaacatctccatgtgcactctcatctcttgtagtcagcaacaggttttcacagggaaggccctacatcatctgctaccctgaaagatctggaggtaagaggctctgggcagaggtgcagtgacccttcgggtcagccctccaacctcctcctccaggagggactgggtgcccctctgccagctgagacagcccacacaccccagccctaatgattgttctctctacctctcccccgactcctgctccacctcctcctctctgcatgaacctcagagcccgtgccaagaacgagcagtagtcctggattcaaggtccgtagaaatcagtcaactgaagaacaccatcaaatctttggtaagagtccggtggggtcccctgattccacgctgccaatcctgggctccagtttccccttggggccctgaagaaaggggctgggggtccctggtgcccgggacaaatagggagcttgggtgcccaggcctcacctggagggaccccagagcatgcagcatggctcttcttttgctgccctctttgccgactctctcctctccagacacccctgctcgagtccttgctacacacgccctggggttgttgcctcttggggaagtgctagcctgactggttgtcaagggccccgtatttctgccatgactcagtccctaatttgctctttgattctggacaagccacctctcctttttgggctcgtgtttccagaggaggtagtgagtatcaaaggtctctgttagctctcgagtctgagatttaaaggcccccgagaatggaaacctcagggctaagggctcctgtctgtccttttctatcctatatctgctgtgaagaaccgtacctggcccatacgtgctcagtaggtgtttattgaatgaacccacttttctaaatcacaagctgccagaaggaggggcctttctgaaactccatctctagaggtttatgttgctgtcctctcaagagattccagattcagactttgagttctgtggctgtgggcaaaagcccacaaagacccaaatcctctgtccttgggagcttgaggagagtttaccagttcgtgttcccattatgtctgagaactttgcctttaaaatccattcctggcccctgcctaccgcttcctggtctggggaatagagttgagggggccaccctccatcaccttatttgactctccccacagaaacaacagaagaaacaagtggaacatcagctggaagaagtaacgtgatttcgtttccttgcaacatgactgctggaagaaggctcacccttcagattccaccccatcccctcagggccccgataacctggtcccatgggtgggcctgtcctggggcattggtggcattctgggggcatgtctcttgctgtgccatctctgcctccccctggtaagagctctgtcttcctcttcctacaggaaaagaaagcaaacatcaagaaacagaaagccaaaagggtgctagaggtgagtggagggtgtgcagtttcctcctgtcctccggagaaggtttctttccttctctttcagcacttgcttggcttttctcccaaaggttcaaatccagacattgaacatacagaaagaggaactaaatacggacctgtaccacatgaaacgttctctcagatactttgaaggtgggaatctgggcaccctgtcatccttcaacctggcactttgacaggtcttcagggggagtcctttgggccccatctcaactctctcattacagaaaagtccaaggatctggctgtccgcctgcaacattcattgcagcgtaaaggagagttagagagtgttctctctgatgtcatggccacacagaagaagaaggcaaaccaggtgagtccaaccacctgccccatcccctgggagtctgcctttgcagatggaggagtgagcctaaaggtcccttctgcaggatggcgtgtcctgcccagaaggcagcatggccatttcttgctacttttttgtatggtttttagtggcagcctggggctgagtcagctgctgtgggtgagttgggggtcactgtgtggagtgagcactggacgcagagcttggaggccaagtgcctgccccgcccttacctggctgtggtcttgggcaagtcctaggtggggtattgggtacttgtactgtgaaggtacagaagagtacctttagtatgttaccatttctgtagaaagaggaaacgtgtgcatgtgtgtgtgtgtgtgtgtgtgtgtgtgtacatactatgataatatacataaaacatgtctgcaagggttcataaaaaattcaggagagagcaacaagatggccgggagatacttcccttctgtaccttctgagttttggactatgcaaatgtatcatcctttcaaaaagtgaacaaaagattaattttccccttcctatctgtggttgtgaggattaaatgggattgctagcatggtatctggtgaagcactccataaaagttcaaacagtggtaataataacggtaataacaatagcaatattatctgatctctctgggcctctgttagccagctataaattcaatctcattccctgtccgttccaactttactgtgttcttttaaaaaccagaccatgggcttggaaatgccatgatctttactgaccgagttgtatattgggcctagccctagccctgttaaggggcactgtgtggaaatgcccaggctctccagattgaaacttctcactctttgccatccagttgtccagccccagtaaagcaggtacggagtggaagttagagcagtccatgcgggaggaggcactactgaaagtgcagctgacacaggtgaggttttctgagggagttatgtggaaggaagatgaccccaggtggccaggagcaggtgaggaccagtgacagcccttcctaacttctgtgcccattcttgcagttgaaggagtcatttcaacaactccaattagaaagacatgaatatgctgaacatctaaaaggagagagggcccggtggcagcagaggatgagaaaaatgtcgcaggaggtgagatctgacccttcagcccccccacattagataggtcactggatctttctggtcatctgtaaaatgggaatagtacagccagaggtggtcatgggtctgggctttgtggaggtgggggcagagagggagagggcagcctgtccagcctccagcccctctctccagggccctttccccttgtgctttgggcagatttgcacattaaagaaagagaagcagcaagatatgcgtcgggtagagaagctggagaggagcttgtccaaactcaaaaaccagatgggtaagatggggctggcatgacctgggagcaggactggcatcagagggctgtgagggtggcttagagtgccccagggaggtgggtggatggaagggctttgaggcagagggaaagaggtctgtgccaggagacggcaagtcttgtcatctcaatgagcctcagtgtccccatcagcaaagagggcccgttgtcagccacccgcagtgctctttctctgaaagtgctctggaagactggctaccatctgggtgtgaggaatcattagcagtgaggccaagtttgaggagcctgagaggagctgtggaccaagaggaggttttttcttttccgagaatccagaggcccttattatctgcttcctttctcagctgaacccttgcccccggagcccccagcagtgccctctgaggtggagctgcagcacctgaggaaggaactagagagagtggcaggagcgctccaggcccaggtcaaaaacaatcagcgcataagtctcctgaaccggggacaagaagagaggattcgggagcaggaagagaggcttcggaagcaggaagagaggattcaggagcagcacaagagccttcagcagctggccaagccacagagcgtcttcgaggagccagtgcgttgccccagctggggagcctgccctcctccctagccctccgggcctttgtttccccacctctaaaatggggcagtgtagccctcacatgaaatgttacttctaaaggcacctgtgagccaggtggctgtgggagagagggggtgatttttctaacctgtctccagccttcccagtgccatgggaggcagacaccaagttctggggtctccagctgcagtgggtggctgctgattgcttctctctgtccagaacaatgagaacaagagcgcactgcagttggagcagcaagtaaaggagctacaggagaagcttggtgaggtgaaggagtcggaaacctccaccccatccaagaagggctgggaggcgggcagcagcctctggggaggggaggtaccaggccagaggcagcttccagcctgggggctggtgaccacagcaccccccagggcagtcctgtttcttgcttcctgcctctgacttttaaaggtgggtagccctgggctcctctcaggtctggacatcatcatcctagctagaggcatggagcccccaatcacaggggaagagacagtggtataacaggctccttatgccaggtgcagtggctcatgcctataatcccagcactttgggaggctgaggcaggagaatcacttgaggtcgggagtttgagatcagcctggccaatgtggtaaaacctcatctctactaaaattacaaaaaaaaaaaaaaaaaaaaattagcaggacattgtggcacatgactgtaattccacctactcgggaggctgaggcacgagaattgcttcaacccaggaggtggaggttgcagtgagctgagattgcaccactgcactccagcctgggccacagagtgacactcttgtctgaaaacaaaacaaaaagactccttagattaaaactggattccagcctcggttccactggtcaccattcaagtactttgcatctctaagtctctgtttctttaacttcaaagggaagttagcattttccttacagaggtgctgaggattaaatgagaagagggtatgagatttgaggctggggaaggaggcatggggttctaggaaagggaggcagtcacttaggcctggagtaaggggacaggggcctgggcagctgacagagccccacagtgccctcgctaccctattaatgggcccagaatctggaaaccagccaccacgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtgactgcagcagacccagctaatgaaccagctgcagcagcaggaagcttggggcaaagcagtggctgacatggcctgccaaaagttgcaggagacccaggggagggagctgcggaggatggggccgtgagggggacgacctggcaaactccatcccttctcactctttcctggccccttaggagcacctggaagctgccagccagcagaaccagcagctaacagcccagctgagcctcatggctctccctggggaaggtacgggagaccgctcagaggaagaggagagagccccaggaggaaggggggactgctagcagcataggattgaggagttggaagagacctttagaacagctggtcattatgccgaccgggtgcctgcactaagttgggcatcagtgtggtgacctcctgtgagcggggggtcaccaagttgcctaaggatggctgaactggccaaggtcagaaagggagcaggtcagaactcccacatcgaccagtagtgggaatgtgcctgggcggaatagcaagatcttgattcttaaaagtaaaaataaagaacaacagctcattcctctctggggaggggctggctcaggattacacagtgagggtggaggtagaggtgggcccacagtacctcccttgttgggttgtctgaagacccctctggccaccccccacaggacacggaggagaacatctggacagtgagggggaggaggcacctcagcccatgccgagtgtcccagaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtggccaacaggtgcactctctgaggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtatgctgccagcgcctggctcacccggtggcctcggcccagaaggagccagaggcagccagaggccctggagccccagggcctgggggcgagtctgtgagtggggagacccactgggccctgcaggaagtcacggagaagctggcccatggcaggactcacctccaccttctccatgacttgaaaatgccacctgagggcaggtcgctgccgagatgtgactgcaatattttggctccagagcagctttatggaccacctggaggagaaggcagacctgagtgagctggtgaagaaaaaagaactctgcttcatccaccactggcgagagagatgccatcagtgagtgggaggccagggcacggcagggggagctacagggccgttggaggggccccagcgtatgagccctgtcctcccgcaggaaaacccatcaccttttatcagaaccagggggccgtgccaaagatgcagcactgggaggaggacaccatcaggctggagctcagggaggagatgaaggtagggtgtgcaacatctctgtgggggtgggggtgggggtgggtgtgagggtgggcgcaggcagcggcatggcagctgagcacccctccctccaggtgaagctgctggagctgcagcagatggtattgcggcttacagcaactacaacaatgggcacagaaaattcctggccgctgcccacaaccctgctgatgagcccggtccaggagccccagccccccaggagcttggggctgcagacaagcatggtggtgagtagagccctcaggtggggtgggcaggcaggaagagggggctcccactgtgctcagatccctgcctccctctctccaaagatctttgtgaggtgagcctcacctcctctgcccaaggagaggccagggaggatcctctccttgacaagcctactgcacagccgatcgtgcaggaccaccaggagcacccaggcttgggcagcaactgctgtgtgccattcttttgctgggcttggctgccaagaagaaggagataaacatcaccatcatcaaacagctgctcaagaaatttttaaataagaaaccaagttatggggttaatctcctacacaattcatttacttcctttgaatgttagagtcactcatgattatttgtgtttctaatttatagtttaagtttatttataaaaagttaaaagagagtgggtgtctgtggctctcactgatgttcactctggcatccttttagcatttttcttttttaatttcataattgtaggtcattagcatgcatatcgagtttgcccttacgtggtgggagttcaaacacacaaagacccactctttgcccaaaactgttctcgctggtttggaataggctgccatgcttttttaatgttattgcagcatgtatattcactacagaattcagacaaaatttgcctatgttctgctgttgtttgatctaatcttaatcacagtgagctcttcgttagctcaatatgtagtttgcccccaagtgtgcactgtttattactttgtaatatgccactatgagtactgacatttagagttgtttaaaggccaagaactggaaacagcctttcctccattttctgtgtattggtgatgggagtgataaccttttgggggagctttttaaatctcacagaagaggaaagtggcctcctctggcaggtatgtgcaggatagagtgtgtttcatctgttccggtgccaggaattagcagtgtattatgatggttcccttaggatttctatgtgctctgggctcatgaagatattgcatcatgagctgcagcagttgcactctttttggatgacctaaaaagggcttatttctgaggaatgaaaggttcccatcgttgactgtggatgtggaaaacctttcctagcttagagcatttgtatctacaatacattttaaagtcagagttcatgttacctgttttaatcacatgactacatgtcccagtacacaaaagggcactggttggcattcttcttaatgtatttagtgaagatcataacaaatcctttatgagttcaaacgtccctggaacaggcatacaggctctagtcaagaatgaattagagtgaaggaaagctgtgtgacacctggaattcctctctgttcacggatattctttgaggcttgaagattgattttaccatctagacctctttggctaatacctattcttcaaccaccttggttactctgacataggaatttacttccttttccttgaatggaaaacactttaaaaaataatagaaacattattataaactaatatatgtgagatacttagttgaaacaaaaaggagttttagtagacggtattatactatctttgaaaatcaaggagaagtttatgaaacttaaaatgtgtacaaactgcagtgcaatctactgttcgtgaatgtcaatgtattatcaggaaacgtgtctatacaatcacagagttatattttctcacagacttctttacaaagtgaaatatgtttttgtacctctgggtttctgttcgggacatattttgtgcaatatttatgtgattgtgcctatgcatgatgaatgaatgcatttcagttatatattgcctaaatcgtaacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttcaactgactcttccaaattttatgaatgtatcaatgtattagataaacccagtttcagaatgataaagaaaaaatgttagaccaaataatgcggctaattaacagtggtacgatttgtagcccgtgggtttaaaatgcacttaaagtcctgttctcgccttttattttctgaacttgccgcttttgcattctttgagttcagtttaaagacggttactttaagagcattttaaaccctcgggctagaaatcggaccactgttaatcagccacattatttggtctaacgttttttcttttatcattctgaaactgggtttatctaatacattgataaattatttcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtcatatatttaagaaaaagctaaaaagaatggaaattgtatgacaataacttaagtctttctccaaagtgcatgcagtcttttgcgatacctcattcagccgagtatttgtgctcttcctcattcggtataaggcagctttcagtttgcttagaaggcaacattggaatgttagagttcatcagaaacacagaattttaaactgtgagttccactgaatacattttaatttctgtaggaagaatcaaaatacctatttaaagatggcaatatataataatcattttaaaagtatttgattaaacctgataattttccagaaatgaaaaaaaaaatcagctctaaaaccaaagctgattttagaaaatttgaaaatgtaaatcagccctatccataatatagtttctctaaaacttaattttaaagagtcgttttaaaataatataactattaaaatatgtaactgctatcttaatgttctgaaataatttaaaacattttaaaatatgaatactgtagtataaaagaaagaaacagtgggaacgaaaagcagagaaagaaatgccaattccagtccaaagttttatttgccaagttttcttagaatgaattttaccagtttatgaattattgtaaacagaatgtgtaatggaaatactgaaagatttttccctagagtggccttattgactgctggtgtgatgccactgtaatgtaataaattattaagttgtttgaatgtgttgtttttgccttaaaattttattttgcgtttcttgaaaactatagtattaaaggtattgatactgtgcaaatgctgggcatgcttggcatgagataatgtgtttcatttttacaaagttgtaatataactatgcaagtgtttattaaaaaccaaaataaaaaagttatgggtttattaaaaaacttttattaaagttttataaaaagttattttattaaataactttatttaaaaaagttatggggtgaaaaagttatgggataaaaatgtaaaaaagttgtggcaaaaaaacttctgggaaaaaagtagaaaaaagttttatgaaaagttacaaaaaaagttatgaaaaataagttatgggatttttttaaaaagtcatggaataaaaataaaaattaaaagcaggcccctgtcagcaaagcctggagaagtggggctggagtctccaccgccaccatgtccctaccacctcttcccaggcacccctttacaattagggtagcagcacaagacctctgtctaatggggaaagacaaacagaccatttgccaccttgagcagggctgagtccctaaatttctggatgatgatgatgattgttatttaagagccagaggctggtggagttggtttgtttggaggaggcctgatggtccccttactctcaccatggcaacgtttccctcaggggggctcccatcttcttattcagagaggtagctgaggccggaaagcggggctaactgtggaccagcgagggcatgggctgctggggtggcccaccttccccggtgtacatactgtgtctgtgtaacattttgtatattccagagggtagggctgcccctgtatcatacctagcagaggttggagctggcacatggggaggaggttctaataattatttgtggctgggaaacttatttattgctagcgtaggacagaggaaggaggcggggatggggtcgtggctctctggtggtatgatcacagcttactgcaacctccaactcttaggctcaagtgatcctcccacctcagcctcccaggtagctgggagtataagcatgcactactatgcctggctaatttttaaatttttttgtagagaaaaggtcttactatgttgccaatgctagtcttgaactcctggcctcaagcaattctcccatcttggcctcccaaagcactgggattacaggcacgagacattgctcctgtccattaggttttctctttattactgttttgttgttgtggttgttgttttgttttgttttgttttgttttttgacagagtcttggtctgttgcccaggctggagtgccgtggtgtgatctcggctcacggcaacctctgcctcctggttcaagcaattctcatgcctcagtctctcgagtgtctggggttacaggcatgagccactgcgcccctggctaatttttgaatttttagttgagacagagttttgccgtgttggccagattggtcttgaactcctgcctcaaacaatccgccctcctcagcctcccaaagtgctgggattacaggggtgagccactgctcctggctaagatcccatctctatttaaataaaaaaagaaaattcagagcatgtggaatacagaacaccaaagtccaaagttatttacctctctgaggtaatctgtgtaaacaatttgaaatatatcttttcaagttcatgcttgctatgcatatacatacatatacacacatacgttgacatagtcccccttccctgctgtcatgctattagagtcttcttttttttgtagaaattggaccaactctatgttctttgctggcccatatttctcctattcagtgatgtgttacaaatgtgtgtttaagtcaatgtatgcaactcttcaatatcattttaaaaggttaaatatacgatcatatgaaggcattagaatttattccaacagttccattttgcacatttaataatttccattggtttgccagggagaacattctcatgccatggctaaatccttttgtacggccatccttaactattccctgaagataaacttttaaataaagttgctagatgagtctcatttcttaaaaagttcttttttggtagtttatatgtaacactgtagttttatatgtacttgcaaatagctatagtgccagtaaaaaatgtgataaaattaaactcacgtatgccaaatatattttgatttagtgcttcattaagtgcatgattacagtctctatatcttttgatttacctttctacctttacaattttcagcccagatacttagaggtcacatagtaaattaaggttttctttttataataatctccatctttctaaatttggtgcgtcacagtaagttatttttcggttgttgaaagctgtggctctgttctaaatttgagcccagaaatcatgccacttacaaaatatgctttgtcttccaacatcagagtgtctggtagaaggtgactgttcttggaattttaaaaatctaaacaggacaagacaagaatatggaaaatatttctgtttctgataatatggctgagtaggtactctgcaaagcctctgtcataaaatagacattctggatagtccttgcaaagacatatttgatcttgccaaacaaaaaaaaaatatccagaatctctaagaatgaagatgaagtgaaaatcagaagggctactacgagaataatggggaagcagccccagttatcaagggatgtttgcatgtgttcaataaaaagtttcaaacctaaaaaaagttaagaaaaataatataactgccctacatacatacatcatcaacaatttttcattcatggcatggccagtttttgttttgtatttttttttaaaggtgggcttttgctgtggttgcccaggctggagtgcagtggcatgatcttgacttactgaaacttctgcctcccaggttcaagcaattctcctgcctcagcctcctgagtagctgggattacaggcacccgtcacaacatccggctaatttttgtatttttagtagagatagggtttcaccacgttggccaggctggtcttgaactcctgacatcaggtgatttgcccacctcggcctcccaaagtgctgggattacaggcgtgagccaccacacctggccacatcttgttttgttccatttgtattcccacttcatttatatacattccttcttcctctgaattattttgaagtaaaacctatatatcatatcatttttaaaattaccttatatgtatctgtagaagacaaggaatttttaaaaatatactcataacgccattaaatatcaaaaaattaatactttctgaaaatagccacaaatccagagttcacattttcttgactttctcataagtgattttttctaggttatctatttcaatcagatacctgtttgctcatatttacattcctaactgaacaatgtcggaagaggtacttaaacctgacataaaacacaaatgagcttatgaccaaatgcttagtgcaagaaaaaacttcacactgtaagatgagtccctccaaatacagaaaggaccagtattttaagaggtatgttaactaaaatgttgcagtgtatggagcagagcaggaagaacctttaagtctgaaaagtacaagtaaatttcatagtttccctggtccttccacaacaacctctggcatctgttttttctacaatggaggtaacagtagctctttcagagcaggaaaaggcttacagcagtgctagaagagggtggtggctatatacagtgtagctatttgtatattgtaacaaaccaacttttttttttttttttttttttttttttttttagtcaatagtagatttcttttggaaaaatagcagcctcctgtctggggacacctgcagttccactaagtgaacattggtgtctgctcacctttgcctctatttctctcaatatactgtcaagctgttccctgatttagcaattttatatactttctttttctttatttttttttcctttcccttttcctgagacacagtcccgctctgtcgcccagtctggactgcagcagcgccaacatggctcactgccaccttcaccccctggctgaagcaatcctcctacatcagccttcagagtagctgggactacccgccgggcccaccaggccaggctaatctttatggtttttgttttgtttttccattaagagacctggtgtcgggtcaggcgcagtgactcatgcctgcaatcccagcaccccagaaggcggagtccggcagatcacctgaggtgaggagcaggagaccagcccgagtaacatggagaaacccagtctctaccaaaaaaataaaaaaataaaaaactaacttggcatggtggctcacgcctgcaatcccagccactcaggaggctaaggcaggaggaccacccaaacccgggagatggaggccgcagggagccgagaccgtgccactgcactccagcctgggcaacaagagtgaaactctgcctcaaaaaaaaaaaaaaaaaaaagagaccggtttcaccacgttgcccaggccggtctggaactcctaggctcaagtgatcctcagtgctcggccgtccaaagtcccagctgggatcacaagcgtgagccaccaggccaggccaatctattcctttctgattaataaattgggccggtcacggtggctcacgcctggaatcgcaccaccccgggaggccgaggcgggtggataacctgaggtcgggagtttgagaccagcctgaccaatgtggagaatactcgtctatactaaaaaaaaaaaataaaaaaatacaaagttagcaggtatggtggttcacacctgcaatcccagccactcgggaggctgaggcaggagaaccacccaaacccaggaggcagaggcccagtgagctgagtccacgccactgcactccagcctgggcaacaagagcgaaactctacctcaaaaaaaaaaaaaaaaaaaaaaaaaaacaaaacccaaagcgaccgggtttcaccgtgttgcccaggctggtctggaactcctaggctcaagcgatccgccgctctcggccgtccaaattcctgggatcacaagcatgagccaccactccaggccaatctattcctttctaattaataaattgggccaggaacggtgactcaagcctgcaatcccagcacccagggaggccgaggcgggcggatcacctgaggtcgggagtctgagatcagcctgacaaacatgaagaaaccccgtctctaccaaaaaaaaaaaaaaaaaaaaaaaaaaaaaaaagccgggcataggggctcacacctgcaatcccagccacttgggaagctgaggcaggaaaaccaaccaaacctggaggcggaggccacaggcagccgaaaccacgccactgcactccagccagtcaacaagagcgaaattctgtctcaaaaaaaaaaaaaaaaaaaaaaagagaccaagtttcatcatgttgcccaggccagtctggaactcctagtctcaagtgatcccccacgctcagccatacaaagtcctgggatcaatcgtgagccaccacgccaggccgatcagttgctttatgattaataaattgggacttgcgcagtggctcacgcctgaaatcccagcacccctagaggccgaggcgggcagataacctgaggtcgggagtttgagaccagcctgaccaacatggagaaaccccatctccaccaaaaaaataaaaaaagagccgagcatgatggctcacgcctgcaatcccagccactagggaggctgtggcaggagaaccacccaaaccggggaggcagaggcccggcgaggtgagtccacaccactgcactccagcctgggcaacaagagcggaactccgcctcaaaaaaaaacaaaaacaaaaaacaaacaaaaaaagtgacccggtttcaccatgttgcccaggctggtctggaactcctaggctcaagggatccaacacgctcggctgtccaaattcttgggatcacaagcgtgagccaccacaccaggccgatctattcttttctgattaataaattgggctgggtgcggtggctcacacctgcaatcccagcaccccggtggctcatgcttacaatcctgtagcaggatttttaaggaattagagagactgatggggtttaggaggttattaattaattatttacgtgcattggcccagtcggattaacatttaaagcactgagttctgaacaagacttaccttttaagcattttatggggtgggggtagatctgtgcagggtgaagcatatgatagaagtgagaaacaaagataattgttcaattgaatcatgcattatattattttttccttttttaggaaaaatatgttttgtaacttgagtttgtttagtgaccttgcagttgtacagttagggaattagggtttttataatgcccgggaagggaggagagataaggctcactgccatagaaaagcaggaggtagtagttttttttgaaggactctagctcttctctttctcagggggaattgggtttttttacatacaactgagtttttgtttacacatttttaaatttcttttaattcctgttcccatcccagcaccctgagaggacgaggcaggcagataacctgaggtcgggagtttgagaccagccccacgaacatgaagccccatctccaccaaaaaaaataaataaataaattagccgggcatggtggctcagcctgcagtcccagccactcgggaggctgaggcaggaatattttctccctcccttagataaaagatagcatataccattgtgcactttgttttttgacctggggtggggtctcactctgtcactgaggctggagtacagtggtgtgatcttggctcaatgaaacctctgcctcctagactcaagctgtcttcccaccccagcctccagggtagctggaaccacaggtgtgtgccaccacacccggctattttttttgtatttttggtagtgactgggttttgccatgctgcccaggctgatatcgggctcaggcgatccacctgcctcagcctcccagagtgttttcaaagtgctgggaattacaggtgtgagccactgcatccggcccattttgcacctttttaaacttctcttagagatcacttcatatctgtttatagaaatgttcttcatcttttttaaaattagtactttgtagtgtggatgtaccacttttttattcagttaggttttttttgacatttgagtgttaggtctttttttctgacattacaagactaaaatatgaaaagaaaaactagaaaaaatttcaaagaaaatttacctgtctttgtgatcttgttgtagggaaactttttgtaatggttagtatccaggatatgaaaaatagcctaataatgaaaagaaaaacttaagacaaaatgggcataggatgtgaagagttactttatagaggaagaaactggaatggtcagtaaacatgggaaaagatacttgaactagaaactcatggataaattgaaagttaaaatgactattctgtcatcttcagattggcgaaaatgtaagtctgacagaattgctggcagagatatgggccagtggaaactcagctaggtaaagtggagcgcaattttataatctctaatgaagttgaagatgcacatacctgagcaaaaaaacacatgtgtacaaagaaatttggaaaacctgtttatcacagtagtatttgcagtaacataagatgatgcagaatgtaagttaaccaacaagagattggataaactcatatccatgtggtggaatattatacagcaattaaacatgaacatactagattgaaaagaattaacatgggtaaatctcatgaagaaaactttgggtgaaaaaggcaagctgcagaaggatatgggcaatataataacatatgtgagtagttcatttccatatttatgttgtttcaaaggagttatcggccaggcacgaaggctcacacctgtaatcctggcactttgggaggctgaggtgtatcgggcaaaattcacccccgatatttcacatagtttcttttctattttccctaagtgttggccggtctgagaaataaaggaacagagtacaaaagagaaattttaaagctgggtgtctcggggagacgtcacatgttggcaggttccgtgatgccccctgagccgtaaaaccagcaagtttttattagcaattttcaaaaggggagggagtgtacgaatagggtgtgggtcacagagatcacatgcttcacaaggtagtaagatatcacaaggcaaatggaggcagggcgagatcacaggaccacaggaccggggcgaaattaaaattgctaatcaagtttcagacacgcattgtcattgataacatcttatcgggaaacagggtttgagagcagacaactggtctgaccaaaatttattaggcaggaatttcctcgtcctaataagactgggagcgctatgggagaccggggcttatttcatccctctgctgtgactgtaaaagacagtcgtccccaaagcagccatttcagaggcctcccctcagggatacattctctttctcagggatgttccttgctgagaaaaagaactcaacgatatgtctcccatttgcttttcaaagaagagaaatatggctctgttccgcccggctcaccgacagtcagagtttaagattatctctcttgttccctgaacattgctgttatcctgttgttttttcaaggtgcccagatttcatattgttcaaacacacatgttctacaaacaatttgtgcagttaacgcaatcatcacagagtcctgaggtgacatacatcctcctcagcttatgaagatgacgggattaagagattaaagacaggcataggaaatcacaagggtattgattggggaagtgataagtgtccatgaaatcttcacaatttatgttcagagactgcagtaaagacaggcgtaagaaattataaaagtattaatttggggaactaataaatctccatgaaatcttcacaatttatgttcttctgccatggcttcagctggtccctccgtttggggtccctgacttcctgcaacagaggtgggtggatcacctgaggtcaggagtttgagaccagcctggccaacatggtgaaacctcattttggggtgtggtggtgcatgcctgtaatcccagctactcggtaggctgaggcaggataatcactcgaaccggggaggcggaggttgcagtgagcccagattgcaacactatactccagcctgggtgacagagcaagactccatcaccaaaaaaaaaaaaaaaaaaaaaaaaaaaaaaaaaatctcttagtttctgatggttttcctgaccatatatgtgatgccgaagttgcttttttgttgtcacatctattggcatcaagtgctgaacttttcatggagtggcaattttttggtaataaagcaactttcaaaatgagtctaagtttatctctggaaaagtttgaaagaatcagtgaaggttcttttagacagtacccatgttctacagatcagccattctctgtctctcaaattttcagtaaacctttccacataggatgtcagcacgattttaatacgttaaatatatgtaaaataaggcaaattaagacacaactccatcaactctcatctgctctgggcttatttctcttcatagtacataacaccatctacgtcatatacttattgtctgtttctattagagcagggtatttttgttagtgctgttagtgtgctcagcatatacagcaacacttggcagacagtaggtgctgaatgaaagaatgaagaagaacagaactcattttactaaagacattttgatatcacttttgggataggatactatacattaaagatgatacactgtttattccagaatggtcttagctacagtgttcacagcacagtatttgtagacttaatgctgttatccattctaccttcctttgaggttggcatgagagttgcccgtcagcgtatgtgtgctcttagaaatcagggacaatactatcattttaagcttcttggcagtgacgtgtacttaactagatggtgaactcataggtggatggggagtatctaatgcttttgtattctgcttttcagcaaataaatattaccgtactgtgtgtgtaacatgagctatgtaagtgtgtgatgattaaattagaagatagggttctctgcaatccagttttccaagataaatttttgccttgtttttgttaggtaataaaggtaccatattgactgttgatatatgcctacttagtcatgcttctcttgcagtaatcttatcaaattaccagctttttacttttttagagagacagtcctagaattgagaatcctcctttgcctacattcaaaatgagactatattatgtgggtaggaaatttctggtgacctacttttaatttttaaatttaaaaaaatattagcatagttttatatttagaaaacagttgcaaaggtggtatagagagtttctgtgtaccacacaggcacccagtttcccttgttgctaacatcttacatgattatggtatatttgtcacaactaacaaatcagtattgatatattataactaaactgcatacttttaggggtagtgacccagttttaaagcttatttcccacaatttgttaaaaatgacaatcagtattgagtgcccatgggtggtggcttcctgattcttcaaagaaactgagtaattttgtaaccattgggacttatcaggaaataaggaactcataataatgtgcgcttaaatttccagtggaggaattgtacagcttaacatacggttttgtaagttgggtattaatacataaagaggctgggtggggtttgatcactattaaaactgatttgttttgttccctggaaaatatgttactaccacatggtctacccttcatagataatcgaacctaagatcactgggcagaaaagggttgccctgtagtaggaaatgtgtcctcctgggactgagttgagatttagtttagcacacagaataagtagccaatggctgctatgagtctgacttctataattcaaattggtataaattaaatctaattcttttccccaggactgcccaatttaagattaagttttatactggcgcttattagagatatggccattttgccatttcagtggaaccttttaatcagctttaatgctgtcttaggtaaagtaaaaacttaatctaagggcttttctagtttgccatcctcaaagcagaaaaagcagcaatgaagcagcactgcctcatatagactctgcttttattaaatttgcttcaataatcctcttccagtcatcttttgtgctgcatatttgaaccataaaataagcaaaaactgtacccaaatgaaaatttcaagttattttaatgaagctctggaaacatcccagagctcagaagatgttttttcctagtttattttttaaattctggaaagtaggtcagtagacataccctgctttaattggtttaattagaagtgaaaaattataggactaactcaatttgaagtatagatttcaataagaagaattatactgggatgaatattatttaaggttttgaatttaagatgcatttaatcaatgcttataatttcctcttgaaaagatttatattgcaaaaaagaagactaagtgttggaatatgtcaatatatagggaaaaactttgccatgaaatataatatttgataaaatcattttagaattgtatctctaaatggtatgcctaagaatattgttctataggaccttaatagatatgcctcgggggaaaaaagtattgtgtgctcaagtgagtttgagatatactgcattaaatataagaagttgcctgcaggacttctcagagtctttaacactttctgaatttctgagacaagatatatagagggtacagtactttgcaaacctatttatccctataccacctagtaacatttttcaggaaaatgttttgagaacacgaatttgacctgttttaggaatttatacctttgacaatgttgaggaccttgttttttcctattataatgatgatgtgatattcacatatattactttttcccaattctttaagatatttttccaatgtattatattcaaccctctgctcagtgccttccttctgctaactaaagtgatggtttccgtctgttgctacacatcagacatacttggccctgaccctggagattctgtatgaacagaaatgccagaatacctgctcaggattctgtatttattacaaacacccaggtgattctgatgcagccaacactggtcctccaactgatgctttggaattgttgaactaaaagcatgcctttttttctagatggatgagtagattggggcatagtttgtggtcctagaacacatgggttaaccatccctcctagtgagaatgatagcacaggcctctgatgaccccacgaggtgctgtgctggctataacctaacatgaaacgatcattattccttaagaaaagcagaatatgtctaaatgggcttttagccaccttcctaataatgaagtaccatatatatgactaccatttgttttaatttcaagtaattcccttgtagatgatgttttatttattcttttttttttttttttttgagacagagtctcgctctttcgcccaggctggagtgcagtggcgcgatctcggctcactgcaagctccacctcccgggttcatgccgttctcctgcctcagcctcctgagtagctgggactacaggtgcccgccaccgcgcccagctaattttttgtatttttagtagagacggggtttcaccgtgttagccaggatggtctcgatctcctgacctcgtgatccgcccgccttggcctcccaaagtgctgggattacaggtgtgagccaccgtgcccggcctattctttaaaaagaatattagattatattttctaaatgtgccaagtatctaagaatatattctttcacctcctgctgataagagttatacatttaaccttaagcaaatctgccaagattctatgtcatttatgctttgatttatgtgagtattaatgtagtttctgtgactattatatggttatatataccctccacctagtaaaacagttccatattcctggaaatggtcttttacatcctacaagtgtagctggaaaggaataatataaatactaatggtttgagagacaactagtcttgacatgtcttggttgaatagtgttctataagcaacaatatatgaaatactagacatacccattaaaagcagaaaatacccactactgttttaaaattattctgcaagatctcatcaatgcaatgagacataaaacagaaataatgggtgtaattattgaaaattggagataaaatttttattacttgtaaacaaaattctgtcaaaaacctgacaaattaaacaatacaattaatatgtttaatagaactaattacatatgagaggcatccaaaatccattttttctatacaaacatggtttgatatacagtcattttatctgtgtattaattggtttatgaaataacaaatagaaaaatcaagtatgcattatcaagttaaagaagcaggagagatggagctataaaaacaaagagagaagaatgttgtaaggagggcttaacaaccaggataaatgttgtagaaagatcaattaaagtgatggcctagagatcacgggcttcctttggcagagccatgttggtgaagtgaaggaagtggaagccagaccacaatggttgaagaatgaatgtaatgtaagagccaagacatttatttgagtctgatagtaatgaaaaaggacaagaattttcttcttgctgttgtttttgtcatttcatgttcaaaaccctttatctcccatgtggtactgaaaactccaagatgggatctctgtttctgtgaggcctgtagtgcttagtacatccttgaatgtgtgaggctctcattggtataagtttaattcctgactgtggatgaaagctttaaaactttgcgggcaaaatacagaatgaatttcagtgagttcccatgtattaaacaaggtggcgctggctggagacatgctgtccctgtgcccacaggagtagcagtgctgtgctcatcttcctgacccgctcttcacagtcttcaccgcctttcttcaggagtctcccctttggcttttccacagctatgaaacccacgtagtcggacaccctaatgcttctcctgtagggtgtgtgatgaggaggtgagcttggctttggagtgctgggaacctgaggaattgccaaggacccagagcccagccctgaccacccagagagcccaaaacacaatgaacaaattgaatttccacaacaacagagtcatgcaagaccgccgcagcgtgtgccttttccttcccaatgagaatctctgaacatcatcataaatgtgagtagatctcaatataattctgatagctggaggatagtgtattttcaggtttgctggagggaaaaaactggactttaaataattaagacaaaatgattgtattaattgacttctattcttaatcactaatttcattttttatatttcccttgacttttgggggagaaatagtctttgtctcaaaagtgggcttcagtgacctatgggtttgataaagcaaccagagataatgagacaagaatatttaatggcaacatgccagcaattattattagttaattgaaagcgtttatgattttggcctggggccaatgctttccccctctgctggactaacatgtgggtaaaggagaggaaaagctttgtttcactttttaaataaaagtattacgtaactttgaaatttgtataaaattaaaagatagtaaaaacaactattctaacagaattcaaaacctgttatgcttcagtggagagattattcaagataagtccgtgggaaattgggagtacatttctactggcaaagttagtgataactatgcacttctgacaaaatgtgaaatggggggtatgggcgtgtcatatcatcatggtgcagatacgtggatgtgtgcttccaaacaatggcaacctaactgactgctggaaccatacaaaatacctgaaactactcagaaagaaggtgaaaattgcatgcaaaaattatttgaaaaatattgagctaacacaacatgaatttggaattataagtgaggtattgtaactcacctacagatgtgttttttgtaatcaatattcatggactcagactacacagtaaaagcttacatagaaatcattctatctaaactttctggatacgaaagtaacctagtatgcgttttgctactatatctttatatgaatttaaatcacatttccaagtggcttacagtaatcaaggttgtcacaaggaagatgcaaattaaaaccacattgcaatatcactgcacacccactagtacggtttaaaagaaaaaaaaaacagaaaatatcaagtattggtgacaatgtggagcaaacagaactctttttcaataatggcaggtatgtaaagtggcacaaacactttggaaacctgtttggcattatactgtactaaacctgaacacacgcattgtttatgacccaggaatgcccctcctgggaaccaacaacaacgcatatatgtgttgcatatgttcaccaaaagacatttacaagaatgttcatagcagcactatttgaaatcacccccaagtagaaaatgcacaaatatttaacagtagttggataaagtgtggtacgtttatgcaatataataccatatagaaatgagagtgagggatctgcaaactaatatgcaactgtacaaatgaatcccacaaatataatgttgggtggcagaagccagatgcaaatgaatacatgctgtagatttcattcttttacattaaaaaagctagtcacacaaagttatgctgttagaagagagtgatttggtcgggcgcaggggtagttacaggaagggagtacacggagatttctggttgttagttatgttcagtgtcaatctatgtgctaaacaggtacaataaagattttagaattcatcaatttgcacacttatgatagatgcactttcctgtatgtatatttcaataaaatcttttaaaaagtaaaatgacaaaaagacactattaacaaaaatgacatattatattaactgttatactaaggaaaatataaaaatgagttctataacaggggctctgcaggtcatgtggtcatgccaaggaccatatgtgctcaagattctcatgacattttggaaggaggttgggctttctttatctttcctttcttctctcccttcccttcccttcccttcccttccctatttttaaacctaggtttggtattttcctggggtgatggtgactttggaaaattgggccggggcggaagtgaaggctgcaacattccccagaacattgagagactaaatggacagggggtgtgccagattgagtgtggagctcagttcctactggcgctcaccaagtctggagtggtgtggacatggtacgtaaacgtcctccccgtcacagtgtgcgtgcttgtgccgacgcgtgcagggaacttgggcctcgccccaggaccaccccggcgtgattgtgacctgtcatatttttacttatgcatgcatctttgtcctttaaaggatattgagtcgggattagtgacaatagtacaagaagaaatttcctattgtaactgggtcattttgaaaatactagaaaaattttaggccacttacctttcctgtttgggcgagatttataggaagtgtttcttctgctgaagcctaaggataaaatgagagcaaaatagccttctgaatcctttgatcctgagaaagttaacatgtatttcttgtaaaagcttattatattaatgtgcaaatgagcaggtgcccagactggccttggatgctgtgtcaggccttgctgcctctggtcataacattggcactatttatttatttatttatttatttatttgagatggagtctcgctctgtcgcccaggctggaatgcagtggcacaatctcagctcactgcaagctccgtctcccgggttcacgccattctcctgcctcagcctcccgagtagctgggactacaggcgtctgccaccatgcccggctaatttttttgtgtttttagtagagatagggtttcaccatgttagccaggatggtctcgatctcctgaccttgtgatccacccgcctcggcctcccaaagtgctgggattacaggcgtgaaccactgctactggccgacattggcactctgagaaagatgtataccagataggactttggataggtgtttgcagtaatgtgtcttattttcagtctatatgaaaacctacaacagtaacttaaatattgtagaacatgtattaaggtattaaggtttttcccagctgacttaataagttaatttgaattaatggtgtatgattttgaatacaagttcgaagaccttgggtgctgtgtgtgatgtcattgagctggctgtgaaagatgtgagacaatgagtgtcttcttgtatagcattgtcagaccacaactatattgtaacactccaccacgggcctccttctcaggggaaagggggattacttcaggttgcgccagggctctgacgtgcacgtgtggaaactgtaggtggtggaagggctgagagggaagaagatcgtgcatgtggctgtcggggccctgcactgcctggcggtcacggactcggggcaggtaaggctgcaggtggcctgggggtggcgtgccatcctgacttgggggacgtgggggtcacgacatggccctcgtcctgttgaaatcacagctgttgatgaactcagccgagtcttactgcttgaagaaccatgaggccgggacccatccgttttgcccgctggtgtatctgcctactcagcagcaggggttgggggcggggtcctcagaaaagaggcgttcccactctgaagtccacgtgaaaagtgtgtggaaagattgttatcctttttttttttttttttttttgagacagagtctcgctctgtcgcccaggctggagtgcagtggcgcgatctcggctcactgcaagttctgcctcctgggttcatgccattctcctgcctcagcctcccgagtagctgggactacaggcgcccgccaccacgcccagctaattttttgtatttttagtagagacggggtttcaccgtggtctcgatctcctgacctcgtgatccacctgcctcggcctcccaaagtgctgggattacaggcgtgagccaccgcacccggccaaaagattgttattcttgaagatgctcctactgcaaggtattaacaagactttgctttaggaaattgctaactggtgaggaggcacccatgcctcattttagagacagagctagtgcctgacaagtgttacactctcttctgcttggagaagcatatgctatgaccggcttgtagatattcaatttaaaattttatttatgaaaacaaaattaccattactgttttttagtcaaaatgaattatactttataattctataaggccaaggagctacttacttgaaaaatgagcatattgtttttggtcatttttctttgcaaagtaaaagggaaaaaattattgcacttagttgaagagaggaccttctgtgtgacttgcaacaaagcagaattaatttgattaatattaagaaaatactccttttatggttattggcattttcatggttagattttcttcagaattatagtacaccgatgccattttgtaagattgtgaaatggtttgcttttacttttaagaactcaattctttcaaataccatggcatacacgttaagcattttgaagtaaaaattacattaaagaaaatgtcctgaaatgttgaaaaattataagcttttttctcctcgtaaacaggtgtatgcttggggtgacaacgaccacggccagcagggcaatggcacgaccacggttaacaggaagcccacactcgtgcaaggcttagaaggccagaagatcatgtgtgtggcttgcgggtcatcccacagtgtggcgtggacaactgtggatgtggccatgccctctgtccacgagcccgtcctcttccagactgcaagagaccctttaggtgcttcctatttaggtaacacagatttgtatcctgagatttttctgtaggttacagcaactttacatttatttaattgtgccaacacattagaggttgtagtgctgcgttaactacattatgaatctaaagacacagaagaattatggtgtgcgctcatgtgatttatacatgctggaatgaaagttttagaagaaagtatgttgctgattcttgtgtttatgatcaggtaaattcacagcgctgtacttgtgtgtaaacaggactcctaataactgcctgagagatacaggcactgtactgggctcttttgtattttttaacagctttattcagttataattgacatataataaactgcacctatttaaagtatgcattttgatcgactttggaatatgtatgatccatgaaagcatcagcacaatcaaagataatgaactcatacactaccccagcgtttctctctggccctctgtacccctcccttttgcttttaactccctccttcctgccgtatgcaccaatttaatttctgtcactagagatcagtttgcatgtctgctttttgttgttgttgttttgtgggtgttttatttgtttgttttcttttttttgtagacagggtctcactctgttgcccaggctggagtgcagtggcacgatcttggctcactgcagcttccacctcctgggctcaagtgatcctcccacctcagcctcccaaagtgctgggattatgggcaggagccactgtggcaggccagtttgcatgttttacagcttactataagtagaatcatacagcatatactctttttaaaaatcttactttttccactcagcataataattttgagattcacttacgttgcatgtatcaatagtttattcttttaaattgttgaatagtatcttaagataaacaaatgcaatttgttcatccatttttctgttgatgaatgtttgggctgtttccagtttttgactatgcaagtgaaattgctaatggacatttccatacaagtttgtgtatggacatccacttgaaattctcttgggtaaacttctaagagaggagtggttggatcatatggtacgtgtatgtctagcttcttaagatcgctacatactgttttgcaaagtggatgttccagaggtccacatcctccacatttttgtcaacccttgatacattcagtctttaattttagttatactgacagatgtatagtggtatctcgttgtggttttaatctgcatttccctaataactaatgatctcaagcatcttgcttatttacaaatcacataccttttttggtgaatgtctgttcaagtcttttcccatatttaaataggttgttttcttactggtttgagagttccttatatattctgagttacaagtcctttgcctaatatagaatttgctagtattttctgtcagtgtggcttgtcattttattctcttcacaggtgaatcttaaagattagaagtttttaattttgatgaagcctagtttattcattttattcttttgtagagtgtacttttgatgttgtgactacaaaacctttgcctcaagattatgaagtttgtctttctatgttctgttatagaagttttatagttttagacaggtatatctatgaccagttgattaaattttatatatagtgggaggttcagattgaaaggcttttttgggcatgattgtccagttgtttcagttgtatttgttgaaaaactacgcttttcctactgaattgccttttgcctttgtcagaaatcagttgtctatggatgtatggatctatttctggactcccagtactgtttcattgatttatttgtgtattttggtggcaatgccacattgtcttgattactacagctttataaaaggcctgaactcaggttgcaacagttttttagctttgttctttttcaaatatattttggctgttgcaggccctttacatttccatatgacttaaaatgagcttgtcagtttttataaaaccgcttgcttgggattttgatgtggattgcattaattctgtaagtcaatgtgcaaggatggattcacagtattcagtcttctaacccatgaacatagtgtttctctttatttgttaggtgtccagtacataatgacacatgaagaggcaaaaaaagcgactaaaaatgaccagaaatgataggagagaaacagacccacaagggctccatatattggagttagaagacacagactttagtataataaatatgcttactgtgttcaaaaagataatatttcagcagagaaccaaaaactactgaaaataaaatagaaagactagaactgataaatccaatatttaaaattaagaacttaatgagtaagtttagaacacactgaactcagctgaagagaaagtaaaaatatctggaatgaagaactgaggagcaaaagtttagaaaacataacaagaaggtaaaagatctgcaggacagaggttaggcctaacacaagtgaaagaagagtccccccaaaaagatagaaaagagaatagagcagaggcaaaatgtgaagaaatactgaaagacagaattttccaaaacagacaacagatatcatgccccagaagccctaccaaccccaagaaagataaacatctccatgcacatgtaaaacctgtgccagatgaaaacaaaaagactctctgaaaagcagacgaaggaaaaataaaatgaaccacaattagacttccatccaacttcaggagaaataatataaaccaaattgcaatggaatactatttttaaagtgctgaaagaaaacacctagcaaaaagacttttcaaaaataaaggagaaataaagacattttcagacatacaaaaatagataatttgtaaccaacaaagacacatttttaaaaatattaaggggattttcaggcaggagaaaaacagtatagatggaaaattaaagaagaagaaaaaagtggagagaaattacaaagtatgcagaaaaatctaaatcaatattgactacataaaatcgtcatatgccctgcatgtattgtttgatcctttgacttgtttttttgctttttttgttttttgagacgtagtcttgttctgtcgcccaggctggagtgcagtggcacgatctcggctcactgcaagctccgcctcctgggttcacgccattctcccgcctcagcctcccaagtagttgggactacaggtgcccgccaacacaccggctaattttttgtacttttagtagagacagggtttcaccgcgttagccaggatggtctcgatctcctgaactcctgattcacccgcctcggcctcccaaagtgctgggattacaggcatggatcatgaggtcaggagatcgagaccatcttggctaacacggtgaagccccatctctattaaaaatacgaaaaattagcttggcatggtggcatgcgtctgtagtcccagctactcgggaggctgaggcgggaggaatggcgagaacccaggaggcggagcttgcagtgagctgagatcacgcgccactgcactccagcctgggtgacagagcgagactctgtctcaaaaaacaaaaacaaaaacaaaaacaaaaacaggcatgagtcactgcgcctggctgatcctttgactttttttgaaattttgtttgagcatatgacccacttagcatatgactggattttatgaacattttctatgtgcataaaagaatgtcttcgatagttctgttagatatatatttgtataaaatgtataaaattttggctggacgtggtggctcatgcacataaccccagcactttgggagactgaggtgggtggatcgcctgaggtcaggagttcaagagcagcctggccagcatggtgaaatctcacctccactaaaaatacaaaaattagccaggcgtggtggcaggagcctataatcccagctactcaggaggctgatgcaggagaatcgcttgagcccgggaggtgtcagttgcagtgagccaggatcgcgccactgcactccagccagggcgacagagtgagactccgtctcaaaaaaaaaaaaaattaaaaattaaaatatgttaagaacatataaatcagaatgaagataaatgatgttaaagagaactaaggtctttgcattgtttaggaggagactttactaaataataatagatttaaatcagtcaaaaatagatgttataattaatatcttcagtaactactaaaactaaaaatgtatataacacatacactccttatagacagagtgagactctgtctcaaaaaaataataattaaaaaaaaaaagtagaaaagttagctgagcatggtggcaccggcctgtaatcccagctgctcagcaggctgagacaggagaactgcttgaacccaggaggtggaggttgcagtgagccaagattgtgccactgcactccagcctgggcaacagagtgagactctatctcacaaagaagaaaagtgatatatgcatacagtggaatattattcagccattaaaaaggatgacgttctgacacatgctacaatacggatgaagcttgaagacattatgctaaacacaaaaggataaatcttacatggttccatctagatgagatgtctggagtggtcatattcgtagagaccaaagttagattcaaggttaccagggttggggtaaggggaagtagggcagttaaattgcttaatgggtacagagtttctgatcggagtggtgaaaagttttggtaagagaaagttgtgatggttgtgcaacactgtacttaaggtacttaataccctgaattataaacttagaaaatgactaagtggctaattttaagttaaatatattttgccacaatgaaaaatataataaaaggtatacaaattaaaacactcactctccatctaaccaattccacatgccacgcaactaaacacttactagtttcttgagattcttttaatgtttctttatggaaaaacaagcaaacaagcctagttattctaattcttccccgataccccatcctgatttttttaaaaagccagccagtcatcagcgggtaggaccgtcacttccgtctcactgtactcactctacagaattaccatatgcaaaggaaccttaaaataacaaattccagtacactgtggtccacaataagtatttcattaatatttggtggaagagagaatataaacattctgccatacctggttcatttattctgccaaatgtatgcctggtattgtgttttttggtcttgaaacacgtttcacaaaaatcaaagtcatcacagtttctgcatttgaatctggatccattgataggaaacatctgacatccatcacacctatttgtaaaatagcaactgagttaagaaaggtcatttattaaacttaattcaacagaaaaccattcgtcccaaagcaaatctagcaatcataaaaataactcacgtaaccccaggatgaatactgggcaccaactccatttctgatagcaacccagtccagtgagactgctggggaaagtcaacaatgatatcttttccattggcactgaaagccaggacacaacagaaatcacctgatccatcttcctcttcaccaataaaaacctgaacttaaaactgcacctagccatgtcatactacattgtagttatttgttttttacaaagagtctatcttttagagataggtactaaaatgcttatggatgaactaatatatgatgtcagcgcctggtttcaaaataatcacaagaagggagcatgaataattttggccatgaggcgacaatcgttaaagccaggtaatgagcacatggaggttcattgtaaactacattccttacttttgcattaggtttaaaataggacattttggtttctaattacaccaagtcaacaattccatacaatacctttggtatctcagggaataaaaaccacattaataacatgaagacttctttcatcctttgataagagcaacgtgtcactcaaaacaaagaaaccaaattcttatttttaaaatttgtcttgttttgatttgcaaatattttaacaatctcttaagcaaagaaaaatgtttaaagtaaaatattaaataatccacttgttcttatgtaacatgagaagctctaggaacctctcaccactggggaaccaccaactgtggccattttctaagcgatctgatgaaaagagaggcttccacaaggttcaaacgaacaaacaaataatctctttatgcatcaagagtttataaaactatacacatacttatttctcatgcaactgttaaaacggacatagtgtgcctttcaaagtgtgccacggatttgatttggaatctcaacagtatcatattaaatataatctgagaattgtttccagttcctaatttccatcattagcacatttccatttcttaaattcagtcctaaatttttatacagcatgaaaaagagccaggcatggtggctcatgcctgtaatcccaacactttgggaggccgaggtgggcggatcaataggtaaggagttcgagaccagcctggccaacatggggaaacgccatctctatgaaaaatacaaaaattagccaggcacggtggtgggcacctgtaatcccagctactctggaggctgagactggagaactgcttaaacccgggggcggaggttgcagtgagccaagatggcgccactgcactccagcctggtcaggggaggagaaagaaaaagcagtcctgacagtcaggagctggcctgttaatgtcaatgttaggccatttcacagaacaaatgacaggacaagtttacagaacacgaacatcagataaggccactctgtgactgatgaatcaaggcacaaccaaaacccctccttaaccatgtgtgattaaagttgagtctaatccaaaccacaaacaaccacacagtcccctatcctggtgatatgaatgactgcttccttaccaatcatgacgttagcatggctccattctttctgcctgctaggtaaatttattaagacatcctgttttaggattacccctgctttctcgacccctcccccaaatacccaacataaacttcattagtcctcgctcactccctctgatggagacacccattccccaaggtgtgtgttctcctgtaccgcaatgagttaatattaataaatctgattgtttcactgtaggtgagttcctttgtggcctttggcagaaggcactgacaagcaaaggaacactctatctctttcttcacacttgttttctgttttgtgtgcttgaacaaaaagaaatactaagtacatatgcattaatgaaaagttaacatcaggaatttaattacccagatgatattacctttcacaacccccacactctgatgagtcacagatccccatttgtattttggtgtggtgacagaggctttgacccgcactttatcaccaatcttgatgtgagaagaacttcttggtggaggatagcctacagatttcaataacaaatcattataatcagtattcatttatgggaattctgtctctaagaaaaagtaaaagcactaaacaaagaatgtgctcacctataagttccacatgaatgtacctaaaccagtagatgccccctttctgctgccagtcacactgcacattgagatcatgcaatccatctctgtccagcttgatgactttgccaacatcacatcaccttcgcacacttcttcgtatgttcggcagcatctaaccatcattcccacctagaattaaaatgaaattggagatccagtccatcatgtacacaggtgaaatgagccatgataagtagtattactctactcttaataaagaatttcaactgggcacggtggctcacatctgtaatcctagcactttgggaggctgaggtgggaggatcacttgagctcaggtgtttgagacaaacctgggcaacatggcgaaacccacctctaccaaaaatacaaaaattagccagatgtgatggcacatgcctgtggtcccagctacttgggagacttgagttgagaggattgcttgagcctggaaggtggaggttacaatgagccaagatcatactactgcactccagcctgagtgacaaagtgagaccctatctcaaaaaaaaaaaaaaaaaaaaaagaatttcatctagcacccagagtgcattctaagtattatttaatgataaagggaagagaaactctttagaacactgtctggctttgtgtctcaggcaggaaatatacaggaagaggctggatcaacttgtatcataaaggaagggagttttcaaagattactcaaaaggattccctgatcatcaaaaatataacagtggagacatcacaccctaaaagccaatggattggtcatcatgacaataaggaaaacgaagcttcctggtcatctttatacatatcagaacaccaatgcatcattgtgaaaactgatgaagtctccctgtattatcaagagcaaccaagattaataacaaagctttttttcacagaagagaattccagctaatgaactcagagaagatgaagttagaaaatcactatggtgcagcccctaatgataggtctaggtgatgacactaatgcctgctggagctatgagatggacaattaatacagaatgtcatcaaggaaggagcaggctgacaagacctaacccacccaaacctgcttgcctgttgagatggggccggagggagtacatgcctatgaagcttcctgcctgagattcagcctggtccaatcaccctccaaccctaactcctactgcattggagaaacagggagagaggaagatgttagccacaaggaagccacctccaaatgcagactgtaagacatttggaggacatggtttcagccacaaataaatagcatgaaaggagaggaagggagaaggagggttactatgaaatgaatgtttgtatcccccccgcaaaattcatgaagtcccgactcctaatgtggcagtattaggagatggggcctctaaggaagtcattaaggtaaaatcaggtcataagagtggggctctgacacaacaggattagggtctttataagaagagactccaggatgggcatggtggctcacgcctataatcccagcactttgggaggccaaggcaggtggatcacctgaggtcaagagttcgagaccagcctgaccaacatgaataaaccctgtctctactaaaaatataaaattaaccaggcatgtggtgcatgtctgtaatcccagatacttgggaggctgagacaggagaatcgcttgaacccgggaggcagaggttgtggtgagccaagatcgtgccactgcgttccagcctaggcaacaagagtgaaacaccgtctcaaaaaaaaaaaaaaaaaaaaaaagacaccagtgctcccctgctagctccagctccccccatccccagccccacgtccacaggaggacacagcaagaaggcagccacctggccgggcacggtggctcatgcctataattccaacactttgggaggccaaggcgggtagatcacgaggttaggagatcgagaccatcctggctaacatggtgaaaccccgtctctactaaaaatacaaaaaaattagctgagcatggtggcgggcacctgtagtcccagctactcaggaggctgaggcaggagaatggcaggaacccgggaggcggagcttgtagtgagctgagatcacgccactgcactccagcctgggtgacagagcgagactctgtttcaaaaaaaaaaaaaaaaaaaaaaaaggtagccacctacaagccaggaagagggccatcaccagaatccagccaagctggtaccttgatcttggatttccagcctccagaaccatgagaaataaatgtctgttgttgaagctgccagtctatggtactgtgttatagccaactgagctaagacaagggggaaccactctagcttggaatagacttcaaagatccatcaaccaaatgcagataaggcatacaatcttggtttatccaagttcaaaaactaaccattaaagccatttctgagaaaactggaaaactacaagcaagcgttagatatgagatgatattaaggaattattatttattttgttaggtaatgctggtaaacagaaatgtcattatgttaagattctttattagtgatactcactgacatatatacaggtgaaatgagatgatttgggggattttctctaaaatatactaaaacaagagaattaggacaagaaatgatttaaagtagataaaggactatataaaacataattagatttttaaagtttgatggcaatgagaattacataagaaaaacaaggaaaggtatgtaggaagtgtcacaagtggggctagtagaaaacagccatccctgcgccatgtccaccgtggacaggccacttgtgctctccggctgcccctgagcccatctgcccctctgtcctctggctacaccggggcagccacagcagcctctgtctgggtgcccatcctgctcagccacccttcacaccctgtaggctttgcacccatctcaccttctcattgcagatcccgatccctggactgtgccctcactcccacccctttactgtagtctgctctctctcattccagggtacacagcaccttctagcgtaccatgagctcactggtcaggtatgtcttccagcaccagaaggcaggctccctgagggcaggggcctctgtccactgatgtttggcatataggacatacccaaatatttgctgagtgaaaaacggatcgaggctccagcttaagacaattactcacctgaatattctctctcacatatacagcataatcatcattacccaagaaaccagctcggtttttgtacgtctggctctccgtcacaacagcaccagtagactacaagaaataaatacattcaaagaaaaaaaaaaaggagaactcaataaatctactcaaaaagaaatgtctgtgaaatctataatattaaaaagtaaaggatgaaatcctttattttctctataaaaatcttcatttaaaaaagactaatagcagtagcatagtaggcagaaatgaatctcaaaagctacaagtatacaaaatttccaaggcacttccaaattaatcctatgaacaatttactcaggtcagaaactgatgtgtcaaaacatggtattttaataaaatatcctctaatggctaccgaagatcatgagatgtttgaacaagggtctgttctgaagctaaaagtaattatgatatagaaacccaatcatcccttcagtagtgaaacacagctttgttctgtgcccggcaacaccataggttggttttatgaaacagtccacagtagatatagttaattctttcaagggacagagaaagccaaggtgtaagactgttagagcgctagacggacagcggcccaggtgcgggcggtcacatgggaggcactgaccatggagtaggcggcatcatccatgtcctccaccacctcctcgtcagaatactcgtcggacaccgtgtctgcatctgagagctccgtgacctgtatgtcggagtggtccagcagccacccgaccaaggcttccacacctaagagaggcacacacagcacaccagccactgtgagtcaacagccctgaagcgggaacccacacacgtacaagcagaggccaggaaaacgaagtaccaggcaagccggacgcattcccggaagcaccagtgagagacttcagggcaaactcgatgttccttctgggaaatcccatctccatgagctgcaccacgatcggcagagcgggaacgggtgactgcttgcgcctcttcactctggcagggcggatgtgctgcacgttgacaggcgtggtggcctcactggagctgcagtcttcaaatcctgggctcgaagggtgagtggactccacaacggccagtgcagcagtctgggcagacaagagggtcctgggaggtttgggaagtgccctcggctagcttacacagtctaggaacatggggcatcatgcaagtctagaaagcccacattcacatgtgcgtttttcaatgagttcctaaaacatgttagaaaatgacaaagccaagtttcgcagtttaatgcagagaaaatacttggtggtaaaataacttgcctgtttcagcagacagagagcctactaaattagccaagtatcaatgtccattaaggaaaacttcattacagccctaagcgagcagtcacaggggcttgagggagcagggagaaaggcatttcccctgccttaaccaggcactgtggtggcggccacaggcacctgtgttttagacaggccagaaatgacacaggactctcatgtaccattaaaacaaccctcaactattcaagggttaaataaccacagtgaggttaaacaaggtattaaaaagtaagagaaataaaagagtattagttgggaaacacactgcaatgaatcagtgaacatctaaactgccagtctctacagctgggaactccccacctacagcacaaatagcacttccctgatctgtctgcaactccctggtcctcctccccagctgctctcatagcactgacttgctattttgttaaacggagcatgtgaggaaggaatcaggaagaaaccgaggacactgtggagccccccggtgctcaggaagtatcaaagcctagggttttgcagcgaagtctgggtaacttggaagtgacaggtttcatcctaaaagtttaaaattcagagccagattgagccaagagttctggttctgataatggggagttagggtgcattggactaacccttggctgataataatcatgaactctggataaaatattttttaaaactgcttgagggcactggagaacagctgacgcaatcagcaataaaacaagcacaacccctgaccccgagaagcctgcaggtaagacgcgcatttaaccacagacggcgcaccttcctgcactgcaggggctggggtcccggcctgccagagcaaccagaatgtgagggaaagcccgcctgagaaagaaaccacagagggaaaaccacgaaatatgcggacggactacccgcaaatctacagctgaatctaaactgaagcaccactgaagagcctgcgctcggcacaaagggaccgctggaaggctgcaggggctccccagctgcccagggccaggacagcatctgaggctcaagctcaaccaactagaggtggggaggagaatgtcaaggcttccagtgacgcccagaagagattctaaatccttgagaattaaggatccacaaccagggctaagggcaaataaaaaatcattagaaagcctggcaccaagccacctcaggatcaaggaggactgccaggtactgaactgcctgtgagaagaaaactccccattctccagaggaggcagaacccagagccaatacaatgtaacgtccaaagaatccagaatgaaataaaaattctcatatgtgaaggacaacaaccaataactgactataatcaagggaaaaaaactgcaaagagcagcagaccaacaggtgggcagatgttagaattagcaaacaagaaattcaacataactatcagaaatatgttttaaaatgtacagcaaaagatagatttggccaggcacggtggctcacacctgtaatcccagcactttgggaggctgaggcgggcagatcatgaggtcaggagttcgagaccagcctggccaacatggtaaaaccccatctctactaaatatacaaaaattagccaggcatggtggcaggcacctgtagtcctagctactcgggaggctgaggcaggagaatcacctgaacccaggagtcagaggttgcagtgagctgagatcacgccactgcactccagcctggtgacagagcaagactccatcaaaaaaaaaaaaaaaaaaaaaaaagatagacttaaaggatgaagaaaggaactgtcagaagagatataaaactattaaatgagagccaaatggaaataagagatgtgagaaatataaaataaagtatgtcttggatggatataacaacagattaggcccaacaaagcaaagcatcttgacctttcaaacagatcaagacaaactaaccaagctactaacaaggagaagaaagactttctattaaagtcataaaaggaaactcactaaccgtgtaacagatgtataatagtatttccagaaaagaacaaaaagagcaagacggggaaaaaaacagcagtcaaaagtttccaaatttggtaggggaacaaaaatcaagccaaagatgcaagcagcttaaataaatttcaaggaggatggtggggtgggcggggtgggccaccattgcatacatgagcccagcttagggaaactgcagaaaaccaaagataacacaaaatacgaaaagcaaccagagaaaacagacatttcatacaaaagaagagatgagaacaacgactctccatcggaatccatggagacaaaacagcggaaggtctttttttgtacaacagtccttctcagttcctgaagaacaactctacacggccttctaggtgttcacactcggcatctcccagcatgactgcagggagcacgtgcaccgccccacgtgctctcaagttgctcagcgtcttttgatctctgccagggagactggaaacacaaccaggccctttaaaatgaaccttcaccttggaggttcccagacctgagaagaagctggagttcagaagagctcatggccaacctcctcccttcctgcccacacccgtttcttgctttctccctttgcacccccaccatctttccagctcgttctaggattgggggaggcctcccacctgtccaaggcagtggctgcctcatctggacccttgctcccagaagggccctgctatctgagggtttctgttagggtaatttctgattgccaaactgagtactgatagttttatttttgtctctgatattttgtccagatttttaatgtattacacagcaagaaagattttggaatgaacatctctaatcctctatgttgccagccatgaaagctcccatccctcttacactcaatcacgtcgcctcctctatgcgaacgtcccgtagccctgaccctgtgcctcgctgctgccctcacctgctccacagcatggagagagcggagaggctggcggcaccagagcacccccaagaggctcctgagtgaatgaaacaaacggctgccagagtcctgacgagcctctttgaataattctacttcctggaaaaagatcccttcatgaagatgtgagcgtttaacccatgctgcatctagttaatattttttcacaatttacacaaacccaaaataaggttaaacttcaaccctctcagtctttagtattataatgttctgcagactatgcacaaacatggttaaaccccaatgaatcattagaattatttgcgtactatcatttaacattcagaatagatccttaagaaaatatacacctagaaaaaaagtgttcacaatttagtgctgtggattaaaaactgtcaaggctgcatggctgtacctcaagttcctgtttatcaaatatggccttcacaggagacggctgggtggccgaggccagcagctgctgcaagaggatcatggggggctgcggcccttcaggagacatgtccccaaggtcaggtgataccactgctccatcatctgaatttaaaaacaaaatatgtgtaagattctattttcaactgcgaacaccactttactattaaagaaaatgcattaagcatgttaaatcaggtatgacttctgcctcattatgtgatagaaaaccaaaatcttcaaggttcagacatcgaacaaaaactagactctaggttgggtgcggtggctcacgcgtgtaatccctgcactttgggaggccaaggcgggtggatcacgaggtcaggagatcgagaccatcctggctaacacagtgaaacctcatctttattaaaaacacaaaaaaattagccgggcatggtggtgggcacctgtagtcccagctacttgggaggctgacacagaagaatggcatgaacctgggaggcgtagcttgcagtgagccgagatcacgccactgcactccagcctgggcgacagaccaagattcggtctcaaaaaaaaaaaaaaaaaaaaaaattagctgggcatggtggtgcgtgcctgtaatcccagctactcgcaaggctaaggcaggagaattgcttgaaccagggagttggaggttgcagtgagccaagatcacgccactgcactccagcctggcaacagagcgagactccatctcaaaaaaaaaaaaaaaaaaaggaactagactctaaaccactttcactgcctgcttttggtctctgtccttcattagtgcatctgtctcttagagccagcaaatgctccttcccagatttctgcacttggtctgattctttctctttttcttgagatggagtctcactctgttgcccaggctggagtgcagtggcacaatcttggcaaactgcaacctctgcctcctggctcaagtgattctcctgcatcagccttccctgtagctgggactacaggcacatgctaccacgcctagctaatttttgtatttttagtatagatggggccaggctgttgattagatttcaccatgttggccaggctggtctccaactcctgatccacccgcctcggcatcccaaagtgttgggattacaggcgtaagccaccatgcctgacctacacactctctttcatgttcactcacggcttcagtaacccctgacacagacacatcccacgtgcatatttctagctgtagcttttccagctaagccttgttgagatcattaagtgaccccaagtccaaatgtgacatgtgctcagggtgatggctttttgtctgttatgagtagctttaggtgcagcctttaggactctgtttgacacagccccagggagatccactgcgctcaagcccacttcacacatctaggtactcatccaggtactcacagcatttgcatgtgctggttttcttcagtgacaatttcaactaactagaccaggagctggaaatctttctcttaaagggccagagagtaaatagtttaggctgatgggctgtacagtctctgtcccaactactcagctctgccattgcagagcaaaagcatccagagacgatgtgtaaacaagtggtgtgcctgtgttcccataaaaatttacaaaaacaggtgcatggcagttttgtcaatctagctctgttcggagtccctgctcggcccaaagcacagacttgatcatcctgattcaggtctgctgtaattgctcatcgggctgagtgcagaacagaacagccaatccaattcccaggctccaatctcccaatctctacaactgggaaatcttcatgttccctacgacctctactattaattgattctatactttcaattgatttctttcatcctcagcaggtttaaaattaatttcatagcatcctctcctcttaagaagcaaacgcacacactccacattctactggacttgcttatttgtttcaaacacactactcaatattcctccctcaactcaagcttgaaacagcagtcaccttccactttttgctggttccccataaagttatcatctacaagactacaccatcacagtggatggcaccttccttccaccagaaccttctttcccttttcatgccttccccctcatcacctgacgcaggagcaattctccatctctgtcatctcctgtttcagatactcctataccttcctagcaggtgtatcacccgaaggtcaatgcttaccatgtggcccctaccacagctttccaagtgggcctcaagtttcaccctggtctcccaggtactctgtaacaggatgtcagctgcccatctagcttcagccccaccactcatcgaaaaaccctgagctccaagaagaggagagctgctcaacgtgcttccaaagactcaccacgttcactcctctcctcctgcctccaccaccagcagagtgcttgtctgctggcatctgtctgccacagccttcaaaggctgcccgtccagtgctcagctgccactggctccagacgcctgtggaaccactcacatgcctcaccgccccctggccccagagaacaaagagagccatctgcattcacttcctctcctcatccaaaccctagagagcaatgatcatagaaaaggacttctccgcaaaagacttagcataatgtctttcaatagttggagatcaaaaaatgtttttttctattaaaagtaacacaagctcattctagaaaactaaatatagagaaatataaagaaaataaagacagccaaaattccaccaaagattactgggtcactgttttgctaaacagataactatggcatatctataaacggatatacatagcagtgtgcttttctgttcacttactgttttcatgtttccacagcaataaacatatacagctagccctccgtatccatgggttctgcatccaaagattcaacaaaccacacatcaaaaatattcagaataaaacaattttttaaaatataattttaaaaagaatagcaataacaactatttacatatcatttattttattttatttttatttatttatttatttttttgagacagagtctcgctctgtcacccaggctggagtgcagtggcacgatctcggctcactgcaagctccgcctcctgggttcatgccattctcctgcctcagcctcccaagtagctgggactactggcacccgtcaccacgcccagctaattttttgtatttttagtagagatggagtttcaccgtgttagccaggatggtctcaatctcctgacctcgtgatctgcccacctcagcctcccaaagtgctgggattacaggcgtgagccaccgcacccagcctatatatcatttatatttttaaagtatttcggaggatgtgcataggttatatgcaaatactacaccattttatagaagggccttaagcattagtgaattctggtataactgggggtcttggaactcatccccatggatattgagggaagactatacatgtaccatcattttgaatggcaccatgatatcacactgtacggatacacaacataagaatgggtattttggtgtctacagtttttcaatacaaaaacaataccaaaaaggaggccataacgacactgttgaatacattatttttatttattattttttttgagacgaagtctcactctgtcacccaggctggagtgcagtggcacaatctgcaccctgcaatccgcacacacggcaacctccgcaccccccggttcaagtgattctcctgcctcagcctcccaagtagctggcattacatgcagccaccactatgccccgccaattttttttttttttttttgagacagagtcttgctctgttgcccaggctggagtgcagtggcgccatctcagctcactgcaagctccgcctcacagattcatgccattctcctgcctcaccctcccgagtagctagaactgcaggcgtctgccaccttgcccagctaatgttttgtatttttagcagagatggggtttcaccgtgttagccaggatggtctctatctcctgacctcgtgatccgcccgcctcggcctcccaaagtgctgggattacaggcatgagccactgtgcccaggtggtgaatacattatctttacatgccttttcgtgtgataaagtcccacagaatgacttgctgggccaaagtatataaatacatacatacatctatgcatttcaaagtccaactcatttcctcagacgcccattagatggctacaccaactgaaattcccagcagcagcctgttcatggagtgcggctttacgcgcatttgaagaaccagcttaggttcatcttgttacaatacaggctctatttctttggtctggggtgcagcctgggagtctgcatttctaacacatacctgcgtgccaccaatcttgctgacccatgcagcacactttaaatgggaaggcatgaaaatacctttttccctccccacccaccagatgccctcagtcttgtcttataagatgacgatgacaattttattcacagttggtggttgctgggcaggccacgtgtctgttttgtacatttataagccacctatgtccatttttatgaactgattattcacttcctttgtctactttctactgcccttcttataaagatttaagaactttttaaaaagacacctgtgtgaacagttccagtctcctgaacagctggctgagacaggatctgccgcagtttatcctggtgggagaacagcgcccgacctgctttcaggatgtatagcttcaactgctggcgccgcagcaggtccaggtccacttgtcctgcggaaggaaagactcagtgagaagggcgtgccctgctcagactccctcctcgccagcagcaagcctccgccacatggcgacgagtaacgctctgcccttcaggaatctgccgaccgcacacactgtccgtgacgaagggcttgcctttcccagagttacactcggtgcttctgggtaagcatcttctgcctcctgggtcttccttccctgctctccaggcacctaacttgataggacgcaggattcaatgggtttaacacggttagaaccatgttagctactattaatatgatcaaatgttccccaagttgctgaagtttcagccgcttccactcttcttctaagactcctctgagagaatctgtcagccccactagctctttaactgatgaagatcgcagcaatgcccaaggcttatctgatagcagaggccgcagaagcagcacagagagcatggggtgggaaggaaggagggccgcaggtgccgctcggacactggctcaactaactggcagacagttttattcaccacgatgggaaacggcagctactagagaatgccagccagctgaatttcggacatgtggtgatttgcatgcactgcacctccaaccagagatgtgaatgggagatccagagttgaaagtgcttacatcataaatgctgaagcagcaatcgtaggtctgtgggagcaagaggggagaaaactcaagaagactgggcagaatacgccatagttatgggtgaagccacacagacttccaggacataaagaatgagcagagagaagagctccctagaaacatggaaacaaactcaggagaaccgccttctagacccgaaggaaggcaaagccaagccaggctacagtcacagtcttagccatcctgaatgtcacaggcaagccaggcgcttccgggacagaggcccctggatccggcagagaacaggctgtgagccatggtccaacagggtgacggggccacagggccctgggatggaggggaggagggaagaggtgaacagacttctcttccgggataaagggtgacacggagaagagggtgtgagccatggggttcttcaagtgtggctccgaacatggcgacaaaggctgactcgaaaatactcattaccacgaacacagggttacattcccaaccgcaactcaacaaatggtgagcccacgtgaaccccaggactttagtacgtccgtgaattcactcataaaagaacactgtacaaaccacacgagtttaagacggcagctatttcatcaagaagcgccatgtactgacctgcaaaggcctgtttagtcgatttctttattttgtgcttttctaacttgcttccagcgaggttcaccaactgagcccagacagacagcatgggctctgtgaagggcaggttgttcacattaaaggccacggcagggagctggagaggacacagaagctgtcagagtgtggccaatatgactaacaaatgaaacgttctgaaagtcatcaaaaccatgggcttaatcctgaaatgccacacatacccgtaagcctttttatagctgagaataatcattttttaaaatgacattaaaggcaggatagagatttacacatataataagtataatctatattaatttttctttacaaacctgtcaacaataattacatcagtgtggtggttactatcttctcagatattttctatatacttcaagttttctacaacatgtatatattcctataataataaaaaagagtactttatagaaaatatagtcaggccgggcacggtggctcacgcctgtaatcccagcactttgggaggccgaggcgggcggatcacctgaggtcaggagtttgagaccagcccggccaacatagtgaaaccccatctctactaaaaatacaaaattagccaggcgtggtggcacacaccgtaatcccagacactcaggaggctgaggcaggagaatcgcttgaacccgggaggcaaaggttgcagagggccgacaacattgtgccattgcactccagcctgggtgacaagagcaagactccatctcaaaataaaaaagaaaaagaatatatagtaagattgcacttgggctacatcaaaataatgtaaatggctccttctccctgtgcatccttgattcacagattaagatgacagtagctgctacattaagtcacgtcactcaaaactactaagcattttctacatgaagaaaggctgtttttttaaaggtgtttaaacatgtttgtttttttaaaacttgagttgttgaataaaaagtaaacttcataaattcacattttaaaataattagaactacctcatagatgcacggtaccttctaggttgctaaagccctcttcgtgtctctgaggctgaaatacacacgaaccactgctttaagtgccctgtgagacaggccctgcttaccacagaagcacaagctcgcacagcttcctggaaggcaaacttcaagtaccagaatcaagttctttcaagtgctgatgttggtgctcggttctagtgtaaagtcaatttcccttatcatgcagtaactaagcacaagttcacctactggtttcagctgattcaatgggcaaacgcgacacgtccgcatgtcagagaactgcacggtgattttgcccttcagggtgatgcgagtcatggtgacttctccaaagtcatcgtgcacaacttggccgcccaggcacaggcgaccatcgatgcctccaaccacagccaggaccgccatgaggccccccacttcagggttctcggaatcagggaagtagtcatctaactgggcctagtgcagaccaaacagcgagctcgaccggggacactcacggagctgcccaatccctacaggtttactgttcaactaaattaattctgagaacacaaacccacccctttggaaggccttcccgcaaagctgtgggtgatggagcggagctgggagttgatgtacttgttgatgagcccattccaccgagtcagggagtgcagcgtgtgcagcagtgccaccacctcctccgccagtgtgctgctgtgggtggcagtcagcgaggcctgcgggcacaccctgcgccgcctcagcgtggactctgaggaggaaaccaggggagaagctgctgcaccactcttcaccagggcacagggaagggagacggccactcacctctgagtgacggcactacacggctcttcaccaggacacagggaagggagacggccacccacctctgagtgacggcactgcaccgctcttcaccagggtacagggaagggagacggccacccacctctgagtgacggcactgcaccgctcttcaccaggacacagggaagggagacggccacccacctctgagtgacggcactgcaccgctcttcaccagggtacagggaagggagacggccacccacctctgagtaacggcacgtcagaggagcacatagtgagcaagctccccaagaagtcaaacagcttctccatgaggcatttcatgtccctcaccctttcggtcttgtcccatgacggaaggactgcttgcaacaaatgcacagctaagatctgataaaagaaaatttaaaatgacaagcattaaaaaaaatctgatgaggaaactacagattgttattttctttttttttttttttttgagacagagtctcgcactgtcgcccaggctggagtgcagtggcacggtcttggctcactacaaccaccacctcccaggttcaagcgattctccttgcttcagcttcctgagtagctgggattataggcactcaccaccaagcccggctcattttttttggattttcagtagagacaggatttcactatgttggccaggctggtctcaaactcctgacctcatgatacacctgcctctgcctcccaaagtgctgggattacaggcatgagccactgcgcccagcctctctttattttctgttctcataatgcaagtaatcatgtgaaaattttgagattcattattttacagccaggtaattacactcaagttgattagtgattaggattgtcagggactttagaaaaaagcaacattacagatgcatgtgtttaattaaaaaagaattatttttagtttaattcttaagacaattacactacaaattctgtgaagcagatgagtaagtagttgcaggatttaccacttaagagaaaagcaggtaaactgaaggttagcaacttaccaattatcaaggacctctgccccttgcctccagaaaatctaccctgtcacttctagaccctttctgcactcgttacggaataaaggcccctgactctgagggcagggaacttcagtacatggaggcctctctcagggaactggttttgcctggcagcacattacctgcctctgcagcgaggtggcagtgaagggtgcgtgcccttccacaaccttcatgagcagcgtgatccactgcggggagctgagggcgccgcacacctgcagcgtgagagcgatgctctgcacaaaccccagcgtgcaccagctccggtgttgctccctgtacaccagcctgtttggagaagctgcgggagggaaaatagacatgcttggtaacaagtccctaaagacaaatccctaaagatatatatatccttatttttttatcaacttattttctacaataagctcctttaaaatatattgcagtttgtaaattaattcaaactaattcaaagtgagaagtggaaggcggcttttaagttagttcaagaaacatttccgaagttttcttttttttttgttttttttagagaagggccctcactgtgttgcccaggctggtctaaaactcctgggctcaagtgattctcctgccttgccctgccgaatagctgggactacaggcatttttaaaaccttctaagtatgtgtcgtaaaagtagttagggaattttagctatgcattgtttctaggcaataggaaaatgatctataattcaaatagtaatttgcaacagtgcatctattatatttttaatttcgtgttttaaatatctccacaatcttggttatatttaatctgcaccacttaaatactctttttgtaattttagtagagacagtttccaatccaagtttaatgcatctgcattaacaaaatgagtttttcactaggtttacaccactggattctggcaccagtgggcccacctctgctccgcctggctccaggactccactactccctcaatggaagctgaggcttggaggctgggccccctgagggaccccgcccacagccccacaggacctgctctccctcccacctcccccaccctgccctcagctatccaagcttatgaggacacctgccttccttcagcacactcacatgcgctcacacacacacacacactcactctcacaccctcatatgcatcctcacactcacactgatactaagttattcagacacactcatgggcactcatacacccaccctcacactttcaggtgcactcacaccactgtcgcaatcactaacacacacacaatcccagtcacacgtatgcacaaacagatgcaagctgacacacactcccatgcactctcacatacacttacccctcccaatgcatacaaaaactcacatatgcactcacactcctcaacactagtaatgaccgattactcacccactcacacctttacccacacactttctcactttacactcacacctatactgttataacctcccattcactgacacaagcaaaatgctcacattcactcacacgcattcacaataacatcactcgtgctcacactgacacaaggcactcatacacatttacacaaatgctcacactcaatcgcacacttacacttgtgcctgccacccactcatacttcctcacactcaccaaccctcactgacttacacttacactgggtgtctcattcgcacacccagtaatcccctcacactcacactcatgcctccctcgtgctcaccctcacacacacacattggctcaatgcaccgacgctttcactcccacttcacctgaatgtagtcacctgcccactcacatgctctcatggacatacacacacccacacaaccacatgctacaaacacaccatcacacttgcaacacaaacgctcagccacttgcccatcgaccgctaacacactcactctcatcaatatgtgcggacgctccagcacaccactaatacacgcatgctctcacacacactggaggacgcccacatacccacccacactcacacgtgctcactctcagtcacatgcacactcaccccactccctcagctcacatttctcatacttactctccacacacacaaacactttatggattaaactgtgcctgtcctccaacttcacatacattcggaacctcagaatatgatcttatttaatgaggtctctgtagacgtcattaaggtaagaatttaggtgacatcatgttggattagagtcaaagaaactcaatgaaagagtcctttcagagacagaaaaggacatgcagaacacaggggcaggggccatgtgaagacgcaggcagagactggcacaatgcgtcccaacaccaaggaagcctggagctcccagaagctggacaaagtaaggaaggaccttcccctagagcctgtggaagaagcatggccctgcccgcacctggatttgggacttctggtctccagaactctgagagaacaaatttgttgtttgaagccagtgttacgggttgaattcagaattgcaaaattcgtatgttgaagccctaacccctaccgtacctcggcaggtgaccttgtttggaaatagggtcgctgcggatgtaatcagtttgatgaggttgaatgatgtcctcatgaaaaggggagatttggaggcgactcacacacagggagaatgccatgtgaagatgacggcagagataggggtgacacctctacaagccgaggaacgctaaagagaccagtaaactccagaagctggggcagagccctgaagcagcttctccctcacagccccagaaggaactacccttgatctcagccttccagccaccagaaccgtgagaatttctactgtgtaagtccccaagtttgtatactttgttacagcagccacaggaaaggaatccacacacatccacacccacccacatgcacacccagacacgacaagcgtgcggcccccagcgctgactccctgggccctcgatctctcattccatacatgtcttgtccgtcgttccgctttccactaacattcgcagcagtccgcataaagtcttggtggcttcactctgcatgatctcagcatgaactccagcagacagacaaagagtctgcagtaagttaatagtgctggtaaacatcattgcagtggggtgaatgttcctttcagtttgttcggcttctaaaaaaaataatcaaaattacaaattatattggcagccccagcctcttggatggtcttaccaagcccaaccatgtgaagcttcacgtgttttaggaacagctaagaaatgtcacgaaacctcctcccacaacctggatctccacagataggatctagctttcttggtccacccctaaattctcacctctgcttccctagaagcgataaagtgctgactaactccacattacatgaagagttcagagtcagggaccacagaggaaaggtaaaggcaggtggcaggtggggtgtgcttgggcaggggctctcactggaggaggacgcgatggaccgagaccgcagggcaattccaccaggcctcggctcactcgctcagatgcaggctcagcaccaaccacatgagactcactggtgatgcagctgcccccacctggccaccacattctcaaagaggggcgggtgcacacatgagaggaaaatgcagaaagtcagttccagccagatcgccggatcccacagtcactccacacacctgcatcggaggtgcctgggagcttatttaaattacaggttccgaggacagagcgccagctgcaggtgtgtcctgacatcccattctaaggcccagatggcagtggcagcacccagcaactggacagtttgtaggctgccttggactaaacaccttcctgagtcacccaccagagtcgtcctctgtgtccgaatcctctgctgagggctgtgcaggggctggcagctctgccagcttgaggtcgtattttccttctttccccatcctgtaggagttggtgctgcctgtgtcccactggactcttatccacccgtcctctcccagctcaccaatcactcggcctaggcctggaggaggcccatcctgagaaagccaaagtagagatcagttaggagggtgcgtaacctgccctggtccttccatggctcccagcagacctcagttaggagggtgtgtgccctgccctggtccttccatggctcccagcagacctcagttaggagggtgcatgccctgccctggtccttccatggctcccagcagacctcagttaggagggtgcgtgccctgccctggtccttccatagctcccaccagacctcagttaggagggtgcgtgccctgccctggtccttccatggctcccagcagacctcagttaggagggtgcctgccctgccctggtccttccatggctcccaccagacctcagttaggagggtgcgtgccctgccctggtccttccatggctcccaccagacctcagttaggagggtgcgtgccctgccctggtccttccatggctcccaccagacctgccacacagatgtcgccatatgccaccctgtctgtcaggggctgtccccagacacagatttcacctctcctacaaaatgtgtgcttgcatcattttaaattaaatggcataaaataacgtgctcatgctgctttaccaaggaagtcggggaaatctcatctcaatgaggatcctctgagtcaatgcagagacagggctttgcagcaagtcctgtccccacaatccctcacgggccttgcaagagcggaaacctgaaacaagcaccagcacctccacattccctttgcttcagtttcccctgggccccagggggaagctctgtctctcacttctgcaggagaaagctgtttctaggatggatgctgtctccagacactgctatttctaagatgactgtgacaaagccagggcttaccagcgtggctgagaaaagccagacagaccatgggaaggtgaacactgccctaacttagctagggctgtggtaagtgacttccacctgggggcacctggcagagatttagaagagacctgcgatgagggaagatggaaacgtggccacaggcccatgaagtagatccctaactactggcttcagggcacttcgcagcacatggccatcagcccacaggggcagcatctgggcttcctgcctcagagccttcactacaccaactttcagaatgagatttactctcttgctcactctcacactcttgttccagtgacccatcaaactgagcctcatgccagtgagtttcctgaaaagagctgcctctctttccagacttgattctgctcagatgccctacttatgattccctgtttgtgttcactcccttcagctgctcgggaaccaacacctgtgtcatcgatcaactgacacatcctggattattccaatttccacccaccaatatcgtacagaactatgcagaagataactaatgtgtggctaatgtgttcacatcaaatctctgagtacctgatcgccccatttccagtccacacctctcatgacccttgttccaatcttcatcatggcagccagttctggccctgaaacagggagctgcacaggagccgtttccttccttgtttcttccaaaactgtggcagaagcaccttgggcagaagcattcatatcttcctcaacgctgtcacaactggggcctgacggagcgtcaaaaacaatagctgagccaacaagtagctacagtgtccccttaatacacacaaaacattcacaaagtactaatgaagatcgtaattttgaacaatccatactatatgttttatcaatataatattatgaatattttactgatataggataaaaagaagataaacggaaggatgaaatacataaatatcctaggaagatataaaagatattaaaatgctcagtaaagctactttctctacttctaggaattactcccctgaaaaaagcaaaataactgagttagaaagatcctcatcacattttttattaatagaaaaacaaagataactacctaaatatctaacagtgggaaactaacaaactttaatcatggttctgtgcagaagacagctaacagctggcccgagatacaacctcagacagggttgctgcaggctggccctcagctggagtctggatctcaggagggctcccccattccctaggtggtaggtgtggttccctgtgcctgaactgtctgtacaaacaatgtggtctgtgctgaaacctgctttccttagtctggaacttggtacacgccaggcagggggtgcccgtgtgatcagtcctgatggaaaccgtgggcctggagtctctacccagcttcccggcagacagcacttgacacggctcggtgccagggcagttaagctcgtcctgtgtggatcctgtggaagcttgtacctgctttcctctggactttacccatgtcctttttcatgattttgctctgtgtcccttcactgtaataaactatagccctgagtacaactacatgctgagtcttgtgagtcctcctggccaaccatcaaacctgggggtggtcttggagacccctgacaattggtgccctgggtggctacagagtcatccgtagcacaaaacagaagccgagctgctgtcacctgagagaagtaaaacttcccaatggatctgaaaataggagcgctaaccctaggagagtaggctagatttttaaccccccttttcccacttgctaaactgagagggggtaggagtgtggttctggtaactcccttgattttagttttctcctccaggtgggagggaaaaagatccaaacagtcccaaaggtgggctggggtggaccaaaaaatgtaaaaagtttgtgtttctctctcttccaagagaacaaaaaaggatattcaattcccagggctggagcaaaactttagataaactagcaggagaaacagcctttcctttagcctagccgctactttagggcccccaggaaggggccccaaggaagggacaggagttgcattccaggtggatctcccaggagcccctgggcagctatactgttaactctgtaaagactgaatgtattgctaagggcttgaataaatttgcaaccaaaaccggggggaatttttttattttacatagctttatgttttgtggctgttacatgtggatgtatacattaagctggtataaaatattatatgtttataatttcttaaatgataagaaggataccctgatcagggcaggctgcaaatatagacggatattcatgagacacaacttccttgctttttgcagccagtgggccagatgaaatttaaacacatgaatattatcaacagaacaagtccccatacttaatgatttgtgctgtgatttttacttattggaacctctgggggaaaagtagacaacataaaaaggccatttctcgatggagatatgcttttgtaatttttaaatgcaacttttggttgctaatgaggcctcaggaaatcagatataacccttactagatgattcttttcagctgtaatatacatattaaaatatatatttaacataatacaacatataaacataatatataaattaaaaaataattatatatatatatatagagagagagagagagacagacagacagacagatagaaagattccacccacccccaagacaggatttcactctgtcacccaggctggagcccaggctggagtgcagtggcttgatctccgctcactgcaacctctgcatccctggctcaagcaatcctcccacctcagcctcccaggtagctgggaccacaggcacacaccactatgcccagctaattttcgtattttttgtagagagagggtttcgctatgttgcccaagttggtctcaaactcctgagctcaagcaatccacccgcctgagcctcccaaagtgctacgattacagcctggcctgatacatatttttgaatggattaatgtgaactctaaaactgatgtgattataagagcttgggaaaaccttgctttttcactgtgactttgacaactggccctgcagcatctcagttttagccaaagaacaccaccataaaccaatcagatctaatagacatatacagaacatttcaccaaaaagagcagaatacacgttcttctcaagtataccacaggacactctcttagactgaccagaccatatgttaggccacaaagtctcaaatttaaacagacgaaaatcatacaagttaccttctccaaccaaaaggaaatgatgagaaattaataacaaaaggaaaagtggaaaattcacaagtatatgaaaattaaacaacacatggtaaacaatcagtgggtcaaagaagaaatcacaagggaaattagaaaatactatgagatgaatgaaaacacaacacaccaaaacttctgtgctgggccaaaagcagggctaaaaggggcaattatactataaaagtctgcatttacaaaagatgatctcaaatcaataactctacatctggaagaactaaaaaaataagaacacaataaaaaccaaagttaggccaggtgtcgtgcctcacacctgtaatcccagcactttgggaggctgaggcaggtagataacttgagcccaggaggttgaggctgcagtgagccatgagtgcgccactgtacttgggcctgagggacaaagtaagaccctgtctcaaaacaaagacaaaaacaaaaacaaaaaaatacaaagcagaaagaaggaaacgatagagattagagcagccataaattaaatagagaatagaaaaataatctacaaaaccaaaagttcggtttctggcaagaacaaaaaatctgacaaacttttggtaaattaagaaaaaaagaggccagtcaaggtggctcacgcctctaatcccagcactttgggaagctgaggtgggcggatcacaaggtcaagagatttaggtcatcctggtcaacatggtgaaaccccatctccactaaaaatacaaaaaaaattagccaggcctggcggcaggcgcctgtagtcccagcttacttgggaggctgaggcaggagaatcacttgaatccaggaggcggaggttgcagtgagccaagactgtgtcactgcactctggcctggcaacagagtgagactccatctcaaaaaaaaaaaaaaaaaaaaagaaaaaaaaagagaaaagatgcaaataactaacatcagaaatgtaagtggagacagtactaccaacataaaaataaaaaagattataaaagaacactgtgaacaactgtatgccaacaaataaaatagcctagataaaatggacacattcctagaaacataaattacccaaactgactcaagaagaaatagaaaatctgaatagagccataacaagtaaagagattgaatcggtaattaaaaatctttcaggccaggcgccgtggctcacgcctgtaatcccagcactttgggaggccgaggcgggtggatcacgaggtcaggaaatcgagagcatcctggctaacacagtgaaaccccgtctctactaaaaatacaaaaaattagccgggcgtggtggctggcgactataatcccagctactcaggaggctaaggaaggagaatggcgtgaacccgggaggcggagcttgcagtgggccgagatcatgccactgcagtccagcccgggcaacagtgtgagactccgtctcaaagaaaaaaaaaaaaaaatctttcaacaaagaaaagcttaggtggtcaactctaccaaacatttaaagctgaactgacaccaatcctcaaactcttctaaaaacagaatatatgggaacactacctagttcattctatgaggccattattaccctgataactgtaaaacaataaaatattgctgaaagaaattaaagaggacagaaataaatggaaagacattccacattcagagaatggatgttaacattgttaaaatggcactatttcccaaaacaatctacagattcaatccctagcaaaaatcccaatggtctttttttgcagatatggaaaagccagccttgaagttcatgtgaaaatgcaagggacccaaagtagccaaaatcatcttgagaaagaaaacacacttctcaattttaaaacagtacaaaactacaatgttcaaaacagggcggtacctgcacaattatcaacatatagaatgtgataatgtaattgagagtccagaaataaacctaaatatccacagccaactgatttttgccaagggtacccagaacttcagggaaagaacagtcctcaacaagtggtattgaaacaatcagatcaacaaaagaaaaaggctggactcttacctcacactgtgtaaaagaaattacctaaaaatggaccaaagatctaaatataagagctgaaactataaaacttacagaagaaaacatgaggataatcttcatcaaccttgtgtttggaaatggctttttggatatgatatcaaaagcatagacgacaaaagagaaacagataaattgaacttcatcaaaataaaaaacttctctatctaagggaatacaatccagagaacaggagaaaataccctcaaatgatatacctgataaaggtctacagatctgtgaaggtctagtatacacgaactttttaaagagtctgaggactggtgttaattcttctttaaaggtttgatacacttatatagtgcatttattggtacaacaagatgacgacaaataaccctatttaaaaaggagaaaggggctgggcgcagtggctcacgcctgttatcccagcactctgggaggccagggcaggcagatcacctgaggtcaggagttccagaccagcctggccaacatggcgaaatcccatctctactaaaaatacaaaagttagccaggtgtggtggtgtgtgactgtaatcccagctacttgggaggctgaggcacaagaagtgcttgaacccgggaggcggaggttgcagtgagccgagatcgtgccactgcgctccagcttgggcgacagagtgagactccgtctcaaaaaaataaaataaaaaataaagagaaagggacttgaatagacacttctccaaagaagatatacaaatggccaacaagcacaaacatgtaaagaagctcaatgtcattcatcattagtgaaatgcaaaccaaaatcacaatgagataccacttcacacccgctaggatggccttaatccaaaaaaaaaaagaaaaccacaaaaaatagtgttggcagggaagcagagaaactggaaccctggaatcctgcccactggtgatgggaatgtaaaaatgatatggcactgtggaaaactttggtagtttctcagtaagttacacatagttgtaccatatgaccctgtaattccagtcctaggtgtataatcaaaagaactagaaacaagtgttcaaacaagtacttgtatataaatgttcctagcagcactattcacaaaagtcaaaaggcaaaaccaacccaaatgtccatcaacagataaatgagtaaacaaaatgttatatattcatacaatgaaatctttttcagccataaaaataaagtactgatatataccaaatgaaataacccagacacaaaggccacaaatggtatgattccatttatatgaaatatccgggatatgcaaatccatagacagagaaagcagatttgtgactaccaggggctggagagcaggggagtcaggactgatggctaaatggggtgcatttatagtgatgaaaaagttctacaactagacagtggtgatgactctagaaaattgtgaatgtatttaataccgctgaattgcgacgttaaaatgctacactttctgctatttgtgtcttaccataatttacaaaaagctttttttaaaaaaaagaaagaaaataaatcaaagcaaaatcttgacgttttcccaaaggctctcaagccagtgcagacctaccaatcaggcgcagtgccgtctgagcgagggccagcgtgccggaattgagcaggaggtcaaggttgtttgcgctgtgctgcagggtgagcatgctgagcatcaccaggaggaagtgggcttgcgggatggtccccaggctcggtcccgatgggttctcattggtgatggtttgcaggggaaccggctggatacctaatgagcattggcacccactgacatttcttgtaatggatacaagaataaatgtaatgcagaaagcacgggcaattactctaaacatctgactaataagcactgacacccactgacatttcttgtgcgtggatacaagaataaacgtaacgcagaaagcatgggcaattactctaatcatctgactattttgacacccactgacatttctctcgcatggatacaagcataaacgtaatgcagaaggcacgggcgattactctaaacatctgactatttttcagtggtttccacagagtgggcagctctgtcatgctgcacgatgggcctaccccctgcattctatgcacaggtcgttccatctgtctacaggacttagtatgctgctctctgaatacaccggtgccctattccattccttccatttcaaatataaaagttatgtctcacttttcctccacaaaaccaatccaatcaactctctgtagatgctcaaactatccaggaaataaatatcaatataggacacagacactttaggatatgtggtgatacacataaaaatgtcaaaatgtaaaaatgttatactagagtacttcaacattgtgtctcctgctaaattttaaagttttgtttaaaatctgagaaagctgacagcagcatagattatacaagtacaaagtacaaacttattaaagtcttctcaaaagcaaaaattggcatttgcaagtttccacaacatataattaaaggcaaactataaaataacattgatacaattattgactcaccaagctctttaaatttggcactggcatccaccaaaacatttcgaatgttctgaacagcccaagcgtacagcttgccaaaggtgacttccagcagcatccgattaaaaggcgggatcaaatcaacatcctttaaacaatcagtaagaggttccctttcaaataaagataaagaatttgactcgggacactgccagacttctaactgttacagaaaaacattctgttgccacagcttccttaattaagaaaaaaatatgctaacgttttaccctatatcgattccctcaggaataagtctttgccatccacaaaacatcgcatacggcacagatggaagtaagaaattcttgctcaccagatacaattttaaaattgtatctatcccttccaggcgaacctctgctctctccaactgcaaaatatcaatgcatacagttaagtgttatgtatattacccaatgcagagaagcatttctcatcaaatgttacctgttttagtaggcactttctcttttccacatccactggctcttctttaagggcaaattcagcaattgtactgaggagtggagactgcggataaagaccctgcacattctgcttcaaccacttgtatttgtgaacatctgtaacagtactcaacagcggctgccatttgtcctaacaaaggaaaacaattttcatcattagtctaccctatttaataataaactgtgctctaaaagttattcaagtaaaatataaataatgcttatgggtttaaattggttaaaatacgttaaatttagtaatacatgtttttaaaactatgctataaatataagtgaatttataatctctatactatatgttggaacaggctagcttggcatactaagttaagttatggttcatattaacagccacagggcccagcactgtttctggaacaaagaatatatttaaggaatgaatggtgaataattaatgatacaatctaataccaaaaataaaaggaaacccttctccagctacagctctgaccaggacatcataagtcaagttcatgaagcatcactggggccgtatttctaacaaccgcccgtccctccctccagatgctcaggtacagaggtacaagactgtggattcctgtgctacatgctacgattctattcagccaacctcagaatcacagaaaataccgcaccttgggtgatttaattgcaatgggtctcttgtccacatttattggactatgaggcaaaatgcaagcttcttctaaatcactctcttcgtttccaattttttcttcatcatccgtagattctggcttcttaggaactgtgttttaaaacatcattcactataaaaatcatacacttaaatattaattttaaattaagacatatttagatttacatgaaggacaaatatttcattcaaataaacatctgaacaacattataaattgcaatgctcaacaacaagagtgaaatgatcaccctggcagaacaaaaagacaaagtgagagtgcgacgaggggagaagccccgaagcaggggaagcccggcagccagcaagctcttcctcaagtgccagagagtgaacatttgagtctttcaggccatgctgtctgtcgcaaatactcaactctgctgctgtagcacaaaaagtaaccacagataaagcaacaggtgtggctgtgctcctgtaaaactttatttatggtgctacaattttagcttcatgtaattttcatgtgccaaaataatatacttcttttaatttttaaataacaatttcaaactggaaaaaaaaaaaaaggtcttagtccatgggcaacccaaagccagcaagaggtagaatttggcccatagttcctggcttgtccaccctggtccagttcagtggttctgttactgtgtaactgaatcaactgaattcactgtgatatgtggaatttcctccctatactttatctcttttaaaatttttggtctaaatctcctcagcatataatataaaaaataagcaacatgataatacatctgggcagtaaagagctaacatagcaggccggggttgctcaaaccctgcaaattcccaaggaaggtctgtcccttcaggattggtccttcttctaggagctgagctctgagcccttggaacatcctgcctgagaagttttttggtatacctgacacccaggaccttgtggcagtggtctggccaggtagtttatgctaatgatgggacttgcgagggaccacttgtttttgcactggggcactggagcctgagtgaggtcagtcacaggggcactgcctgcgtatgtgactggcccccaacaaaatctctagactcgaggctcaggtgcgctggcctggttaacaattcttcacacatgatgtgacactgttgctgggagagctaagcacatccacgtgacgccactggggagagacaccaaagcgtgtgcctagtttcctctggacttccctccatgcacccttccctctgctaattttaatctgtatcctttttgcagtaaaaacacagctgtgactataacagctcttctgagtccttttagtgaatcaagcctgagagaaggctcggggatccctgacacagcaacaggaatattaatcacttaatcttttcaagttacttactttccaaaaaaaaaagaaaaccagcttgaaacaccacacgataaatctataaacccacaagaaactctaaaagtgacagtgtgggctcagaacccacggatatgagatggcaaatgtggagtctctctccctcattccgaggcagcctgtctcctgggcccaggctgagttcctgcatgcctgggttaaaggaatcgcagcagtgtgactgctgtgacttcctgatccagagcacccctcgcattcagacaggctgttatggtgtagggtttgttcaggaacaatcaaattaggatggcttctaacacactttagtctttcataagcttattgttcaaaatgcccatcagaaagtcagtaatcaatactgttcaataagcaggtttgtgagtaaatcagtataagtcataatatgatcagaggccaggcgcggtggctcacgcccgtaatcccagcactttgggaggccgaggcaggcagatcacgaggtcaggagatcaagaccatcttggccaacatggtgaaactccgtctctactaaaatataaaaattagccaggagtggtggcgcgtgcctgtaatcccagctacttggaaggctgaggcaggggaatcgtttgaacctgggaggcggaggttgcagtgagctgagatcgcaccactgcactccagcctggcaacagaccaagactccatctcaaagaaaaaaaaaaaaggatataatcagaaatttctgtagtttatttataatcacaagtgactaaattctaaactattttataatttctaagcatttttattcaaatttggatttaatgcaaaaagacttttctgtacccttacacagctacttccaggaaaatgtcagtaactcttttagcttccctttatagttcttcatgtatcagaatactcaatatttccaaacaaaaaacatttctttagaagaatggcaataagtttaaatgttcccattatatctcattaccaggataactaataaaagtacttccttgttcccatcaatttagcaaagattatttacgttttcaacatcaatttactagtaatcaaatcataccacactcaattcctaaactgcctcattgtctgatcatttggaaaaataagcgagatgtctgtatttaatcctaactataataaaaatgatggcagcaggtagaaatgttacatggaatcaacagtagagaaacttcactctgaaatcacagatccaacgtggcagggtgaagcacaagctttaatagtatcttctgtccttttacattcttacctctctttttccttggttctcgaattatcttctgagctatcctcctccaatggggcaaagaacttaacaatttaaacttagacattatagagaggtcattacaaacagcaggtctcaattcattaaagaggaatctcaaacgtttgatgacaggagcgcagacctccttgtaagaacggccctgttcttgatgagtctgcaaagttaaccaggaaaagacaactttaacaacaaatatttcagcaactgtctgcaaagcacagaataaaaagaattaaaatctatcaccttaatgagcgaacattttgcttggtagacaactctacaaacatccaccactgacttaggcaacgttctgtgctttacttgctcaatatcaagtgcacctgcatgaactaaagataatgccacatgacctgtaaaaagacatttaaaagaagggcagtgaaggaatgaatacgtaccacaggttagtcgaggaatctgcagtgtagctaaagtacaaagatattgagctccttacctaaatcttcatgttttaagaggcaacataacagcaagcgaccgacctcttccacgggatgctcggggggaaacatgatcggtgtggtcaaatggcactgcctacagtacctttctatttgacacaaaaagtcctgcaacaggaacagctggaagtaacttcagggaaacccagtgagtcttcacaaatcttaaacatgccacagcttctgacgcacttgcaatcactaatgcttctgaagcctcgctagcatgttaacacaatcaggttctcacctcaaaaccctccaaataatacatgaaacaaagtctgtgctgtgttaaccaaagagcacataagtattcctatgtcaaagtcctcagataaacagagcactgaggtggcagtgggggcaggcctagctcaccttcacgttgtgatcctgaatgttgttgtctgcaatggcttgcagaaatgcctgggaatggtcccccagggcccgtctgtgggagcagagtcgagatttgctggcaggtgtgccccctggggagctgcagtggtcctcgtctttctcctcgttgtagctgtagtggatctggctggtctgcaggcctccagagaagatggatgactgaagccattctagaaaatgcacacacaaacatgaaagagaaactcaagtgcacaactcaaaataaatactaaaaaaaaaaaaagatgctcaactgaacactcaatttagaaggtgaaattcagcatcattcatatgaaagagctccacctaacatgtttacacaggttgacttataattcctctatctacgtgaacacactttctggtgattccacacgcctcaggcatggcatcagaactcaggatcgtagttccagtccaacattctctggatacctgtgctctgcctgcagctgcctggttccacaggtaccgtgtgaagactgaggtgcacattctaacagggaaggcagcaaagggcaccgctgacacaattaatcacaggatttcaagtccgaaactgtgcaacagatgactatgggggtaccagggagactggaagacagaccaccgctattctgagggtcagtgagggacttgtggaagcaacaactgagctaagatgaggaataagacccagacgctgagtatccaggcagggaatagcacatctgaagggtttctacaaagaattacatcctcagggtaggctatgtattcctagagcacttataaaggaatgaaaaggagaaaatatttaagaaacacacaatctgtaatgaaggatagatccttggagatgggagggccgatggactggaaaggagacctgtgcgtggtgcaaggcatgggatcaaccagtgcgaatgttaattacaactgcttatggcaacttgagggagtgcaccactacagatctctattaacgatctgtgttatcaaatactgctccaaatccaagcaatcaaagcgggatgcacttagtgttcttttactggacatttagattttagagcactcaggagcattccccaacacaccacattcgttcttctgaaacactaatccaatgccgactctctctggccccctctctttaagcacaggacagcccctccttactgctccaagataagcctctgatcctcctgtggatcggacccacctgccagggcccatggcaccctctgccctggagctcgccagccctgccctccttgccaatttaaacaaagcccatcttctggcaagcaatgagccttgaggaggagggaaggaagcagacacctcagagggcaccacaggcagcccagcacctagcactgcacaaaggtccgcccaacggggggctgtatggacaccaagatcctccttccctgcaagcctctgccacacccactcctgcaagcagcaggaaagccctgctcctctcagcagtgcccttgacactcctgtgttttctgcccagaatgctctctcacgcaatttcaggactgctgccaatgtgaagcctttcttctcccagaaccatgtatgaacatctccatttcaccattcaccaccttgtaatgtgacctgcttagaatggtggctcatcaacaagcagcagctgaaagcagaggcgtgtcctacccatcactgcatcctgaacacctcgcatggtaacggcaccagaaagcagaggtgtgtcctatctatcactgtatcctgaacacctcgtatggtaacggcaccaggcaaatgctcaacagaagctgctcacatggatggacagacagacagatgggaaatgcacaactacatgaaggaaaatggaaacacatcttaggagacagaaagaagcttattattttaggtggttacaaaggctgccatcctgaaatataactgacttgagcctggtctggtaaaaacgcagtgctcaaatagtatgctcttccctgagaggacagctgatccacattctgtgcaatttctgggcatgcagggagacaaaagccatgctgggcccatcaggcagaggctgcaatacgtgagaccaccaagggcagacgggtagacattcctgcacactttttagcttcctctgcagcaacagaccatgagggcaaatgacaaccactcacagctgtttctacctgattgagtctcactatccttattatttttttttttgtcatcatcaactgtgttgaatcctcctctccttttttttttttgagaccgagtctcgctcttgtcacccaggctggagtgcagtggcgtgatctcagctcactgcaacctccgtctcctgggttcaagcaattctcctacctcagcctcccgagtacctaggattacaggcacccgtcaccacacccagctaatttttgcatttttagtagacatggggtttcaccacattggccaggctggtcttgaactcctgacctcaggtgatccacccgcctcagcctcccaaagtgctgggattacaggcatgagccactgcctggccatctcctgcttttttaaagagagagtcttgctctgtcacccaggctggagtgcagtggtatgatcatgactcactgcagcctcaacctcccaggctcaagcaatcctcctacctcagcctcctgagtatctgggactacaaatacgtgccaacatgcctggctaatttttgtgttttttgtagagatggggttttgccatgttgcccaggctggtctcaaaatcttgatctcaagcaatccacgtgccacaacctcccaaagtgctgggattacaggcatgaaccactgtgcctggccctctcccactcttaatggcacttacagttcaaaaaaaaaaaaatctgctgattagcaaaaagtaaagattttcttactggcacattcaatctcgacaggagacagcggtgtgctcattgctaaataggaagcgtgtaatccgagaagcaggcccagattcctctctgtgtctatcagaggtgaggagagactccccagatctggtatggtgacgccttcttggtcaggctggaaaaataaatttaatcatcaatctgaggaaacagaattaattaaaaacataaaaccaaaaggacagctctctcctgcagctgtaccgcacgtgagcccaggggtgctctgggcgttctgcccctccatcctgtaatgagttggtgctgctgtgcccaagtaacagcagataccatataaacccacatgccctataaagcaggcagcaaccgcacagccctactgtagaaaaactaaaccacagatacatgatttggctagaatattccttaggaatcagtttccaaagtgactgtacaccatgcttcagaaagtataatgaattgttacatgcataaagaacccactgggcaacaaaactatgacaagtattcgatgacaagtattagtggactgtgaccacacatgtagaggaaatgaaatttattctaacaaaaatcaaactctgaaaaaagcaagagttcaactttttcagtcacagaagatatttacagcaaagttaattctccccttcataaactgttttaagccctgccctaatggcatttaatacatcttattacttgtcgatacctagtaagctaatcccaatatataaattctatgtgttcgtgaatacataggaaggacatatttctattgtaaagaattacacttctacatagttcttcccaaaaaatacatacctcaagattataagccattccaaatttctacataagaccaaagtttaacctcttttcttgtggaacactgcctatatttctcacaaattgatcatttaaaaaacaatctttcaagaccagtacatcacagatcttaacatgaataaatgtaaattcatttatgacaaaacttctaaaggatctttatatttatccctaatgccccgcaaaagacccagatatcagtacttctagatccaaatattcctatcacaaacacacagagggtatcccctgccatcctctgcatcactcaaggcatacagcctcacctccaaatactggccaacacaaaatgcgtgcatggattcccgggtgtcttcaaactgcaaagcagcttccaaagctaccactgggtcttcccctgcaaactgagctgaaacaaaaagggaaaaagcaacatgagttcaattcagcttgcctgaagagctacaggagaaatagtgagtaggaaataagttaggctcttaactcaaaagtgagggttaccagaatataatgacctcccactgtctcccagggttgcctgggccaactcggaacttgaaatgagttccaagtattaaaacaaaagatacataatgaaaggaaattcttcgaatgtgctgaatttgttgataagacagacaccaaagccacagatacattaaaatatgcgggggctggcacaaaactaaaggaatcatttataagccaaatactctgcttaaaatgatacaggctgtaacttttaaccaggaaataacaagtgtaatcttaccaagaatactattttctgttaacgactgtgtctggaagtcctttatatcatacactttcccgtcaatcacagtccagaagcctccatcgttattatggttctccaaatcagctatgcgtacaaatgtcactttctcattatttctacagttctgacctgtaaaaaatgactctgtatatacagaaaccagaatcagtccattgatcaatcaacaggtaaaatgaaaagaacaaactgtgtgaaagaactacaagcagaaataaacaaatccacaatcacaatgggagaaatacatacctagctctgaaactaataccacacatacaaattctgttaaatatagaatgctttaaaaaaaagtctaggcagcatgaataccaaatcgggccatgccaggccatagagtaaatctcaacagatttcaaagaaataaacttacagagcatgtgtgctgactacaatgcagttaaattacaaataggttttcaaaaattcattcaaaataaaataaaaatgactctgtatacacagaaaataaaaatattcatccacatatttgaaaattacaagatacacttataagtaacccaaaattctaagaaaaaatgactatgaaaattagaaaatgtgttcagttaataatcaaaatactgcagatcgaaattggtgacatacaactaaatgcatgcttgagggcatttatgcctttaaatgtatatatttacacattaaagggggaaaaagctaaaaaagaaaagaaacaccaaatcaataaaagtctgttagttcataaaaatactcaaaaaaaagaaaacctgagtggtggtcacctatgcaagtgctaggataccaactcaatattatgaaaaatagttaaagggaggtggcagttcaagaagtcaagcttagattatgtccttgctgtacaaattgtacctcctgctaaccagacagcagagggcaaggttggtaggggattttatagaggatacgcaacacatgaattccctggtctagcttcacagaactaaagcggggagccaccgagcattacaggcctcctgagccaacagaaagcatgcagcatgaccccagacataacaccgccccaacgagactgaattcaaatccaaccaaacctctagatctaaccagcagattaatgtaactaacagaagaacatgttggtctagaataagagaatgcaatcaaccaagttcagaaaatgtgaagttctccaaaataaccaacctgcttctttgaaaaagaaaacggtatgatcagagacagggagaagagggcctggagccatgttgtttggggaaagagactagaagcatatgtcaagcaatgccaatacgcagaacatgctcaggtcttaattcaaaattaccacctaaaaaaggcatttttgagatagtccaggaaaatgtaacatggactgcatgttagattaaggaatcactgttaatcttatagacaggataatgatattgtagggtttttttaaaatccttatcattaagaggtaaaataccttaaaatgttttaaagacagagttatgctttaaaataatccaatcagccgggcgcggtggctcatgcctataatcccagcactttgggaggccgaggcgggcagatcatgaagtcaggagatcgagaccatcctggctaacacagtgaaaccccatctcgtaccatgccatattactgcatttaacaggtatgatgaagcaactgaacaggctatttttccatttccattgcatttcaacagagcccattaaaaagtagtataaatggcccttaaatactaatatattttaaaatgctcaaactatatcggggtcaccactttgtgctttagcaggcaaaatcccaaaagcccacacacaaggctgggagaccagcatccctattggtggtgagagaaatcaagatgtacaggagcaatctggtgacaaccagcccacacgaggtccatccccacctgtgcatgtgcacaggcacacacgcgtgcacacatggaggacacgtgttccaggccaggccttgcagtactatttgtgttttctgttgttgttgtttgagatggagtttcactcttgttgcccagcctggagtgcagtggcgcgatctcggctcactgcaacctctgcctcccaggttcaagcgattctcctgcctcagcctcccaagtagctgggattacaggcacccgtcaccacgccccgctaatttttgtattttttagtagagacggggtttctccaagttggccaggctgatctcaaactcccaacctcaggtgatccacccacctcgacctcccaaagtgctgggattacaggcgtgagccactacacccgaccctcagcactatttgtatagcaacattgtggcaataagcccaagtgtccaccaataagagactcactaaagaaagatagataaaagacacatccacacactgaagactaagctgatttataaaaacaaagagggacactctgataaggtactccagtatatatggttagttaaaaaaaaaaacaaaaaacaagcaacacaagtaatgaagcatgctaccacgaacgtactcatgccagagaacaaggaggttacagaggagactggaaagtcagagggagcaggtgggaaaatgggtggaaggggtgggcaggggaagcgacagtgtgtctctgcctaggtttgatttttgaaccatgtgactgtattttttttttttaatgactgtaaaacaaaataaatactctttatactagaaataaaatgttagaaaaatctggattcaaaactaggattactgttctgcactggcaaagttcactaccattcccaaaggcagttttctcattgacataatgagatacaacagcgtgcatgaggtcctcagcgggcctgcaccctacaggtgctccacacatgcaaatcactaccattactattacataagagatataatacataattatactgtcactactataaccagcatgacatactaagacagcctgcgttcagagtatgaagaaggctgtggaaccccctgcagaaggtgggagggcctggggctgtggataaaggggagctctctggggctgtgccacctgaacctggaacccgggcccccaggttgggtcgccaggcctgtgcgcctcagcttgctcatcactcactctcaacacggataacaccttcaactgcaaacacgtttaaaaaccacaggccagctccccctaccaataccagaaaaaacaagtctccacacgggcccaggatgagaacctacaagtggtactagctacaaaacacatggagaacacggttcttgcacacaccttatgagacgtcggagagctacacagaggaggcatctacagggtgtagccagacggtctaaatgggccatgacaacaaccgccgtttgttgcagatcaatggcaagcctgttgtcttgtggaagggtgaggtacctcaggaaactctcactggggctcagaggaccagacaaaagctagaaaggaaaagtaaacaaaaattcagaaatggtgggaaaaactaaagtaacacagttttttacccaagctttatattttggtattgactcatttgacccatcaaatgacaatgttgatgatacagttatactatacgtctatatatttatgcagcatataaactgtataaatctctaaatctgctgtatacatgtacacaacattgactgtgcatgtatacatttatgataccataggtaagttgaatccacacagattactaacatgaccaaaccactctacaagcctaggacccctggagaaaggcagaaccacctctgtgggaacccagcacagcatctcaagctggccttgaaatctaaaaccaaaacctttattttaatctaaatgttgcccactctggagaacacctactttcatttgcaaattaaatcacagttctaattcttctaaaggcagaagacccctattatcattagtttaaagactgccaaataataggctgggcatggtggctcacacctgtaatcccagcactttgggaggccgaggcaggcagatcacaaggttaggactttgagaccaccctggccaacatggtgaaacctcatctctattaaaaatataaaactgagctgggcatggtggcgggtacctataatcccagctactcgagaggctcagacaggagaatcattcgaactagggaggcggcagttgcagtgagccgagaacgtgcactgcactccagcctgggaaacaggcagagactccgaagacgggaagggacgggatgggacgggataggacaggacgggatgggataggacaggacgggaagggagaaagaaagcaatgtacccgcaaaacaaacaaacaaacaaaaaaacagtctcggggacctatgggactataacaactccggtcactgaactcacgaagggacaggagaaagaaggtggggctgaaactgtactccatgaagtgatggcttacaagttcccaaatttggcaagagacataaatctacagatctaacgtaagcaaaccctaaacaggatgaacccaaagaaatccaaactaagacatataataatcaaactccaaaaaacaaaagacaaaacatttcaaaagccactaaacaaaaacagtgccttaactatcgtggattaacaagtcaaatgacagcgaatttctcatcagaaaccatggagcccagctgaaagtacaaaatatttttcaagcgatgaaaagaaccattaacccagaattcttatatccagcaaaaatgtccttcaggaatgaaaaggaaagcaaaacattctcagaggaagtgaaacagaatttgtcaccagaagacccacaccaaaagaaaggctaatggaagttctctaagcagaatggcaaccatcaaagaagaaaaccctggaacttctggaaggaggagatgacaagcacaccaacgcataaatacaatagacttttccctcacctcttgactttgctaaattacgtctgaaggttcaaccaaaaattataacattgtcatatgtggttatcaatgtaagtaaatgaaatatttaaggcaagtatattatgaacagaagaacataaaggaacatcaagggaggtagtttctatatccctgaagctggtaaatgacaacatcaggtaaaatctgataagtgttcatacatacacaggctgagtgtcccttataaaatgctcaggagcacaagtgttccaaatttcagatttttatcagatttaggaatatctgcatataaataatgagatattttggggataggacccaagtctaaatacattcatttatgttttatatataacttatacacagagcctgaaggtaattttatatagcatgcttagtaattttgtgcatgaaacaaagttcatgctaagtacttatgaatggaattttcaatttgggggcgtcatgctggagtgccataaagtttcgaattttggggcatttcagattttggattttgggtttacagatgctcaatctgtatgcaatatattacctagaaaagccactaaaaaagctatacaaaaagatacactctaaaacactacagatgaaatagaatgctaaaaatggtcaagtaaaccacagagagccaggaagaaccaaaccgaaaaaatgaaaaacagaagaaatagaaaatgcaaaacaaaatggcagtgttaagcctcaatttatcaatgacattaaattaaatgtaaacaatctaaatacatcaattaaaagacactaggagagtagactagagaacatgatccaactatatgttgtccataagaaagtgacttcaaacaggcaaactgaaaatagaagtatagaaaaaaaaagatcatgcaaacattactgaaaggacagcaggagttggctatatttataacaaataaagtaaacttcagaacaaagataattaccaggagggccgggcacagtggctcacgcctgtactcctagcactttgggaggccaaggtgggtggatctcaggagtttgagaccagcctggccaatatggcaaaaccccatctctactaaaaatacaaaaattagctgggtgtgatggcagaagcctataatcccagcttctcaggaggctgaggcaggagaatcacttgaacctggtagggtcggaagttgcagtgagctgagatcatgccacttcactcctgcctgggcaaaaggagcgaaactccgtctcaaaaaaaaaaaaaagataattaccaggaaccaacggcaacattacaaaatgagaacttggtcaatccaccattaagacacagcaattcgaaacgtgcagacaccaaacaaacaaaaaaacaatgaatagaaccgaaaggagaaaaagacatttatacttttatagttggagacctcaaaatctctctctacagctgataaaattaggagacagaaaagctgccaggatatagaacgcaacatcaccatccatcaactagagccaatcaaaatttatagaacactccagccaataataacagaatacataatcttttcaagtatccacaaaacaaatactaagttagaacatatcctgaggcataaaacaaacctaacaaattttttgaaattaaaatcacacagcatatgttccctcaaacaatgggaacaaatctgaagtcaacaagagaacaattacaggaaaattgcctaactctcagaaactaaacaataaacttctacataacccatggatcaaagagaaagtctcaagggaaattttaaaatatattgtgaactgagagaaaatgcaagtacaatacatcaaaatgtatgggaaagagctacagtgggtgacgagagacaaatttacagcactaaatgaatggtacattagaaacttggaaacaaatcaataatataagtgcccacgttgacaacctaaacgaaaattaaaaatagcaaaatcaacccaaaagtaagcagaaaggaagaaataattaaggtaagagtagaaacaaagtgaaaacagaaaaacaataaacagtaaagcaaaaagctggttctttgaaaagatcaataaaactgacacacctctctaagcaagactgacaaaaaaaaaaaaaagacataaattacccaacattagtgatgaaacaagctctaaagatatgaaaaaagataattaggaattactaggaacaactctacacacataactttgacaacttgggcaaaatagacttattcctcaaataatgcaaattaccacaactcaccaaatataaaatagatcatttgaatagctctaccactatcaagaaaactgaattcataattcaaagaatcccaaaaaaaaaaagaaattaccagatccaaatgaactcactggataattccatcaaacattaaaaaagaattaacacagactcaaaacaatctcttctggaaactagaaaaggaaaaacttcccaattcatattaagaagctaatattagagccaatattagcattttaagaagctaatattagagccaatattagcattttaagaagctaatattagagctaatattagcattttaagaagctaatattaggtaccgtaactaaagacagtacaaactacagaacaatataccttaatatatatatagacacaaaaatattcagtgaattattagcaagtagaagtaaacaatatataaaaagaattccacatcatcgccaagtagtttcattccaggaatgcaaagctggttcaacagtcaaatatcaatgtaacccaccctattaatagactaaagaacaaaaatcacataattacatatcaattgatttagaaaaagcaaatgacaaaattcaatactcgtgaatgataaaaattctcagaaaatagcaacaaatgggaacttcatcatcttgataaacagcatttacaacaccttaagctaaaacctatgccaacaagaatgtcagaaagggtcctcccagacctatttatacagcagagagaatcattaagaatgatttagatagttactaagagtttactctcctaagagattacaacacccaatggccagcaagcccttttcattagacaaaaagaaaagctgtgatctgtcaacactctcagaaggttcactgtgaaatgtgcacttctgaactcctgctgagggcctacacgctgcaatgttgagaagcaagtgtccagaggtctccttggaaacattgcaaaaaaaatgtgagggactgatggatgaatagaaggatgaaaaggtggagagaacggtgataaagcacgtgggatgatgccagcggcacaatcttaggtggtgaatatgtgggtgcgcgctgtaaaattctttcaacttttctgtatatatttttttcataataaaatgttggaaaaaataaacctgtgaaaaaggaagctttagtcaaacatatctaagcaaaagaaaaaacaaattctaaattcctatggctcaaattaacgtgtttttctttttaggctgagatggaagagtaaaaaaacagaaaaagaaatgaaaggaataggagctattctaacagctacaaattccacctgcagtttgattaaagatggcgtggctcaagaatatgctttgaatccaagccccttcaaggctgccaggtacagagtcggttctgcaaaagctctgtacctgtgaacaagcagagcttccaaataaaccgattaaagctgccctgagtcaataagccgggctttaatctgagcaagaaaggtacatttttagtctagttacccacccataactgtaggtactttgatacctaggtgaggggaaacatggagaaaggcaaaataacagatttttaaaatcacaacaaatctttatcaaacatttgtgccaggcactgacttaagagcttcaaatgcattatttcatgtcatttgcacagcaactctctgagtaagtactttcacttattttatatataattttaattatttacattatattatacttattccttttttttgtttgttttttttgttttgagatggagtctcaccctgtcacccaggctacagtggtggtgcaatcttggctcactgcaagctccgcctcctgggttcatgccattctcctgcctgagcttcccgagtagctgggactacaggtgcccaccaccacgcccagctaatttttttgtatctttagtagagacagggtttcaccacgttagccaggatggtctcgatctcctgacctcatgatccgcccgtctcagcctcccaaagtgctgggattacaggcatgagcctctgcacctggccacttattcctattttatacatgagaggcccaaggtgagacaaagtgatttgtgtagagtcagagataaagccaaaattgatacccagacagactgaaaaacttctctgtcagaaaatctagaaatggtaaagggagatcttcaaactgaaggaacatgataacacaaggtagctgggacagaaacaaaaccttaagggcccataatggtaaaatgaaagttaacataaaaaacttttttttggccagccatggtggctctttgggaggccgaggtgggtggatcacctgaggtcaggagttcgaaaccagcctgaccaacatgacgaaaccatgtctctactcaaaaatacaaaattagccaggtgtggtggcgtatgcctgtaatcccagctactcgggaggctgagccagaatcgtttgaacccaggaggcagaggctgcagtgagccaagatcatgccattgcactccatcctggcagcctgggcaacaagaccaaaactccgcctcaaaaaaaaaaaaaaaaagaggccaggtgtggtggctcacacctataatcctataatcccagcacttaagggtggctgaggcacgtggatcacctaaggtcaggagttcgaggcgagcctggcaaacatagtgaaaccctgtctctactaaaaatacaaaaacgttagccaggcacggtggtgtgtgtctgtaatcccagctactagggaggctgaggcaggagactcgcttgaacctgggtggcggaggttgcagtgagctgagattgtgccattacactccagtctgggcaacaacagcaaaactccgtctcaaaaaaaaaaagacttttttttctcttttcaaatttgaggggaaaaaatgtaattgcctatttaaagcaaaaacaaaaacatcatattgtggggtttataccatgtttcacttggacatgacacagcaacactaccaaccaagaacatgtgagaagcaggaagctacagtcagagcactgccccgcggctcaggcagtgtaataccatttgagagtgggcagtgacaagtgaaagatgtaactgaaaacgccagagatgatagatttaaacccaagtagtctaaagattccaaataaaaaacagaggttgtcagggtgaataaagaagcaagacctaattaaatgatacctgaaagaaatctactttacacatacacaaagtttgaaagtgaaaaaagctaaacctggcaaacacaccacgcaaacaccaaatcagaagaaaggagagtagtcagaccaaggtgacttcacaacaaagaatgtcaccggagattaagggggtcaaatttatgaatatggcgtaaaaatcctaaaagtgcatgcaccttataacattctcaaatacatgaagcaaaacctgcagagctgaaagaaaataatccataattagcatgagagatttcaattctcctcagaagaaagaggaactaagcagtgaaattgctcttcatgcctccccagcacaatggagatactcctgggaaataaagccagtcactggggctgatctcccagaacactgagactggcttctctgtaaataaatgactggtatttgctaggagaagtgtccttatctatgaaatgtttttagcaagatgtggttagtttaggattgtgtttggtaaacatacctaaaatccatggacttatgggacatggctccctggaaaaggttccctaaggtgtataaactatctgactacaaaacgggaacactgcacatccttaatgctccttgtgcagtgagatgacgacacacctcagtgagaggaccacacgcctcagtgagaggtctcatctcgcaggccgggctcaaagaggatggacctgcgggggttgcacagactctcccacatctctccccactttgcctgagcacacaagtgaggatattacttgtatctttaaagttactaagtaatcagctacgggtaacatctctgagattcatgtcaaactaatgtggtaagccaaccttgtgtgttagttcaactcctctcctaacagtgactagaacaagcaggcagaaaactatttcaagtcaaggatacctgaacactatcaacttgatctcactaagctttacagagcagcaaaatacactttttttttttttttgagatgtagtcttgctttgtcacccagactaaagtgcaggggtgcaatcgagattacaggcacccaccaccacacccagctaatttttgtatgtttcgtagagacagggtttcactatgttggccaggctggtctcgaactcctgacctcaagtaatccacccacctcagcctcccaaagtgttgagattacaggcaggagccactgcacccagccacattcttattacatgtgcatgaaacattccacagaatgcaccatattctggggcttcagacaagcctcagcattgaaatcacagaatatgttctctgactacaactaatttagaaattgttaacaggagatatttgaaaatccccaaatatttggaaatgaaataacacatttccaaataataagtgagtaaaagaagaaattaaaagggaaattagaaaatattttcaactgaatgaagatgaaaatgaataaacatttccaaatttgtgaaatgtggctaaacaatgcttagagggaaatttatattatagtcttgaacacttgttagaaaagacaaaaaatctgaagtcaatgatctaagcctttaccttaagaaactagaagagacagaagaacaaatggaacccaaagccagcagaaaaaaggaaataataaagagtaaagcagaaatcaatgaaaaagaaaacaaacaaaatcaataaaaccaacaactggttctttgaaaaaactcaaactgatgacttctaggaagactgatcaaaatcgaaagagagaaaatacaaggcacatttcagcaaatttctggataacaggtagtatatgctggtacttactacatgcaaaataatagcatacgcactttgtctggcctactgtactgatcccataataacctatgaggtaggtactactactaaccccaaatacgaatttttttttaagagacagggtctcaccctgtcacccaggctggagtgtagaggcacaatcatagatcactgcagcttcaaactgatggcctcaagcaattctctcacctcagcgtcccaaagtgctgggattacaggcgtgagctaccatgcatggtgtcactaattatttttatatatgtacatttacatatgtatgtccatgccaggaaagaaaagcctgaatatccactctgaagggataatagtggctaactcttagaggaaaactgaaattggggtgggcagccaggtgaaatttctgcttttataatcgatacatttttataagaaaacatttatttgatgtatatttttaattggaacgaaaatgcatcagacattttaaaaaattcaattacacacaaaaaagtaagcaaagaataaatatatgggttttactgggttggagaaagggaagagattatgaaagtccatccatgataaggaactcctataacccaaaacaaaaaactcaattaaaaaatggaattagctgggtgtggtggtgcccgcctgtagtcccagctactcgggaggctgaggcaggagaatggcgtgaacccggaaggtggaggttgcagtaagccaagatcatgccactgtactccagcctgggtgacagaacaagactctgtctccaaaaaaaaaaaaaaaaaaaagaaagggcaaaagggccaggaacagtggctcatacctgtaatacagcactttaggaggccaaggtgggtggatcacctgaagtcaggagttcaagaccagcctggctaacatagtgaaacttcgtctctactaaaaatacaaaaaattagccaggcacggtggcggacacctgtaatcccagctactcgggaggatgaggcaggagaatcacttgaacctgggaggtggaggttgcaatgagccaagattgcaccactgcactccagcgtgggcaacaagagccaaactccatctccccaaaaaaaaaaaaaaacaaaaaacgggcaaaggatttgaatagacatttctccagtgaatgtatacaaatggccaataagcatgtaaaaagatgctcagcatgactaatcaacagggaaatataaatcaaaacaatgagatgctgtacctactcacacaaattaggatggctatcatcagaaaacaaaaagtgttggtgagggtgtggagaaattggaaccttagtatactgctgcaagaatgtaaaacaatgtagccactgtggaaaacagtttactgcttcctcaaaaagttacacatagtgccaggtgcgatggctcacatctgaaatctcagcaactcaggagtctgaggcaggaagatcccgtgaagccaggagtataagaccggcctgggcaacacagtgagattctgtctctaattagtcaagcgtgatggctgggcaacaatgtcaatatatttaatgccaatgaactgtacacataaaactggttaaaacggtaagttacatggtatgtatattttaccacaatatttaaattttttaattagtttttaaaaaattgttaccaaaaaaatactaagaatccattcaagttatttagaaagggagtgtcagatcaacctttccaaagtgccaaaattcgcaagatcacctggttgcttgccccatacccagctgtccagaattgacttggccctatatataggtgcaggagtttcttcttcatcttttttctctttgtcattcagatctttctttgtcccacttggttcgacactatcatctgcagaattaaaaattttttaatctgtcaccgcttttcagaatgtcataccgttagcctctgcaaatgtccctccccgaaaagttacaacacacatgattaactgaatgcttgacaacttaaaaataaaatacatcaatcatacctgtaacagatccagtataattttcataaagaaaccaatatattggccgggcgtggtggctcatgcctgtaatcccagcactttgggaagccatggcgggtggatcaggaggtcaggatatcgacaccatcctggctaacacggtgaaacctcgtctctactaaaaatacaaaaaattagctgagcatgatggcaggcgcctgtattcccagctactcgggaggctgaggcaggagaatggtgtgaacctgggaggcagagcttgcagtgtgctgagatcatgccactgcactccagcctgggtgacagagcgagactccatctcaaaaaaaaaaaaaaaagaaaccaatacaacaaattatttaaaggatgtcttccaaaatgatattccatctacttcctagtacatttcttaactgagaaacttaagtctttcatatttacctacttcaatttcacaccaattgcttttatccagtgagtcccagtgcttgtgtatccatgggaaaagggagggtgtagaacaagagtatgattcaaaaatcttttaactctttacaaggccctactccactgccaactgggaagcactgctatgcaggggcactgtcactgctggcataattcaagagcactgggacacaaaggaaaagctgagaaaaatcactttaggccactgacaatgtcaagtttcagtcaaaaacaactgtcataaaactccttacacagtaagcgaagagaagagagaactaaccttaaccttgaagtgtaaacacattccatcacagaaggctgtgactaaatgtctaacaacataattagaaaaatgtatctcaatcggggaaagacatgatatcccatccagattacaaataatgactatctaaaaatctcgaaggaaacagttcctctgtttataacacttctgacaccaaatgtatggacttttgcaccaagcaattctccagttctctgcgacacccagctttgtgtcccacagtgcaattcaattctgaaactaactacctagaattagcacagaccccacaggttaataacaagagagaaaaggtgaatgctgaaaaaaatatccaaagaactaatggctgaaaacttcctaggttcagcaaatgacataaacccaggcagactgaagaatctgcacaaagcccacacaagataaatccaaaggaagccatgacgaggcacatcataatcaactgctaaacactaaggacaaaaccttttgaaaagtgccacggaaagtagatacagaagaatttctcgtgtggcctgaaattaagactaaatattacgtgctgccttgacattggtaaaatcaagaaggcctcaaatagcctaaccacaaggtctcccctgagctctgctctcacggataagatcccaaagccaaacaacctccttatcgcggaaacccgaccccagcctgctcatccctgccggcccagagttattcaaacaagccagtcacatcttcccatggaagcaaggtcatctcaccctcctgttactacaaaatgtgcctcccacagcccctcgtggttcgctctgttcccaagtgcagcccccgtgtggcatgcggtgtcccccaccccagggctgtgagcatgcgtgactaataaactgctatttcatctgtccagtgtcggtgtcctacgttcagccatcccatatccctagggcaggaatcttctagggttataaacagaactttaatcaacctctccttggttattttactggttccatgatacagctttttctgtgcaaaagatctgaacagaaactcacagaggatacaagagtggcaaaaaagaacatgatattcagcattgttagccattacagaattgcaaattaaaaccacaatgagatcccactagacttgttagaatggctcaactaaaaatcactgataacaccaagtgctaacaaagacacagagcaacagaaacgtgacagattgtcagcgggaatgcaaactaaaacagcctccagtttaccaaggtagacacctcgagtcacagaatacagagtagaacccagccaggaacacggctcaggtgagaacacaggtgctggctctgaatgccagactctgccgtgtgtgtgtgtgtgtgtgtgtgtgtgtgtgtggtcactaaccacagcccacaggacaaacccagcccacagcctttttgtgtatggtctgaacacagagaaagtattttagttttgttgttcttttgagatggagtcttggctcaccacaacctctgcctcccaggctcaagcgattctcccaggttcaagtgattctcatgcctcaacctccgaggagctgggattacaggggtgcatcaccatgcccggctaattttttgttttcagtagagatggggtttcaccatgttggccaggctggtctcgaactcctgacctcaggtgatccgcctgcctcagcctccaaaagtgctgggattacaggtgtgagccaccacgcccagccaccgtattttatagtttttaataattgaaaaataatcaaaagaaaaacagtattttgtgacttgcaaacattctgtggacttcatcttttcgtgtccataaataaagtttacagaatgaacgtccccagcccgctgacgtagtattgtctgtggctactctggcactacagctgcaaggtcccatggctatgacagagaccatagggtccattgagagcttaaaatatttactatctggccctttacagaaagtaggccacccctaccctacatctggctataaattttacaaatttgacaaattctgagaccctgtctcagaaaataaaataaaatattcatagtcttaataatggaaaacaaaaacatttactgaatgccaaaacatctccctaacaatcccaatcagttgggatctacataaagaacaattatgctctgctttccaaccatgatttttaaaagaacaaaagacaaaaaaattcatcaaatgtgggctgggcatggtggctcacacctgtaaacccagcactttgggaggccgaggtgggttatgaggtcaggagttcaagaccagcctgaccaagatggtgaaactccgtctttactaaaaattcaacaattagctgggcatggtggagggcgcctgtaatcctagctgagtactcaggaggctgaggcagagaactgcttgaacccgagaggaaggggttgcagtgagccaaaatcatgccgctgcaccccagcctgagcgacagaacaagactccctctcgagaggaaaaaacaaaaaaaattcatcaaatgtaatgaataaaacatatactttggattttgccatgtacttagcttttcttagagcaccttttagaactattgtttcacagaaaacactttgggaaacgttttaatttataaacaaatactggagggctaggaagaagaggttaaaactttttaaaatatacagaatgaattactgatacagaaaaacaaaaaaaggttgctgattcctgtcttggaagacactgtcatatggacactcttagcctcagcatccagaggtccagaaagggaaaatttcaagtcagagagaattctatatataccacttacttggaacattcagccctcaaaatcccaacatcatgacctcagtttcaacacaattgtccttagtccttatgtcactgcttttggtgctgcctgctgtcaaggcagtggaagccagtgatgcaactgctctctcgttaaaaggtgtggttctcagtattacaggtgtttgtacttgcttgcgggtatacgcacgaaagataaaaatgaacagatgtgactttgaagggcctaatgaatgaaacctcaccctgaaaacctttgtgctactgaaactaaatgtaagctttggtgtctgaaagtttccaagaattagtaagtaggagagttttactttctgagttgattccatgaaatgggaacaaattggtacataaatggattttgcccagaatcctaggaaatcgccactgttcagtcgtaatcactgcctcctaaatcactgagtctgttctctgtatttttattagacttttgtcatctcccaaattcagatatccaatagtcagccaaaaagggaaacttttatctctggaaagaaaaaaaatcatttagaaaaatgtattcagtgtatctaatactgaaatggagaaaagacttaatgttaaagaaaaaaaaaacactatagacattgacatggaaaagagatttaatgttaataaaaactttatattaactgagtaacacctcctgatgagaagtgctatattaaatataaacccattatgttgtttaaaaaaaaaaaacatgaaaatcaaaagcactaaacagagtgaaagaagccaagacacagaagaacccgactacatgattccatgtatggagttctagaacaggcgcaatttgtcaatgctggagaaacatcaggccagctattgcctctgggaagaaggggcaggacaccagagaactttctgagcaagagtcatgataaagatgtgggttacacgggttacatttgtcaaaacttgtgaaatggtaaactcaaaatagatacatttcattatatataaattttacctgaaagtcaaaaacaaagttgaactagaatcaattacatacatgagtgtctaaggagctaggtgagacaaacggtggatggacagacagcaggatgtggagccaaatacggtggcagaacatggaggtgggtctgcagccactcactgtacacgtctgtcagttattgtgtgtgtgtgtgtgtgtgtgtgtgtgtgtgtgtgtgaatattttcaaacaaatataaaaaataaattaaaataaaaacacaggtaactctgcttgacactgaaactgaagagggagactaatactttttcccatggtttgttttgtgttttttgtttttttttttttgagatggagtctcactctgtcacccaggctggagtgcagtagcacaatatctgctcactgcaacctccacctcccggctccaagcaattctcctgccgtgccctcccaagtagctgggattacaggcgcccgccactatgcctggctaatttttgtattttttagtagagacggggtttcaccatgttggccaggctggtctcaaactcccaacctcaaatgatctgcccgcctcagcctcccaaagtgctggaattacaggcacgatccaccgcgcccggtccccaagtattttcaagtggacaccatcccaattcattccacaaaagaagaataaatacttgccaggcacggtggctcacgcctataatcccagcactttgggaggctgaggcgggcggatcacgaggtcaggagattgagaccatcctggctaacacggtgaaaccctgtctctactaaaaaatacaaaaaattagccgggcgtggtggtggacacctgtagtcccagctacttgggaggctgaggcaggagaatggcatgaacccaggaggtggagcttgcagtgagctgagatcgcgccactgcactccagcctcagcgacagagcaagactccttcccaaaaaaaaaaaaaaagaagaagaaatactttcttcagactaatgctctcccaactgagctatttcaacttagaataaatactttctaaagtggtagctttatccacgttgatgactctcaagcagggggaccaacgaacttcaacagtggttctcaaccaaggatcttttcagattcaacaagtttagggtgtatacaagcatccatttttttaaacctcaatggggactctgaaacacagccactgttatgaacaacctaatgatagtcctattgagcatgcaaaactacaacgctaaataagattgttcaatggcatttccttgcaggccaaaggcttccaataagtgtttaatacacccccaaagaacaccacaaatgcagcaagacggttttgcaataaaaatgccttcaattcacgtaaaacaataaaatccgggcagcttgtattaactaccattttagacaacaatctccaaagtaaaaagcaaaacttcaaagagttaagctcaaagctcctgttcctatagcacattacaaaatttctataaaatgcattttataatggtctttaccaaataaaaaacactagttaaaggcccttaccttttccaggagggagctatccgttctgggttgattctgttccagtgtatacaatttctccatctttaaccatttcattccacagaccacagagcccatctcttgtgaatgcaagctggcaatgataaacgagataagctcacactcacactgcaatttttaaagaatgatatgggaaaaaatctcaatcccccttatgtattcgatcattcggtaataaaatcaatgatttactgaattagtgacttaatcattttacatttcatgaaagtcatccaagaaatataaatgaaaaggtgcataatagtataaatactattctacctcttatgtaacatacaagaaaaatgacacgtggtcaggcgaggtggctcatgcttgtcatcccagcactttgggaggccgagcggggcacatcacgggggatcaggaatttgagaccagcctggccaacacggtgaaacgccgtcccaactaaaaatacaaaaaattagccaggcgtggtggcgggcgcctataatcccagctactcacgaagccgaggcaagagaattgcttgaacccaggaggcagaggttgcagtgagccaagatcgcgccacagcactcagcctgagttgataagagcgagactcggtgttaaaaaaaaaaaaaaagaaaaaaaagacacacacacaaacacacacacgtgcatatgctctgaaaagataaaccgaaagcaagtaccaatgactacctacggggaaatggggaggggacatggacaaaggcagcaggaccagaaaaagcaacaacattgtgagtatactttagatgtctttacttctgaaacatacatgactttcatcctcaaaaattaaaattaaatcataaaaaagcaaaacctacaactggcaacaagcaaattaacccatgcatatacaaagaaaagtatgtcaagggacttttgaactacatatcattaatagaatatactataatgaaaaataaaatatttatcggtattgataacactctcacaattttagaactacttcatgttgcacaataaagcagtgtaaatacaataaaacatgtttatgataaagtattaaatgttctcagaaattaaggttttaggccggccatggtggctcacacccgtaatcccagcatttggcaggccaaggcaggtaaatcacttgagatcaggagttcatgaccagcctggccaacatggtgaaaccccatctctactaaaaatatgaaaaattagccgggtgtgctggtgcatgcctgtaatcccagtcactcgggaggctgaagcagaagactagcatgaacccaggaggcagaggtttcagtgagccgagattatgtcactgtgctccagcctgggtaaacagaacgagactccatctcaaaaaaaaaaaaaaaaaaaaaaaaaaaaaaaaaaattaaggttttcagtggaaaagaggaaaaaaaatcaaagaaattttgaaaaacaacttaaattggaaatctatgaactttatttttgaatatatttgcttactctgttttttaaaggactagaatcaaaggcaatctgacagcggcacccagattttggtctcttagaaccatttcccgataaaagacgctagggctcttgggaaaataagtagattcaagggccagggcagacaaagatgagcctgtttcctcaaagaaaaagctgtttcctcaaacatggccaggtgcggtggctcacgcctataatcctagcattttgggaggctgaggcgggcagatcacttgaggtcaggagttcgagaccagcctagccaacatgccgaaaccccatcttttttaaaaatacaaaaattagctgggcatggtggcaggcgcccataatcccagctacttgggaggctgaggcaggagaatagcctgaacccaggaggcggaggttacagtgggccaagactgtgccactgcactccagcctgggtgacagagcaagactttttctcaaaaaaaaaaaaaaaaaaaaaaaaaaaaagcagctgttcaaagatgatagggactcctggccaaatttataataattataataactgtgagcatcaaaatcaaaaacgcctttgcttgtcaacatttgtgagtcagaaaaggcttcccagaacaggaaaagggagcatttcagacactgggggaaggcatccattctgaaaactgcgtatgtgacagaagctcccttgtctggcaaaacaaaagccatttttaattaaaagagacagatgtttgcccatcttttttttttttttaacttctgtggatacacactagttgtatgtatatatatatgggttatatattctatctaactcttttttttttttggagacggatctcgttctggcactaagctggagtgcagttgtgcgatctcagctcactgcaacctttgccttctgggttcaagggtttctcctgcctcagcctcccaagtagctgggactacaggctcacaccaccacacccagctaatttttgtatttttggtagagatggggtttcaccgtgttggccaggatggtctgggtctcttgacctcatgatccacctgacttggcctcccaaagagctgggattacaggcgtaagccactgtgcccagccctatctaactccatttttatacccattaaccatccgcacttcacccccactttatccttcccagtctctgataaccatcattctactctatctccatgagttcaattactttcatttgcttagcacctacaaataagtgagaacatgcaaagttcgattttctgggtctggctcatgacattctgttcctgacttaacataacgacctccagttctatccatgttgttgcaaacggcagtatcccattctttttcatggttgaatagtactccgttgagtatatataccacattttcttcatccattcatctgctgggaacacttaggttgcttccaaatcttggctattgagaatagtgctgcaataaacatgagagtgtacatatttcttcaacatactgatattctttcctctgggtatatacctaccagtgggattgctgaatcatatgatagtcctatttttagttttttgaggaacctccaagctaatctccataatggctgtgctaatttacattcccaccaacagtgcacaagggttcccttttctctatattcttgccagcatttgttcttgtcttttggatataagccattttaattagggtgagataatatctcattatagttttgatttgcatgtctctgatgaccaaccatgttgagcacctgttcgtactgcctgtttgtcatttgtatatcttcttttgagaaatgtctattcaaatcttttgcccattcttattggattattagatttttttcctatagagttgcttaagctaattatatattctggttattaatcctttgtcagatgggtagtttgcaaatattttctcccattctgtgggttgtctcttcattttgttgattgtttcctttgctgtgcagctttttaactcaatgtgatcccacttgtccattttagctttggttgcctgtgtttacgaagtattactcaagaaatcactacccagtgcaatgtcctggagagtctccccaatgttttcttttagcactttcatagtctgaagtcttaggtttaagtctttactccattttgatgtgattttcgtatatggtgagagatagtggtctagtttcatttttctgcatatgggtgccccattttcccagcaccatttatcaatgaggctatcctttccctcatgtatcctccgggcacctctgtcaaaggtgagttcactgtagatgtatagatctgtttctgggttctctattctgttccattggtctaggtgtctgtttttataccagtaccatgctgttttggtatacctttctagtaaactttgcacttgatctaagccaaaaaagaccaggaagtgactgtagtataattttaagtcaggtaatgcaatttctccagttttgttttttgctcaggatggctttggctattctgtctcttgtgattccatacaaatttcaggatttttttttctatttctgtgaagaatgtcattggtattttgatagggattacattgaacctgtagattgctttgggtagtacagacattttaacaatattgattcttccaatccatgaacacagagtatcttttccttttctgtgtgtcttcttcaattttctgcatcaatgttttacagttttcgtggtagagatcttttcacttcttgggttaggtttattcctacgtattttactttatttgtagctattataaatggaattatttttcttgatttatttttcatattgttcactgttgacatatagaaatgctactgatttggctgggcaaagtggctcatacctgtaatcccagcactttgggaggccgaggcaggcggatcacctgaggtcaggagttcgagaccagcctggccaatgtggtgaaaccctgtctctactaaaaatacaaaaattagccaggcctggtggcaggcgcctgtaatcccagctactcaggcggctaacacaggcggatcgcttgaacccaggaggcagaggttgcagtgagccgagattgcgccattgctttccagcctgggccacagagtgagactccatctcaaaaaaaaaaaaaaaaaaaaaaaagagagagagaaatgctactgatttttgtatgttaatttagtatcctgcaattttactgaatttatcagttctaatcattttttggtggagtttttaggtttttccaaatacaacaatcatctgcaaacaagagtaacttggcatcttcatttccaatttggatgccctttatttcttcttcttttttttttttttctgagatggagtcttgctccatagcccaggctggaatacagcggcacaatctcagctcactgcaatctccacctctggggttcaagtgatttccctgcctcagcctcccgagtagctgggacaacagacacccgccaccacgcctagctaatttttatatttttagtagagatagggtatcaccatgttggccaggcttcaaactcctgacctcaagtgatccactcacctcagcctcccaaagtgctgggattacaggtgtgagccactgcacccggcctttctctctcttatctgactcctctagcaagggcttccattattatattgaataacagtggtgacagtgggcatccgtgtcttgttccagatcttagaggaaaggctttcagtttttcacctttcagtatgatactagctgtgtgtcagttgtatatggcttttattgcgttgaggtgtgttccttctataaccagttttttggggtttttatcatgaaaggatgttgaattttatcaaatgccttttcagcatgaatttaaatgatcatatggttttttatccttcattctattgatatgatgtatcaaactgattgatttggatatggtgaaccatcctggcatccctgggataaaccccactttggtcatgatgaacgatgtttctaatgtgttgttgaattcggtttgctggtattttgttgggtatttctgcatcaatgttcatctgggatactggcctgttttgtttttttgattatgtctttgtctggttttggtatcagggtaatattggccttctacaataagtttggaagtattccctcctcctctatttttcagaatagtttcactaggattggtaatagttcttctttaaatgtttggtaaaattcagcagtgaagtcactgggtcctggggtttttctttgctggaagactttttattattacagtttcaatctcattacctgttattggtatgttcaggttctggatttcttcatggttcaaacttggaaggctgtatgtgcctgtgaaattatccatttctttttccttctttttttgaagacacagtctcactctttcacccagggtggagtgcagtaacatgatctcagcacactgcaacctccccctcccagggctcaagtgactctcgtgcctcagccttccaagtggctggaattacaggcacgcaaaaccacacctggttaatttttgtatttttagtagagatggagtttcaccatgttggccagactggtctcaaactcctgacctcaagcgatccacccgcctcagcctcccaaggtgctgggattacaggtatgagccaccacgcccagcctgcaaacttatctatttcttccacgtttcccaatttattgacatatagctgttcatagtctctaatgaccctttgaatttctgcaatatcagttgtaatgcctactttttcacctctgatttgggtcttctttttctcttagcctgcctgaaagcttgtcaatttatcttttagaaaaaccaacttttcatttcattgatcttttgtattattttcttcatttcaactccattttatttctgctctaatttttattatttctgtccttaaaattatgggtttggttagctccttcatttctagttctttaagatgtatcattaggttatttatttgaagtttttctacttttttgattttcctcttagtattgctttcactatatcccacaggtttcgtatgctgtgctgccattgccatttgcttcaagaaattgtttaatttcattcttaatttcttcactgacctgttggtcattcaggagcatattgtttaattcccatgtgttggtggagtttccaaaattcctcgttattgatttttagttatagtccattgtgatcagagaagatacttaacataatttttttaacttttatatggcaaaagaggaatctagcttcattcttctgcatatgaatatcaagttttcccaacaccatttattgaagagattgtcttttccccagtgtttgttcttggtacctttgtcgaaaatgagttcaccgtagatgtgcggatttgtttctggattctctattctgttctgttggtctgtgtctgttttatgctagtactatgctgttttggttactatagctctgtagtataatttgaagtcaggtaatctgattcctccagtttgtttctttttaattacgagagcttcggctattctgggtcttttgtggttcaacatgaattttaggattttttttttttctgtttctgtgaagaatgtcattggtattttgctagggattgcactcaatcggtagattgctttgggtagtatggacattttaacaatattgattcttccaatccatgaagatgaaatatttttccatcttttgtgtcctctttaatgtctttcatcagggttttagagttttcattacagagatctttgtaattatcttctttggttacttcccaggtacttaatttcatgtgtggctactataaatgggattagttttctaatttttttcatattgtttactgttggcacacagaaatgctactgatttttgtatgttgatttcgtatactgcaactgtactgaatttatcagctctaatcattttcttgtggagtctttaggtttttccacatataagatcatatcatctgcaaacaaggataatttgacttcttcctttccaatgtggaggccttttatttctttctcttgtctgattgctctagcaagaacttccagtactatgttgaataacggtggccacactgagcatccttgtcatgttccagatcttagaggaaagactttcagtttttcaccattcagtatgatactagctgtgggtctgtcatatacggcttttattatgttgaggtatgtttcttccataatcagttttaagagattttatcatgaaaggatgttgaattttatcaaatgccttttcagcatcgactgaaataatcacatggtttttatccttctgttgacatgatgtgtcacatcgattgatttgcatatgttgaaccatccttgtaccccagggataaaccccacttcatcacaatgaacgatctttctaacgtattgctgaatttggtttgctagtattttgttgaggatatttgcatcaatattcatcagagacattggcctgtagtattctttctttgacgtgtctttgtctgcttttagtatcaaggtttcaatttttaatgacttattttgtggcctaacatatggtctaaccttgaggacgatccatgtgctaaagagaacaatgtaaattctgcagccatcagatgaaatgttctagaaatatctattaaatccatttggtctacagtgcagattaagtttgatgtttcttcgttaattttgtctggatgatctgatctgtccaatgctgaagtggagtgttgaagcctccatctattaatgtattaacgcctctctctctctttagctgtaatatttgttttatgtatctgggtgctctagtgttgagtgcatatatacatatatttataatagttatagcctcttgctgaattggcccctttatcattacataatgacttttttggtctccttttatagttttggtcttgaaatttatttggtctgatataaccgctatgctcttttgtgatttccatttgcctctccctttttccatccctctgcactgtcctgaagagatggtctccaatctgaagaagcaagcagccaatgaactgcctgtggggaggggcagcctccaagagcccagggtttcagtcccacaaccacaatggattcaattctaccaatgaggacctgagctccagatgacagcgtgccctagccaacaccttgactacagcctgtgacacctgaagtagaggatagaactaagctatggccagactcctgacccacagaaactgtgagagtgtaaatgcttgttgttacaagctgccaaatttgtgtttggtaacttgttctgtagcgacagaaaccaagccagcatccttcagtttttgtagaaggaacagctttccctcagcactgttattttttctgttcacatcactaacaggataactgccataaacatacttggaaccaaaacatatgacttttggtaaaaatatcagctggtgggggagaggtaaactccttcctaaaaagtgagccctggccagatagagtgactcacatctctaatcccagcaccttggaagactgaggcaagagaatcacttgtgcccaggagttcaaaaccaatctaagcaacatagcaagaccctgtctctacaaaaaaattgtaaaattggccagaaagctgggcatggtggctcacacctgtaatcccagcacttgggaggccacggcgggtgaattgtttgagctcaggagtacaagaccagcctgaacaacatggcaaaaccgcatttctaccaaaaatacaaaaaattagccagaggtggtggcgcgcctgtactcccagctacttgggaggctgaggtgggagaactgcttgagaccaggaggtagaggctgcagtgagttgagatcactccactgtactccagcctgggcaatagagcaagaccctgtcaaaaaaaatttttaatttaaatttaaaaaattaaaataatataaaaaataaaattaaaaagtgagccaaaaacattcagggcccctgaagtttaacgagtgaatggaaagctttgactcttctagtcttcagtcagaggagagcagtgaatacgtgcactggggttcagtccaaaccctaccacaatgcacatgataagaggctaacagtggtcagaactcacagctccatgtgggccgtgctccaggagtttcagactatctttaggcactcaagggaatacgacatttgacccgtgtcttaaagtgtttcagaaaacagaaacagagaaggtgaactaagaagctattactggccaggcacggtggctgacgcctgtaatcccagcactttgggaggccgaagcgggtggatcatgaagtcaggagataaagaccatcctggctaacacagcgaaaacccatctctactaaaaatacaaaaaattagccagatgtggtggcaacgcacctatagtcccagctactcgggaggctgaggcaagggaattgcttgaacctgggaggcggacgttgcagtgagtggagatcgcaccactgcactccagcctgggtgacagagtgggactgcatctcaaaaaaaaaaaaaaaaaaaaaaaggctattaccaagtgtccaaaaaagaaaggatgacagcagaagtcaacacagggaagtacagtctttaagattatttcaggcagggcacggtggctcacatttgtaatcccagcagtttgggaggccaaggtgggcagactgcttgagcccaggagttcgagaccagccagagcaacatggtgaaacccggtctctacaaaaaatacaaaaattaaccaggcgtggtggtacgcacctgtagtcccactactcagggggctgaagtgggaggatcacctgagcccggggaggttaaggctgcagtgagccgtgacggtgccactgcattccagcctgggcaacagagtgagaccctgacttaaaaaacaaaaaaagaaactatttcaaatcacgtaagttaaatcaaatgtgaaagggaaaataagggagggaacagaagaggaatgagaattagttccgttttaaccactaagatttgcactaactactgaacataaacatggagctcctccccactccaccaaccctcagtaaatatagatccagatcttagcagagtgttcagggctagagactcaaatctgggagtagtcaacaaatggactgtaggtgatgtcctggagaagatgccaacacccaagcagagaggggagacccctgcccagccctgaaagcactctaagatcgccccagactggctgggctccacacatcagtgttctgcggtacagcctagattgagaaacattagtgttacagaggtaccatttaaaaaaaaaaagccaaaagatggaacatttaaagactaagccaaagaggaagcccagtttacatggaaacaagaataattaccaccacctttcgattattacctgggtagcactgggaaggaagaggataggccagaccttgtccttctgagtaacaaggaattcttttttggaaggtagacactggactcctggaaggacatgcactgtggaagcctcctaggaactgatgacccaaataaatggtaagcaccattcaaaaaactatttgggcaccttaaaggtggaacattactaaggcaataaagcaagcctcactggaggaggtctccagagagttagactctgaacaagcaaaagtgaagcccagaagagctctccagatcacaaacagtacaggatcctgactgaggaagcagcagcctgggaacaactggaagacagccgtggcactgagaagaatggagactacaggcagggcgtggtggcccacgccgtaatcccagagctttgggaggccaagacagaagaactgcttgaggccaagatttcaagatcagcctgggcaacatggtaagaccgtgtctctacagaaatgtaaaaattacccaagtgcatggcacgtgcctgtaatcccagctactcaggaggctacagcaggacggtcacctgcacccaggagtttgaggttacagtaagctctgatcacaccacagcattccaacctgggtgacagagaccctattcatttaaaaaaaaaaaaagaaagaaaaagaaaaaaatgaatgggactttccatttgtaaagtgagagtatttatttctacaactgtctccaattagctttttattagtagctgacttacctaaacgtgcccagtagcttttcaacttttgacttttttggttcagatcccagaagcttctaattaggttatttgggctaagaactcttttccaatcttttccaatctcacattcctatcttacacctctgaaatgacatggcaagtaaaggcactttcatcgtcaaaagaccccagcaaaagaggcagtaacaggctcactttttgtaagttactaaactgaagctcagaaggccaatgacttgaccaaaggccacacaacactgaggctgtgagaggcgggatttgggaagaggcccaactccaaggcttattcgcttcccaccaacaccataacatgcacccacacctgcagcacggcagccagggcaagccttcacgctcccatacataggccaccaatattttaataccaatcaggactaggcaagcaaacagttaaggcatttttttttttttttttttttgagacagagtcttgctctgtcgcccaggctcgagtgcagtggcgccatcttggctccccgggttcatgccattctcctgcctcagcctcccgagtagctgggactacaggcgcacgccaccacgcccggctaattttttgtgtatttttagtagagacagggtttcaccgtgttagcctggatggtctcgatctcctgaccttgtgatccacccgcctcggcctgggattacaggcgggagccaccgcacccagcccgttaaggcatttattaaagtgacttcagaactatagagtcaggcaataaaatccaaaactgaataatataacaaatgaatatctgattaatgtataggttagaaaatgtttctttttcatgtccttacaatttgacagaaaagtaatcttcaaatatttgcagatgagtaaaggtatacggctttttttcttaaacctacagaaaaatactaaacacctactgaacgtaggacaacatatgaaaaaatgttaagaacaggttcctagaacaattagaaaggtcagacaggaacattaagtacgtcgatttgaagacatcctagaagcagcaagggagtgaggtcttcctaaagtctaagacccacgagaggaagaaagaggcccagagaacctaagcacgcagggatgagactgagaagcaaaacggagcttctgagagactcccagggccctcatacaggagaaagaggcctggcagatcccatgctctgagctggaacctcaaagggccacacaccagaaatacaggtgagttagaagtagaccagccttcacggaaaaccagcccagtttcgcattctctcaatttccaaagggactgcagtgacctgggattgcctagaacatcctctctggaggaagatattgttacctagagcctcgatttattgctacaatattgcatatacaatatctgaaagtcaagcaaatataataatgacaaagatacaagaccacatcattgaaaaatgaaaaaaaaatagaagtcattagaacagactgagtagatcctgaaaacagaaacataaagacttctgtcatgaaagaagagcctgaggaatgaactgaagtgttgacactctgctcagcagatgtcagctcggggcaatggggtgagggaagtgggaaagcgagacaaggagatcaatgaagtaacgatatgcagtatatgacttcacagtcagctaagtgtgattttagcctactctgcctatgtaggagccattcttatttcctttaatttcctaaaaaaagaaaaatatatattaaaaaagagtgattttatatttttcaatggttgcaacataatcaaaagaatcatatgtcagccaagcacggtggctcacacctgtcatctcagactttgggaggccaaggcaggcggatcacgaggtaaggagttcacgaccagcctggccaacatgatgaaaccccatctctactaaaaatacaaaaaaaaaaattagtgaggcatgatggtacacgcctgtaatcccagctactccagagtctgaggcagaacaattgcttaaacccaggaggtggaggttgcagtgagccaagatcgcgccactgcactccagcctgggcaacagagcaagactccctctcagaaaaaaaaaaaaaaaaaatcatatgtcaacaaatgaaaattatatgacattcaaattctggtatccacgaagttttcctggaatatagccatacacatgtttggcagcttctcgcaggacaatggccaaggtgagctgttctaaaagagcacgtacggcccacataaacatttactatctggtgctttacagaaaaaatgtgctgacccctatgttagtgccacctcttctcaatgagctgcaaatacaaccaactgttcagccagcacattcactaggcatatgtggcttttccagaaggtttgcaagaagaaactacaccataaaatagtccaaagaggaaagaaaaaagggaggaataaaaacactgagttccctcatctctccttgtaaagtggtgaacgttcataccacaaggaattcacacccacacacactcgccacaccttccaggctgtgtcactggctccttggtaggcagtcaggaagccatactccaactctcttgcgtgacatcacagcggagactggagccgaagggcggctcacaggcatgagtcagccaagagggacagagagaggcggctaaggaatctatggggtcggacaaggtttataaacacacttttaaaataactacctttaatagagtcaagcaattaaaagatcctattaacagccgggcacggttcatgcttgtaatcccagcactttgggaggccaaggcaggcggatcacgaggtcacgagttcaagaccagcctggccaatctggtgaaaccccatctctattaaaaatacaaaaattagccaggtgtggtggcaggcacctgcagtcccagctactcgggaggctgaggcaggagaatcacttgaacccaggagatggaggttgcagtgagccgagattgtgccactgcactacagcctgagcgacagagcgagactccttgtcaaaaaaaaaaaaaaaaaaaaaaagatcacattaacaatttcaacacagaagttgaaactagaaaaaagtacctaaagtggcagttaaagaaactgtcaaacatttcaaactaaacattttaaagggatgtgtttaatataattatacctcaataaagttgatatgtttaaaaaatggaaattctggaatagaaaaatataatagtaaaatttaaaactcaatggatttgattaaaaacagattgggaaggcctgtgcttcctccacctataaaggatgaattctgtagaaatcacttccttgctataatcaactagaaaaccagacagaatataccgaaaagctgttaccaaaaactggacaacagacagcccagagctgggatccctgagagaagggaaacactgcccagaagcagcttccaggctgcagcacaggaaaggggaacccaaatagagcccaaagaacttgctgagctcaggagacagatcagctatacgtaggccaaatgacaagaatacagcaagctccagagatgagtggaggggccccttgagtatctgtctgagtactactctgagcataggttaagaaaactatggaatactggggaaagcagcactagaaagtaataagcagcactgccatgatgcacagtctgggaaaagcctgtgtttccacaaacaaggaaagaaagatcttctcatacaccaagcatcaggtggagtcctgagaacagtattgccttcgttgtatggataaatgagcccaagagtaaagcctgtgtggatcagcctaacaaacctcagaatcaagctttgaaaagatcaaactgaccccatgtaacttacatgtatggcagaagaaaactaaggctctttaaaaaaataaaacaaaatcctgcacagaagataaaattaatgcctagcattcaatcaaaaattagcaggcatacaaccatgcccccataactagggcaatcaatcaatagaaatgacagaatcaatcaacagagatggatctagaagtgatcagagattacagaattcacagacaaggacattaaaagctctcttacagaaatgctccctatactaatagaaggaaagcatgaatgttataaggagtgaaacagaagatataaaaaggactcaaatggaatctctagaaatgaaaatacaaaatggatggatgagattaacagaactgcataacagttacaaccataatctacaatgtctaagcacatggctatgccatgctctctcccttaacactcatgcagtctaggtttaacaaataactgtttcatgcccatcatcagttgcaggttgatctacagtcatccagttgtctaaagatctttctccactccattcctaaggaagggctcatgagaacaatacttcctaagttacagctcactgagaagtttgtgtgtttttcatctgaaaagtcggttttgctggaacaaaaaatgctttactcacattttcttttcttgagtgccttaaacaggatactcaatttcttcttcataaagaattgtcatctgctgggctcagtggctcactgctgtaatcccaccactctgggaggccaaggcaggtggactgcctgagctcaggagttcaagaccagcctgggcaacatggtgaaaccccatctctactaaaaatataaaaaattatctgggtgtggtggtgcacacttgtaattccagccacttaggaggctgaggcacgagaatggcttgaacctgggaggtggaggttgcagtgagctgagatagtgccactgtactccaacctgggcaacagagtgagactctgtctcaaaaaaaaaaaaaaaaaaaaaaggaattgtcatcaaagtcctacggctaaacccttttccttttttttataacaagtattgctagtcttttccaagaaccaaagttaaaagttagttctttaaaacaccaggccaggcacagtggctcacatatctaatcacagcactttgggaggccaaggcaggaggatcacttgaatgcagaagttctagaccagcctggacaacaaagcaagaccctgcctctacaaaaaacttttttttttgctgcaaaatgctcttaattaacctgacaaaatgccacatacagggttactgcatcttttttatcatggaattttgaaaacaaaaattgttctcttgaggcagcagtatttggatattagaggtaaaaaccacccttagaatccagtcctaaaaacatcaatgaatattcctatatttacaaattcttctatttctacatgtcatctatcaacaggattatgaacctgaaagcctgagaatagaatttatcaagatactcatgtttgtactttttttatctactgcccttttttattttttttgagacagattctcactctctcaccaggctgtagtgcagtggcgcgatctcagctcactacaacctccgccacctgggttcaagcgattctcctgcctcagcctcctaagtagctgggactacaggcacgtgccaccacacccagctaatttttgtatttttagtagagatggggtttcaccatgttggccaggatgatctcgatctcctgacctcagcctcccaaactgttaggattacaggctaagccaccacacccggccatctactgatatttctaagcatgaagtgacattttttttttttgagaaggagtcttgctgtgttggccaggctggagtgcaatggcatgatctcggctcactgcaacctccaccttctgggttcaagcagttctcctgcctcaacctcccaagtagctgggattacaagcgcacaccaccacacctggctcatttgtatttttagtagagacagggtttcaccatgggggccaggttggttttgaactcctgacctcaagtgatccgccctcctcggcctcccaaagtgctgtgattacaggcgtgagccaccgcgcccagccgaagtgacaatatttatatacaataagtttaactgtaaaagcttacatttatgcgtggtcatttttaattgatgattagatgaagagacaaataaatggtcccagtttagctactgatatactcaacaaaccttgacggacctgagggcattatgctgagtaaagaaaatcatttccgaaggtcacatatcacttggtaatctcacagtaacaaaattatagagatggagaacagatcagtggttggcaggagttagagatggtggcagaagagaggcaggagagagatctttctggtgatgaaacagttctgcataggaaattgtagtagtagttatatttacagacacttgatagaatggcacagaactacgcacacacattgtaccaacttcaatttctgggtttttatactctattatggttacataaaatgtaaccactggggcagtatgcgcaaatatacaatgacctctctagtttctttacaacttcctgagagtctattattatttcaaaataaaaagtttttttaaaaattgcttcatgcatatctagtttcatgtgccacttaaaaaagaacccaaaaatagaaactgtaggaaattcatctgagtgcagcttatgcaagaaggggcaggataactccattctggacctatgctcaaagacatgcacctttaccttacaacaaaactggcgaacaggcatgtgttttaagaataaaaagcttttaaggtctcatatattggtttttatgattcctttgcttaactgactttttggtttgctaaaaaactaccaatcacatcagattagaagtactttcacggtaaaaataaaaagtgatgtgactgacacctcttacctctgtaatgtattactcttcacgagagcagtgaaggaaaacatggtgattcaatcactccacacatcaagcagaaaagagtgttgaacaggccgggcgcggtggctcacgcctgtaatcccagcactttgggaggccgaggcgggtggatcacttgaggtcaggagttcaaaaccagcctggcccacatggtggaaccctgtctctactaaaagtacacaaaattagccaggcgtggtggtggacacccgtagtcccagctactcgggaggctgaggcaggagaatggcatgaacccaggaggcttgcagtgagccaagatggcaccactgcactccagcctgggagacagagtgagactccgtctcaaaaaaaaaaaaaaaaagtgttgaacaattaaactgtttatatgtaataaccagatatatatgcctggcataaaatgagccctgcattagaggttgctggatgtagggtcctaggcctgacgtatccaaataatgtctatgataaagaagtcaataagtgctctctataacacacaagcattataagttttcacactccaaaaactcttcctttctaaagttactaaaacttttaagggcatttcgaacaaaaacagctgtggaaaacagatcggttaaatcctatggctaagaaacatcttcctatcccatgtattattcattacccaggtgtcaattctgtttccaatacaaaagtctcaagcagtgaagcgcttcccactccagctgggagagccatcctcaacaagataagggtaaaacctgtgagcacaaggcttccatctgcaattcctgtctgcagggaagctccccaaagagggaaaccatgtcttattccttacggtaaaacaccaccattcattccttgtgtttaacaaccaatgctggtggaacataaaacaaaacttagcaatcacttttttcatgctacttagacctgtaacacatttttcctctggtgcacactatccaaaacctagtcgtttcccttactcctaggaggaatttagatgactttttttttttggccaggtgcagtggctcacgcctgtaatcccagcaatttgggaggccgaggcaggcagatcgctttgaggtcaggagaccagccaggccaacacagtgaaaccccatctctactaaaaatacaaaaattagtcgggcatgcatggtggcacacacttgtaatcccagctactcggaaggctgaggtgggagaatcacttgcattcgggaggcggaagttgcagtgagccaagattgcgccactgcacgccagcctgggcgacagagcaagactgcgtctcaaaaaaaagactttctaatcatattggaaatgtgtaacaaggaccaagtactgtgtattaaacttaataaatcaaaacaacaggccctctaagatataaatggtgcttcactgtatgtttatctgcccaacccatcataggaactcaattcagcattaaactggttttagatcaagacactagaactcatgtttagcagttattaaattacaattattaagaaaaaaacttcattacgtaaagtcctttactccaaaaagtttctcaaaatacataaacactaatataaaaacaactattaaaactttgcctgaatctcaggatttcagaaatatgaaagtactcatctctcacgtctcccatccacttaaaatgacaaaacagatcattatagctaaatcaaaggaaatgtttaaagagaaacaaacccaaagagtaactacaccaattcttgacccaattctctgtactctgtcttatgtaacattacactatgaataacaatcccatcatccacaacagctttttttttttttttgaaaaaaaagctctcattgtccaggctggagtgcaacggcacaatcttgacccactgcaacctccacctcccgggttcaagcgattctcctgcctcagcctcccgagtggctgggattacaggcatacaccaccacgcctggctaattttgtatttttagtagagacggggtttcaccatgttggtcaggctggtctccaactcctgacctcagggaatgagtgagtttctataggccataattactgcaacttacttctccaattttcccctccacagttaactcaacagctcaaaaacgatcagtaacaaacaacagtcaccatgatatggttaggagtgtggcagatttcttaaccagtaataataaataggaaaaaaattttctctattaatagatctcaagtttcgtgcacttgcaagaaactaattaaaaggcagccgcgcacgatctacaaaaacagccataagactgttacattttaagttacaggaaataaacctgctcctctaattcagcaagatacaactgacttccccttacataccctaaaaaaaagccttacacgagaaatttaaacatggaagcagaaacacaccaagaaaaagacatgtcaaaccccacctgtatatctgttttcaaccatttggagtcgaggcgagcctgggcagccaaacacaaagattcagagggcatcttttctccagcttcctcccaggtctcaggcctgcaagtaaacacatacgctgaagacctaatgctttttaatagtttacaaagacactcccgaaaggttcaatgcagaaaagaaaaaagagagagagaacagaaaggggggagagaagagctggtggaggggagagaaggggagagagggaaagagggaagagatggagagagagggaggtggggaagggaaagcctgcttccaaggtaggcagggtgtgccgagtttctgcaccacgctgacgagaccttgagaatggacggtcacaggaagccaagttacaatgtcatccccctgccctcaaatccaagaagtacacacacataacagggagcccatcgttttaacgacaaatgacagcagcatgaatctgccgctttaccccacagcagggcgcgtgcgtgaaacaaattactcaaaaggatcgcctgcagaaaaacccacagccaccaccacttaagagatggagagaggcccgaggctgccccgcgggtggtccgcgcaggccccggtgcggccgccgcgcccacgcccgcctcccgggctcggccgcccgccagccccgcgcccgtaccgcccccgccaccggccgcccaggtgccccaggccaggacctgacgcgcagggcccggccgcctcgccccgccggcgcgcggacgcagcctcccaagagccgctggctcagccggcgcccgcgatcccggcgcctctcgcggcccgaggggcgggccgacgcgggactgccgccccccgcgtacggccaatcgcaacgaggctgctccgtgggcgcagccaatggggaagaggagcccttcgccgctcctcccgactctcccgcttccagcaatcccgcttatcttcctacttggagcgccgtggctgcggccaaggccaacagcgggcgccggaaggctggatttccgccgcacgcacgcgctcccgcactcccacgggagactgcttggcccggagcgctcttgatcacgccgcggcgggaggtggcgctcacactaactatagctatccagggcgcgggtcgagtggcgagaccagctcccctgggtatgagaacgcatctttgtgcggtcggctggctggggcctgaagagcttcctcctgtgtgttcaactgaacgcagcaaaagtcttgggcagattccatggagcagctgtggaagcactgtgcagggaatcgaagaaggaaacacctccagcgaccacaaaacaaaattgaagaactataaaacaatataggccgggcgtggtggctcacgtatgtaattttcagcgctttgggaggccgaagcgggaggatccctcgaagccaggagttggaggatcccatgttgccagactgggcaacatagcaagaccccatctctaaaaaataaaaataaaaaaatttaacaattagccaggtgtggtggcacacacctgtgatcccagctgctcgggaggctgagacaggagaatcgcctgagcctgggagatcaatgctacagtgagcttagatcgtgccactgcactccagcctgggcgacagagtgagatcctgcctctaagaaagaaaaataacggccgggcgtggtggctcaggcctgtaatcccagcactttgggaggccagagcaggtggatcatttgaggtcaggagttcaaaaccagcctggccaacatgatgagaccccttctctactgaaaatacaaagattagccaggtgtggtggcacgtgactgtaatcccagctactcgggaggccgaggcaggagaatcgcttgaacccgggaggcggaggttgcagtgagccgacattgcaccactgcactccagcctgggggacagaggctgcaccactgcagccttgacttaccgggttcaggtggttctccacctcagccttgccactagctgggactgcaggcacatggaaccacacctggctaatttttgtagtttttgtagacgggattttgccatgttgcccaggctggtctcgaactcctgggctcaagtgatccgcccgcctcagtctcccaaagtgctaggattacaggtgtgagtcactgcactcggctaatagtaatgaactttgaacagaaggaaagttgttattattttcttggttatgttctatctatattttctaatttttctaaacatgtaaagataaaattctaaaaactcagacctcagaacaaaaaaattagagtataaatatttattttagttaacttgtacaaatttggtttctggaaaaagaatggaatagattttctgagaaaaaaaatccaccactttggccgggcgcagtggtttacgcgtgtaatgcctgcactttgggaggctgaggcggtggatcacctgaggtgaggagttcaagaccagcctgaccgacatgaagaaacccctgtctctactaaaaatacaaaaattagtcaggcctggtggcacgcacctgtaatcccagctactcaggaggctgaggctggagaatcgcttgaacccaggaggcagaggttgcagtgagctgagatcgcaccatagcgctccagcctgggtgacaaaaggaaaactctgtctcaaaaagaaagaaagaaaagcagactggctgaaaggattgaagaacaaaatatgatccaccaatgtgctatctacaagataaacattttaaatacagaaacagattgaaagtaaagggatacaaagatacaattaaaatagtaaccaaaaaagagctgaaggggctgtactaatatcaaatgtaatacactttaaattaaagcagggctgggcatggtagctcaggcctgcaatcccagcactttgggaggtggaggcagagagacacgtgagcccagaagttcgagatcagcctgagcaacatggcataatcccatctctacaaaaaatacaaaaattaggcgggcatggtggtacccacctgtggtcccagctatttgggaggctgaggtgggaggatcatgtgagctggggaagttgaggccgcagtgagctaagatcgggcccctgcactccaccctgggcaacagagcgagaccctgtctgaaaataaaaaaaaataaaaaacggggttgagagacaaaaaaggacatccttttttttattattgtattttgaaatggagtttcgctcgttgcccaggctggagtgcaatcgtgtgatcttggctcactgcaacctccgcctcccgggttcaagtgattgtcgtgcctcaggctcccgagtagctggcattacatgtgcctgccatcacgcccagctaatttttgtattttgatacagacggggtttcaccatgttggccagggtggtctccaactactgacctcaggtgatccacctgccttggcctcccaaaatgctgggactacagacatgagccaccgcgccagccgaaaccttcattttaaaaaaggctgggtcaggcatcatgcctcatgcctgtaatcccagcactttgagagggcaacgcaggcggatcacctgacgtcaggagttcgagaccagactgaccaacatggtgaaaccccgtctctaccaaaaatataaaaattagccgggtgtggtggcacacacctgtaatcccagctactcaggaggctgaggcaggagaattgcttgaatctgggaggtggaggatgcagtgagccgagattgtgctaccacactgcagccagggtgacagagtgagacgccatctcaaaaaataaataaaggctgggtgccagatgtggtgcataggcctagtttgttgactcctgtacttaacatataaaactctaaagaacagtgggaaggagcttccctctagaggcacaggagcggccaagttggtccctgagcagtgactttataataacatgttacactgtgttttttgtttttgttttgttttttgtttgtttgagacggagtttcgctcttgttgcccaggctggagtacaatggcgtgatctcagctcaaaacaacctctacctcccagattcaagcgattctcctgcctcagcctccaaagtaggtgggatttcagtcatgcaacaccatgcccggctaattttgtacttttagtagggatggggtttctccatgttggtcaggctggtctcgaactcctgacctcaagggatctgcccgcctcggcctcccaaagtgctgggattacaggcgtgagccaccacacccagcctttattttttttctttttttttagacacagtctgactccgttgcccaggctggagtgcagtagcacgatcttggttcactgtaacttctgcctcccaggttcaagcgattctcctgcctcagcctcccaagtagctgggattacaggcatgcaccaccacatctgactaatttttgtatttttagtagagatggggtttcaccatgttggccaggctggtctcaaactcctcacctcaagtaatccgtccgcctcggcctcccaaagtgctgggattacaaggcgtgacccaccgggcctggccctgtgtgttgttttatgtatgtttctatatgtgttatatttcacaataaactaaatattaaaacaaagaataactgatagctatgcacaaaggtatttaaatttcaccctcacaaataattttttttttttgagacaggatctcactctgttacccaggctggagtgcagtggcaccaccttggttcactgcagacttgacctcccaggcccaagcgatccttctacctcagcctcctgagtagctgggactacaggcacactccaccacacccacctaatttttgtatttttggtaaagatggggtttcaccatgttggccaggctggtctcgaacttctgggatcaaggaatcctccaaccttggctttccaaagtgctggtattacaggcgtgagccactgtacccggccaagaatagtttcttctccttacctaggtagagacctctgcagaaatgctgggagatctttggagaggggagattttttaaataaaaaatttaatacttggaggggcgtggtggcttacccctgtaatcccagcactttgggaggccaaggcggacagatcaggaagtcaggagattgagaccaccctggctaacacggtgaaaccccatctctactaaaaaaaatacaaaaaattagctgggcatcgtggcgggcgcctgtagtcccagctactcgggaggctgagtcaggagactggcgtgaacctgggaggcggagcttgcagtgagccgacatcgggccactgcactccagcctgggcgacacagcaagacttcgtctcaaaaaaaaaaaaaaaaaattaatgctttgggatgccaaggcaggtggatcacgaggtcaggagttcaagaactgcctggccaagatggtgaaaccccgtaaaaatacaaaaatttgccgggcttggtggcaggtgcctgtaatcccagctattcaggaggctgaggcaggagaattgcttgaacctgggtggcagaggttgcagggagccaagatagcaccactgcactccagcctgggcaataagagtcagactctgtctaaaaaaaaaaaaaaaaaaactgatctagttcaaaacctcactttgaatccacccacattgctctaaaatactttcatctttcctgtggctaaaaccttaaagccttgccagtaactcccattgcacttaaggaaatccaatctcccttgttgtggcccctgaacaggctgctgctggcccaccacggtgcctctagtttgtgtaaaatgcatatgttaatttataatatatgaggcttttttagctctaaaaggctattattcactagttgctgtgtgaatcagtatttctgggtgcagttagaaattattagagttgatgcccaagactcatctccatcagcacgggggaggcatctgctcgttttatggtcagtgactctgggcctcctgctgggctaagtcctgaggtgggtctgactcaggtcagagctgtgcaccccggccctcctccccaacgtgcatgagtgctctttaggatggagctgaacactggcttctcaaaaccacttggccccatcacaggccctgagaactgattgggtcactctggtgggctccccagccctagccaagaagggtttctctagggagcctggccccccacttatgagacctggagccccaaagatcctgaccaggggcctgcctcctccagggaggggccactcgcccccaccaagctcccttcacagagacccatccaacagagctgaggaaaaccatgcctcataaatgaataaatacataaataaggatgccggggacctgtggattttgtaattcctgaaagaaggcagagtggctggctcacagcaagcgcagtaggagatactgctccccggccaggctgttctctgtctctttggagggagccctagggtacaagaaaagccagaggagaccagctggcccagaaggtgcctctccaccccttccccagagtttctgggaaacaaagcccacccgagggacacatgccttcttgggagttgtaccaggcctccttcctcatccggccatgcagtggttttcagtgcccgaaacagatgaataaaataggccctttactggatgttcttcaggaacatgcacacttctttggatcttaccatcgttttatctctatttaaagttaaatgctgtgttatacagagtattggtaaagatgtagagctacaagaactgtcaagctggcagtagcataaaattgtataagcacattggaaacctgtttggcagcttctactaaagctatatctatgcctacgttcagaaattccatcctaagcatgtacacaagagaaacgagtgcatatgtccacaaaaagacttatataagaatgttcactgccatttttattcataagagccccaaatgaaaacaacctaaatgtccatcaacaggagagtgaataaatggtgatacagtcacatcatggaatactacacagccaaaaaagaaaaatgaagtggtaggaacactcaacgacatgggtgaatagagggagccaggtatgagagacagtgcacagtaccagcccacctagatgaagcgcaggaaggcagaactgacgatgattgaagtcagaagagtagtttcctttgtgggaaagtgtaggtcaggaaggagccttctggggtactacaaatctgccgtattttggctgggtgcaacagctcacaccagcacttcgggaggcataggcgagagggtcacttgagcccaggagttagagaccagcttgggcaacacagcgagatcccatctctacaaaaaaattaaaaattagcgtggcatgctggtgtgcacctgtagtctcagctactcaggaggctgaggcaggaggattgcttgagcttaagagtttgaggttgcagtgagctcccaaagtgctgggattacaggtgtgagacactataccagcctgatttttaaatactgaccaagccttgtgttactgggataggcatcacttggccacgatttactactctctttctttctttttttttttttttttgagacagaatctcactctgtcacccaggctggagtgcattggtgcaatctcagctctctgcaacctctgcctcctgggttcaagcaattctcctgcctcagcttcctgagtagctgggattagaggtgtgcaccaccacacctggctaattttgtttgtttgttgtttgtttttagtagagatggggtttcaccatgttggccagcctggtctccaactcctgacctcaagtgatccaccctccttggcatcccaatattcctatgattacaggcgtgagccactgcgcccggccctattctgtttctatattgctaaatttgacttgctaacacgtttttgaggatttttctgttgatgctcatcagggatgttggtttgcagttttctttctttgtattacactatctcgtctggctttctgtcaggggaaagctgaccttatacaaagtattggcatgtgttccctccttttccattttctctaagggattgtgtagaattagtgttatttcttctttaaatgtttttgaatccatctgaacctggagatttctttctaaaagattttacgccgggcacggtggctcgtgcctataatcccagcacgttgggaggccgaggcaggtggatcacctgaggtcaggagtttgagaccagcctggctaacatggtgaaaccccgtttctactaaaaatacaaaaaattagtcgagcttggtggcgtgcgcctgtaatcccagctactcaggaggctaaggcaggagaatcacttgaacctgggaggcagagattgcagagagctgagattgcaccaatgcactccagcctgggtgacagagtgagactccggctcaaaaaaaaaaaaaaatttttacaaattcaatttatttaacagatacagaactattcaggtaacctgtttgtttctaggaggattttcctggtttgtggcactcggacattgctttatttcatctaagttgtctgatttttaagtgtcaagttttccttagtgttctcttgctaaccgtctgaagtctgtggggcctgcagtgatgtcccttcattcattcctgatactgataatttgtatcttttctgtttttttctttgtcagttttcctagagtttttcaattttgttgatcttttcaaagaatgatctttaagtttcattaatttttcccttctttttttgctttcaatctcattagtttctgcttttatcttggcatttgttcctttggcttgttttgcgttcactttgctctttttctggtttcttaaggtggaaacttggattgctgatttagacctatcttttttgtaatatataatgatttgatgctataaattttcctctaagcagtactttaattaaccccacaaattttggtgcattttcatttatgttcaaaatattttctaatttcttttgagaattgttctttgacccatggatgatgatgatgatgatgattattattattatttttcttcaatacggagtttcactgttgttgcccaggctggagtgcaatgacatgatctcggctcactgcaacctctgtctcctgggttcaagcgattctcctgcctcagcctcctgattagctgggactacgggcacccgccaccatgcccggctaattgttttgtatttacagtagagatggggtttctccatgttggccaggctgatcttcaactcctggcctcaggtgatccccccaacttggcctcccacagtgttgggattacacgcgtgagccagtgcgcccggcctgacccatggattattaagtatgttgttttattttgaagtgtttgcagattgttttgttaatgatttctagtttaataccattgtgattggagaacaaactgcatatgatttcatttcttttaaatttgttaagatttatgtgtcaggttatgttctcagtgaacattctgtatgtgcttaaaaagtatatgtatggtctgtatatgtatggtctgtatatacatatatgtatacatatatgtgtaaaaagtatatgtatggtctgtatgtgcttaaaaagtatatgtatggtccagcactttgggaggccgaggcaggcagatcacaaggtcaggagatcgagaccatcctggctaacagggtgaaactcagtctctactaaaaatacaaaaaaaattacccgggcatgatggcgggcgcctgtagtcccagctacttgggaggctgaggcaggagactggcttgagcctgggaagcagagcttgcagtgaactgagatcatgcgactgcactccagcctgggcgacagagctagactccatctcaaaaaaaataaaatttaaaaaaagtatatgtaaagtgtatgtatggccgggcacggtggctcacgcctgtaatcccagcactttgggaggccaaggcaggtggatcacgaggtcaggaaatcaagaccatcctggctgacatggtgaaaccccatctctactaaaaataaaaattaaaaaaataataataattagccaggcgtggtggtgagcacctgtagtcccagctactcaggaggctgaggtaggagaatggcgtgaacccaggaggcagagcttgcagtgggctgagatcccgccactgcactctagcctgggcgacagagcgagactctgtctcaaaaaaaaaaaaaagtatatgtattttgctgttgttgggtgaagtgttctataaattagatccagtttattgaaggtgttctacagttctcctagatttttgccgattacttgttctctcactatgaaagatattgtgtgtgttatatgtgtctaacaattcattgtctagttagagttgctattataccacttcaagtggatggagagcctcactgccatccattaatgtgcattaatcattttgagagtgaaaagattttttaaaatgtttttacttttttaggtatggccaagtgagatggggctagtgaaatgggtgggagaattggaagctgatagtgtgtgagctagacacccatgaatgcttttccactgggcagttagagggatgataggtaataatataaggcagctccatcacacaagctggtgactcctgtgcgacagaccaagaactgcatttggagattcatttccgattgttgcgtttcctcttagagcattgcttggtcatcgtgttctgagtggtccattggcctccatgtcccttttggggtggatatttgctcagtgacttttgagcagctggatctcctgcttcggcaggtgagtgaggggatggatggctccacggactggcccccgccccaggagaaagagtgcgtggccgtggcaacgctgaatcttccccgacttcaggtattcgtgatttcccttcctcttgctccttttataagtgtcttagcgatttgtaagaaggtttatgtattttgaaggacataggttttagcctgctgggggaagtattttaaagtaagattgtaatgcactaataatggacgcaaggcttaaaaaacttgatctgtttattttatgtttgtcctggaagtcagcctcggcatgcaggaagagtgtatatggattgtgttatttttgctataatcattagtttgttggtattcttactgttttactgttgttgcgtgtggagaaatgactgggtgagatcacaggtgatggagagagacagcgctcagctgagagaccagtgctggcctgtctctcctctgtcctgtgaaaaccctgctccaggagggtccagtcttttggtttccctgggccacactggaagaagaattgtcttgggctacacataaaatacacttatgatagctgatgagcttaaaaaaagaatcccaaaaatatctcatgatgttttaagaaattttactttgggccacattcaaagctgccctgggccacatgctgccctcgggccgtgggttgaacaagcttgatctactcagtaagcttggctcccaaagcaataccttcctttcctcaccatgaaggctgtggttagggtcaaaataaaagctacaaaagccttcctccctagcaaaactaaagctgaagtgtttgatcatcatcttttgtctttgtaataaaaccctctaacttaatgacaagaaccacggttttctcgacatagtaatttttcccttttattacagtggtttcttgtaacaacccgtcatgtccctcttccagcccctcccctttttgccctgcttctagaatgtacagaactgagtgtagtgtttagttgcagtaatgaactgagcagaggtctggagcatgcttctcctctagtcctctgtagcactcatttatcaccatatctgtggcatcctggcgtttgcgtggttgcgccccaggtgtttgctgcccctcctggtttgcggtgatgtgtctgttctggtcagtgctgtggggcgtggccttgtgtatgtcttaggctgtcgaggtgtcccagcgtatggttttgcatttgcctctccagggtcctgagggttctgtaggtttcacagactccaggtgagtttcggtggtcatttcctgacctgtgatatctatacctagatgagtggtgtgcttttgatttcacttctactcacagggcaaggccgggtctctgatttctcatggggcctcttgctacccaaagcctgggacgggcagtgtgttgccccctggctgcggttggctggcaggcaggtgatcctgagtggctcccagccttctgcaggaagctcgagttcagtgggtccttgtgtgcattcccgtgtgggaggttgtgctgaagcctggcggcttggctctgctttcagagcccggaacctcttgactcctgctgtgtgtgcccacgtgaattttggttttgcacttgaggagtttccctgtgtactctcagctccacagtctaatttttagcagctcttttttttttttagacagggtgtcactttgtcacccaggctggaatgcagtggtacggtcttggcctgccaggttcaagtgattctcctgcctcagcctcccaagtagctgggactacaggtgtgtaccatcacacccggctgatttttttatagagatggggtttcatcatgttggccaggctgatcttgaactcctgatctcaagtgagctttcccgtcggcctcccaaagtgctgggattacaggcatgagccaccgcctatggcagcttttgtggttacattgtagccattatttctgtgtttggtgcagattgttggggcggggtggaggttgctgttgctagttgtttagctcttctgctcatcttgagcttttccatatatgtgttcatagtggggttaaaaaaaattcctctagaaaatacttcaactattgtgggtaagagtttttttagtccagtttttaaaaatacgtaaactgagaagttattttgtctatttagatgatacttcaaattgacttttattcagtgtttaataagactttgaaattcactcatttttaggggttctaagtgaaaattgtttttctcctttcagttgcatgctgccattagtcaccaggttgacctggaattccttggtttaggtctgggcagcgtcttcctgaacagcctgaagcagaaggtggtgaccctggcaagcagcgcagacgtgctgagcaccgtgcagtcggcctcccaggccatgctgcagagcggctggtccatgctgttgcccaccgctgagaagcaggcccgggcactctgctctcctgtcctgcggaggtgggctcggggaaggaacaggagagggcatgggtcagggtgctgggaggggatggcgtttcactcaaattggcacacactttctatttcagtttcaggcaatgaagtgagcataagtccaggtcatcgattggtgattgatcttctggtgggcagcttgatggctgatggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttatgtgctaattttaaaaattattgagatgatttgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcgcagcaatataactgtatagtatgcactctttcctgctttgccttggagaatgattttcagattcactcactgttgtgtgtattgcgacttcgtttttattattgggaagttttccattttataggtgtagtactgtttgttagttcattctcctattgaaggacatgtaattgtttttggtttttgttttcttttttttttttttttttttgagacagggtcttgctctgtcacccaggctgtatacagtgacctgatgttggctcactgcagccttgtactcctaggttcaaatgatcctcccacctcagcctcctgtgttgcagggaccacatacatgtcaccatgcccggctagttttttgatttttttgtagagacaaggtttcactgtgttgcaaggctggtcttcaactcctgggctccagtgatccccccaccttggcctcccaaagtgttgggattacaagcgtgagccaccgcgcccaggctttctggtttttggccgtgtagagctgccacaattgtgctgtgaacaagtactttagtgaacatatgttctccctttggataaacacttggagtggaatttgttaggtcctggggttagtgtgtgttcatagtttcccaaagtggctttgccatttgcatttgaaccaggacttttgtgtgtgagaattctagctccttcttgtccttacagagcagctggatgctgtgtgtgtggagccgatcacattgggttttgtgtgagccattagcagggttaaggattttagggacttcacagaaggaggctggagagcatcagcagaggcagcctagaccttggatctgtaaaaagaagacactgtttgaaactgcacagatgagttggggtttccaacagggcaggtgggggcctgtgggtggatgggtgtggcagccacagaggctgggatagcttggcactggggtcagggctcagccagcctgtgtgccttcacacctggtaatgagatcacttgtaaacaatttctgtttgtcaattacaggatacaaaaaaagaagcacggaaggaaaaagaaatttatgaacaggaagcaaatgcctcaacatttcatagaaggaggactccattggataaagaccttattaatacggggatctgtgagtcttctggcaaacagtgtttgcctctggttcagctcatacaacagcttcttaggtaaatcatattagctgtattgtattgtgttttatttatttacttttttgttttttgagacagagtttcgctcttgttgcccaggcccgagtgcagtggtgcgatcttgactcactgcaacctccgcctcccaggttcaagtaattcctctgcctcagcctctcgagcagctgggattacaggcatgcgccaccatgccccactaattttgtaattttattagagacagggtttcttcatgttggtcaggccggtcttgaactcccaacctcaggtggtccatccactttggcctatcaaaatgttgggattacaggcattagccaccacgcctggcctatttatttacttattaatggtgttttttttttttttttttttttgagatggagtcttgctctatcgtccaggctggagtgcagtgtcacgatcttggctcactgcaacccccgcctcctgggttcaagctattctcctgcctcagcctcccgagtagctgggactacaggcgtctgcaaccacacctggctgatttttgtatttttagtagagatggggttttaccatattggtcaggctggtctcaaattcctgacgtcaggtgacccacctgccttggcctctcaaaatgttgggattacaggtgttagccactgtgcctggcctgtattgtattttaataggtgattattggttttcatattaagatagtgaaatctagcgcaaggatctcaaaaatttgtttgatgattgaaggaatattctgaaaattacctagtatagatgttaggataaagagcagacccttttcaatataggtgagaggagaagttggagggtgtgatgatactcaaaagtttttcactgaagagaaattggggcgtgcagtaaacatgtaaaaagattcttactaataagcaggtggatgcaaatgaaaatcatcatggaaggttatttttaaaactgattgtatcattgcctcactttatatattacagagttatacatactactttgtaagataacttttcttttcaaaactgaagtcaatgtgatagaatggtgagcattattttggaaggccagactaggaggaggtgggaggaagaagtcagactcagcctgtgaacagacgctaaccttggcagaagccaaaacagtcagacagtgttgtgtaaaaatgatcattcaagaagagcgaaacagcaaggtgatttgtgaaagagatttattagaaaatgaaacacatttatacctctgttcaataaaaatctgcttttcgtcaactgatgctcctggtttttgtttctacacatagagaaagcagagccctggcagctggggtcaggcagccgagtacagaccagggagccctgggcagtggctgcagctctcagctggcctgttcatggggccatggtgggtctgtggcgtggggtgggcctgtggcgtggggtgggcctgcggcgtggggtgggcccgcggcatggggtgggcctgctgtccacagccagaaaaactaacttagtgcacacacagtgaaattttgaaacaggaagttttagagctagtttctgtcatagattttagtaaatgctactttgcaaaacctttttctgatgtttgttttgtttttctaatctgataatgcatatttcacacattctggtctttaacaaatggaaataaagagaactaaacaatatagtttgtgtcgatggaaagagcttgggatttgttctcagaaaatttcagttacaacagtttgttcatataggtggacttccaacacagtaactataggagtaagaataaaagctgtgtttactttcacagagttaattaagaatacatgagaaaatggatgttaaaaaccttgtaattaaaatgtacagttacatgcaaagttttaaagtgagcattttccagaggtgcttttctaagttcttgaatgcctctcccttttctgaagtggctgcttcgtggggctgttggtctttggcagggggtgagtgcagggttcctgttgtgggtcctttgttctcacgagggcagtgcccgttttccccgtctcctgcttgcccagactgttcccgtgcgcagagagactggcctgtttgacctgcagctgtgctgtttgagctgcagctgtgtagcctgcgctggcccatctggctacactcaacaccgtttgctgatcagcacttgaagtctgtccgtcatagctgagacactgaatattttatctgtttaatttttattcattaaaatgcaggtttgaaaatttgattctgttattagaaagcacttaagtatgtttagaatcacttggccttgggagtctactttgtcaactgtgtattttatgagtctaaatggagatcagatgttttcaatgcaaatttcacggtccaaattgaaatgtgttacatatgtaagctactcagatggtttttgaggacttaatatgaaataacctatgtaaaatatctcaataatttttcttagattgatttcatgttgaaatggtcatatttttgatctgttggaataactatgatacattattaaaattatttttattttttaagatggaatcttactctgttgaccagaccggagtgcagtggtgcaatcttggctcactgcaacctccgcctcttgtgttcaagtgattctcctgcctcagcctcctgagcagctgggactacaggactacagactcccgagcagctgggactaccaccacgcctggctgatttttgtatttttgtagagacagagtttcaccatgttggccaggctggtctcgaactcctgacctcaagtaatctgcccgctttggcttcccagagtgctgggattacaggcatgagccactgcaaccagccattattacaattaattttatgtgttgttgtttttcttgttggtgtgttttttttttttttttttacttttgttaatgtgactaagaacaattttttttccccacccggagatggatcctcactctgttgcctggactggagtgcagtagcacgatctcagctcactgcagcctctgcctcctgggttcaaatgattctcctgcctcaacctcctgagtggctgggactaacagaagcatgccaccatacctggctaatttttgtatttttagtagagatggggtttcaccatgttggccaggatggtcttgaactcccaacctcaggtaatctgcccacctcagcctcccaaagtgttgggattacaggcgtgagccaccgcacctggccatgtttattaatacgactaagaacattttgaattgcacctgtggctccattggtgtcctgggcaggtggctctgtgctgtctacacaggttgtctcctgtgtcttcgtcttcgctgcgtgtgactttttggttcctgtggcacgtggggtcctgtatgggacattggttctacagcagatttatagtaaggatgtacctactaaaaaatacaaaataaaaagaatagacacaaacatagaaataagtatcacctcacaaaacttttggaaagtagaaaaagaaaaatgcattcgcagctttccagtagccgatatccaggctgtcttcataagcatggatcatgtttccctctcctgcatgggtagacactgttttctcaccttaagtgtttgtgagtgaaggattcttgatgtgttgacttggcagatgcagttgttgaacagtagtttatctaaagatcgtaagagacttttggagacatttcatgtccttttttcccttggaaaacgtgggttggagaaatcgctgcttgccaaaaataagccgtgaaacgtatttcagagtagatcgttatttacatgctggcgaggagccacagaataccatttacatttgaaaatagagtgctgcgaagtttttataagtagtgaatcccatcagaattacacattttgattatggctctaaattttatattaaataaactaaaaatttcattgtattgtattaccgtctcttgctccttcaggtgtagcatacatgttagattctagacctgtttcttgtgttacagtggtgttatccaggcagggtatcatgtagtgaaggtgatgtctagtggtggtggtgagcccagtgaaggcgcatccttgccgtgtgtgatgagggcctgtgggttgctatgggattccccaaccctggctcctctgtctcctgcttctgtccttactcacactgctggtagttttctggtgtgagccacgggggcaagtgggattgacaagcctgctgtcacattaggaacctgagttaaagtggagctgaaagcatgtcctcactcttgatgttgtgcagagagccacctgtgctcctggctcaacggggcgtgtgtggtgggtctggaaccaggccctggtttggctctcctcccctccatgttcccctgtcctgtctgatttgcttcacactgacataagagttactttccctcggcctcccaaagtgctggtattacaggcattagccaccgcgcccagctagcatcctttcaagtactggggtacacccaagctcccagcttctagctaggagtcattttgtccctctttatcccaaaggacttgccaccatctttggttcccaaagcccaggagggtccaggctcttcagcctccaaccactttgcatttcttgtctgcttttcgttcatggagataattaacttatttttcagcctgggcatgtcttttttatttactttattttttatttttattttttgagatggagtctcactctgtcgcccaggctggaatgcagtggcgggatctcatttcactgcagcctctgcctcccgggttcaagtgattctcctgcctcagcctcctgagtagctgggactacaggtgtgcaccactatgcccagctaatttttacatttttagtagagacagggtgtcgccatattggccaggctggtctcgaactcctggcttcaagtgatcctcctgcctcagcctcccagagtgctgggattacaggcacgaccaccgcacccagcctttatttactttgtatatctcatctattactgctgcagtttgcagaagagaggatgccctcaaacctaacttctccaaaccatcccaaatgggaagtctgctccacgtcaacagcattgttgcttttaaagactatacgtcaacatggcagattatagcaaaaggatgtcgagggagcaataggaaagcaagcctgagagtcctggagagaaggtggcagagctgccttttgaaggtggttccttcctcagaccctgcccttcctgccttgttcctccagttgccagatttgctgttggagctcctccacgggcgaagaggtgaggctggactgagagggagatggagaagctgccagagattcttttggatctagaattgagacagcagttccagccaggtccagaggtgggggctgtcacccagcccccaggggaatggtactgattgcagaatgtggcgagaactccctggctgggagagggaggtgcttgctcccttgaatcacctgagcccaggctggaaggcccaagggggaggacgaggccagctcactccagctccatcccctccctttaaccctaagctagttaaccctcccagactccagtcctttttcctaagtgccctccctgcaaagtctgcaccgagcagcgctccctcgcaccagctcaccctgcactgtcttgtctttcagcaaccccatgggtttgaacttgagacgattcatgttcctaaaagcctctttgggctgagggaaggcatgggtggctctgccagttttggagtgggggccgactcttctcagagccgctgcaagggccagggccaccctcccaggcgggtgtctccgggctgggcagcagctttgtaggcagcctgggtcatccccactggtctgggaagctgggggtgcaccggctcctgctcctgatagggccaaggcaccttccttacctaagagctgactttcttgaagagtgggcacagaggagccggcaacctgggctgtgtaggcacccaggagaaaatctgcagctcagtatcagaagtctccaccagcacggctgttgcagagatggggaaactgggctgagagggaagggggcttgcccaaatcaccagccctggaatgtttggagctttgggggtggatctcccaggaaacgtgtttttatggcaccaccgcctctggtcacccaccccgaggtgtggcgggcctggacagccagcttgactgagggccaggctggtgaagtcaaaactaccactcaggaagaagacctagcccttctccagacagagttcaaatgtgaggactgccttctttgggcctcaaattccccacgtgaattccaaggacccctctagctcctacactctgggccaaggtttcctctgagccgcagtcagcctagaggacctaggatacatcttccttggacagagacccaccataggggcagcaggaggtaggggtgggggtaggcaagattcctgtggggaggtggagctgtcatcagagatggtgtctgcaggcagtgggtgtatcgtggctctgctactacttgctgggtggccccatgacgtttctttccccactctgacctcagtttccctatctgttctgtggagataagatgcctgcctacatatttgtggactgggatgtgtgtgggccagttgcagtgtttcttggtgtggtcctggggcaggctgcaccaccccatagagatttctgggccccaccctaggctcacaggaccagaatctctgggaatgaagcctgggaatttgcatttccacaggcatctggctgattctgacatgactgaaaagcactaatagtatatagcaagttctttataaaaggtaaattcatagctgccttttactaaacataaatctcaccttcccttcctcagttaaggacacacaccgcagttgaaaatcactgtgcctttccagatgcagaatctgacctttccgataagattctgttaactgctgctttctgcagtttgtattccaaaacaaggggaatatgtttccattttttcaatacaaatgtttaagtcggatatgctttctcaaactggacacgcactcacacagcttagggtttcagctatggcttcctctcaaattattagcctctttctgccagggagcagtttttcccagacaagaccctggacagaggttggtggggccctcctcatcagaatcactagattatgactgacccctagaggtggcttttctgcttaagtgtcagcccatgggctgggttgtgacccccaaagctgcggcagaagcttccacccatcctgggccccccctgccatctatggggaaaggcctgtcccttgtcttctgggcccagccggcctcacaggcattcagcagattggaaagtcgaagcatgtgctgtgcttggctgggctctcctgcgcccctttttggggtgaggtggagtgcatccagcccccagcatccctgccgtttattcccacccctcatccccacccccatacacactcacaagtacaaacacaagcacagtcactggcacacaccactctggacagcaccatttccagcctcagcggggcagtttccttacagggaagttaatgaggcactaacgaaggctcaggggacagggggaacctctatcgagaagaggctcctagacctggttctgcctctgaattgctgggggtccttgagaaagttgctatccctctctggtctcagtttcctcaggtgagaaatggggggccggccaaatggtctaaggttctgggaacctctaaatcagagcccgtagctggtggtcaagatgagggagaggccctcagggtcagccgaatgcctgagaggccggacaggcccaaaggtgagcaacgtgagcacatcaggtgggctcagagctggcgcatgagccccacagcctgcagagcagccctgtactcgggagcccgctcgcaccaacccagtgggacttcagagatgtggggtccagcctttcctactattgctgggctgagggctgggagctgcagattctgaccccacagctgccttagacatgccagatggtctggggcaagacacacccctctctatgaaatgagcagccagtccaaataggtacgttagagaagggctgtgggatggacccagctgtagcctggggctacagactggcttccggggtactcaagcagctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggcggctgctccccacagccaggagtccggcccagcacccacctgagtccgcctcagtcctgctcaattgggttatccgtgctcttggccctctggtcccacccacagagggaggtctttggggcgaccaggtgagctggcccttgtgggaggatgtaactgactcctgagcctggcgagccaggcagcccctcgccaacgtccccacccctacctctccagcccccccgcattccctgatcctcccatccgctcccctgacccagcagttgcctctgctcactctcttttcctgctcccaggctcgcctggtcatgtgtccttcactctcctctgagtctccctctttccaagccgcctccactctacttgacacactctcccttaagacaccagagtacacaagcgcaagtctctgcacctcacctttactcccagacatgggagggagatgacatgaagacccaaacgccacttagcaggagatctggggtatgcagaggggcagaacggaggctgtggaagctccaggggctccctgcaggaggccacatgtaagctggctattgaatgtggctctgagctgagacctctccttgaagctccagaccaggagccagctgctagctggacccctccatttggtgcctcagagaaactttgcactctctaggtctaactttgaacccagaaaattcccccatgtcggccctgtctcttcatagggaaagcaccacctcagacccagttctgcaccaaacccacatttgagtcacgaggctcctgccctgcactgtgagcactctggataagccagtgctgagggggaaagagctctgaatgccaagccaaaacatgagcttcaactccacctccagctctgagagctgtgggtagggaagggccctcgtccagtttgctgtagaaagatcagtctgccactgtatggcacatggatggcaggggcagagtgcaggtggagagaacagaaggtgggcagggcgggggaggcagggacatggctgtagccgtggagatgggaggacagacaggacttggtggccacttgggtgaaccaagggaggagtcaggaagagacacccagttttgtatcagatgtgtagagcgtgggatgctgttcattgacggagggaggaggaggaggaagaggtatggcatggggaggaggtagctgagctctgtcgtgaatgtcatttgaagtccccagggaaagccaggccggccagcaccttcactgcttcagccagctctcagggtgtctgtgctccctggccctctcagctcctgcttcatagctgtcatctgcagtgggagacagctgcacaagggcccagcatgtctgtgtgtttacccaggggactgccgcatggcccatgccgagcagaaactgatggacgaccttctgaacaaaacctgttacaacaacctgatccgcccagccaccagctcctcacagctcatctccatccagacggcgctctccctggcccagtgcatcagcgtggtaggtgcagagggtacctgtggctcaggctcaggtgaagaggcagctcatgcccaagccctaagcagtcaatgtccagaggaatgaaatgactagagttgacttagactcaccggtacacggtggggaggctggaggagggtccatgaggtttataggtgtccagtatttaatgaggccatggttttgttaacaaagaagaaatgagggtgggagcgagatcaccactggctaggagactcagctgagtctccagcacgaccatgagcttctcatcctgatcctcccagccccaccctacttttctcccccagcttgctcaacaggtgaccttacaggctccctactctttgcagggaataagaaccagactgggggaactgacgggtacagaggcccaggtgtaggcgcaggaccacaggcagtgaagcgtctactgacccaggcgggtgagggtctggagagtgggcatggctgctgcaggcatggaaagcaggcacagatggcggcactcccagggcccattgtcagggtctccacatgtggacgtgtgcagaggtgggggtgctgagggaggaggggcagggaatttctcatcttctctctactgcctctgagttggagatgtcagagggagccatggcccactgtaaagtaacacaatgtccccacccacaggattagaacccctcccctggaagcagctctgaggggaacagtcacatgtagagagtgcagggcactgtgtccagccgggggaaggaggtcaccaagggggttgacccccctctggccaggtggctgccttctgacacaccagcctctgtctctagcacggtggcccccacacacccagcctgtgaaacctacagccctcaagaagactttggccaaattaatgagcggctccctctcccaggaggaagcacaggtgaaggatgtggagggcagtagagttgtgtgtgctccgccccctttctccgcagtcggatggaaagaagggggctttcagccaggctcgcccaggctggggtctgagtgtcactgtccagctattggcttcttgcttaatgggtgagcccagctgctcccgtgcagctgccgccctagtgagggtgaaccggcaggcgagttacatttctgaaagcctgggaatacagtaaatattaggctgtgggctgctgggccaggaagagttgtttatttttcagggtttgtttatctattgacttgatgagggagggttataggtacaaccagtttaaagatggaaattttgagagagcaggcagggatttagtgctgggtaagcctggtcaaagtggctcttttggggcggccagaatccagtaccaatgtcctcagcatgttcatcagctggctgggggagtgcgggacagcatgaaagcacaggagaactttctggatgatagaaatactctgtatcttcaaaggaggtgggttccatagtaatgttaaatgagttaaaactcatcaaaatgtaaaccagacctgtgcatttcactaatagaaattatacctccaattaaaaacatgttttaaaagacagatgggccggatgcagtggctcatacttgtaatcccagcactttgggaggctgaggcaggtagatcacctgagtcaggagctcgagaccagcctggaaaacatggtgaaatcctgcctctattaaaggtataaaaaaaaattagccaggcatggtggcacacgctactcgggaagctgaggcaggagaattgcttgaacccaggaggcagaggttacagtgagcagagatcgtgccattgcactagagcctgggcaacagcgcaagactccatctcaacaacaacaaaaaaaggacagatgaaggttttcaactttcaataaaggcagaggagcttgttacagattcgcctccccacaagagcagttagaaaaactggataaaaatgtgccccgcccccaatcaaaaacaattgttggaaggtaattggagacctcagtcaggacttgagtgaccaggcctaggaggtgatcctgacagtctgtagtgctttcccacatttggtgattggtcaacagtagagggctaagaggctaagaaactgagtatgaagtggtagttaagaggctggagagcctagctgaatgtttggcactctcacagggctgaaatgacctaatgagaatttgggtcccaggaaggagatgggaccttggtggggaccctggaagggccacccctgggagtccagatgaataaaacatagaccagccatcagaaaacctaaaacctgctttgaaccagcttagtcccaaagtagatgaaggcgatctgcccttactccaattgtgtgccataaactcaaagtcaatactctctggaggcagataaaagtttactatgaatgtcaaaagacaacacaagactaaatgagaaagaccaagaagaaaactaatagaaacatacatgtaaggaagaaacttttttttttgagacggagtttcgctctgtcacccaggcttgagtgcagtggcacgatctcagctcactgcaacctctgcctcccaggttcaagcgattctcctgcctcagcctcccaagtagctgggattacaggcatgcgccaccatgcccggctaatttttgtattggccaggctggtcttgaactcttgacctcaggtcatccatttacctcggcctcccaaattgctaggattacaggcgtgagctaccatgcctggccagtattttgccacaatttaaaataaataaaatttttttttcaggtttgtgctcagactatattctaaacagtcacatggcggcttactcttctccaggccttgctgccggcttttacatgtttattgtctttgccttcttgtcatgtgctcattagatggcagcttccaggtgctcctaaggggccaggaaagagagtgagaaggcacggaggttgccagatcatcccccttggggccccgccctcatcaactccctcaaccgggtctcctgcaactattggtgggccatctcggccaccgcttcgccctgagcttcctgctgctgcagctgggcagtgcctccttctcagaggccagctgctgataggcggccacgtactgctgcaggtgacccaggtaatggtctcgctgctgctgcagactcagcctcttggctcttcagctccacctgcaggataggcgtcagggtaggtagtggctggcttccagattctgggcccataaacagggtagtgagggcactgcggggctctgtcgcctacccaggcccctggccctggccccttcctccaggcctaaatgactgcctcccttgcctagaggcccatgcctccctccccagcctcaaatctcacacccttcttcccaccatttaaactgtaggccacagactggtggaaaagcagagggagccaaccaccatctgctaagttgtggtgaggtcgttctgtatgatctccagggtttgcacacacctccgcctgctccccccaagagctcggccttctgccccagcttccccagcctctcctccagctcctgcagcctcacctagtgttcctgcatcttctcctcctgctgccgcagcctcacttcctgctcccacatcttctcctcctgcctccgcatcttctcctcctgttcttgcatcttctcttcctgctcacacatcttctcctcctgctcccacatcttctcttcctgttcctgcatcatctcctcctgctctcgtatcttctcctcctgctcccgtatcttcttctcctgctcccttatcttctcctcctgcctccgcatcttctcctcctgttcttgcatcttctcttcctgctcccccatcttctcttcctgttcctgcatcatctcctcctgctctcgtatcttctcctcctgctcccgtatcttcttctcctgctcccttatcttctcctcctgcctccgcatcttctcctcctgttcttgcatcttctcttcctgctcccaaatcttctcctcctgctcccccatcttctcttcctgttcctgcatcatctcctcctgctctcgtatcttctcctcctgctcccatatcttctcctcctgctctcgtatcttctccttctgctcccgtatcttctcctcctgctcccttatcttctcctcctgcctccgcatcttctcctgttcttgcatcttctcttcctgctcccccatcttctcttcctgttcctgcatcatctcctcctgctctcgtatcttctcctcctgctcccgtatcttctcctcctgctcccgtatcttctcctcctgctcccttatcttctcctcctgcttccacatcttctcctcctgctcctgcctcttttcctcctgctcccgtatcttctcctcctgcctccacaccttctcctcctgctcccgtatcttctcctcctgcctccacatcttatcctcctgctcctgcctcttctcctcctcccatatcttctcctgctcatgcatcttctcttcctccctccacatctcctcctgctcccgtatcttctcctcctgctcccgtatcttctcctcctgcctccacatcttctcctcctgctcccgtttcttctcctgctcccgtatcttctcctcctgcctccacaccttctcctcctgctcccgtatcttctcctcctggtcgtgcatcttctcctcctgcctccacaccttctcctcctgcttccgtatcttctcctcctgctcgtgcatcttctccttttgcctccatatctcctcctgctcccttatcttctcctcctgcctccacatctcctcctgctcctgcctcttctcctcctcccgtatcttctcctgctcgtgaatcttctcctcctgcctccacatctttttctcctgctcccgtatcttctcttcctgctcccgtatcttctcctcctgcctccacatcttcgcctcctgctcctgcctcttctcctgctcgcgtatcttctcctcctcctgcctcttctcttcctgctcccgtatcttctcctgctcgtgcatcttctcttccagctcccgtatcttctcctccttctcccacatcatctcctcctgcctccgcatcttctcctccttctcccacatcatctcctcctgcctccgcatcttctcctcctgctcccgtatcttctcctcctgctcccgtatcttctcctcctgctcctgtatcttctcctcccactcctgtatcttctcctcctgcctccacatcttctcctcctgttgctggttcaggcggttccacaactcgttctcttccacctgggcttggagctttgctgacacactctgcagctccttacccaggtggtcagcctccgcctgcagctgctgctggaatagtgaaagtgtttttttgaacctcagaaggaagcagaatcatgagctagccacataaatgtaatctataggctgggcgcggtggctcacgcctgtaatcccagcactttgggaggccgaggtgggcggatcacgaggtcaggagatcgagaccatcctggttaacacagtgaaaccccgtctctactaaaaatacaaaaaattagctgggtgtggtggtgggcacctgtagtcccagctacttgggaggctgaggcaggagaatggcgtgaagccggggttggagcttgcagtgagccgagattgcgccactgcactctggcctgggtgacagagtgagactacttctcaaataaataaataaataaataaataaataaataaatgtaatctataaaataatggttttcatccatgatcctttaaaaaaatatttttaagccctaactcttgagattctgattccccaggcagggccccaatttgtacatttttagcacactctagaggattctatggcgggaccagaacaaggacccaaattttccagctcttggctggagcctccccataccctgcatgatccctagaccatggtcccagctggatgggtctcccacaacccccggggctgcagctgctcacctgtggcagcaggagcttggccctctccagtttcctttttagctcctttacgttgagctggatctcagacttttcagattctacaagttgaagtttttcttgtagtttggcatttttctccttcagctcctcatcagttatgctatggccagaggcagtagagaaaggaatgaatgaagaacataaaagaccactttggtgattgaccccctaccctcgccccacaaccacagaaccgtggcgctggaagggaccccaggaattaaaagtcccaggtggcaggccagagagaagacatgagttgcctgaggctaccccatgagtcagtggcacagccagcactagagcttccgtgtgcacacatgaaaacatgtatgagcctctccgcacactcacctggaccccccacctcccagcacaccacccatgctaagggcccccagacctcccattccaccttcccccatcctacgtgttcctgtacagttccagactcagggcgtccctctcctttgttaactcctcaatgtactgcaaatagagaaaggttaagtcaggatagagcaggcacagcagtagctggacgaccaggaacaactgctacagtgactactccacagtaacacttcctcactctcaatcacacctgacgtgttctcaaggcatttccaagcccatggtctcatttgtttttctttctttctttctttctttttttttttggcagagtttcattcttgttgccctcactggagtgcaatggcacaatctcagctcaccacaacctacacctcctgggttcaagcaattctcctgcctcagcttcccgagtagttgggattacaggcatgtgccaccacaccgggctaattttgtatttttagtagagacggggtttcttcgtgttggtcagtctagtcttgaactcctgaccgcaggtgatccgcccacctcagcctcccaaagtgctggcattacaggcgtgagcgagagcacctggccctcatttgtttttcaaagaactcagtggatgtggaagggacagggaaagagattgaatttagagctggctaacaggggcccagagcgatcagataatattgttattgctattactgttagtactaccactgttcgaacctttcttgagtgcttcaccaggcactatgctaacaatcccatttaatcctcacaacctccataggagacggttaccattattacctctattgtgtagatgaaaaacatgtggtattaaaggttaagtgctgcctaagatcacttggagctgggatttcaacacccaggtatatctgattctctaagcccattctttcgctggaggtaggggcacagttaagaaggaggaaattaatcctttgttgaatttttgaaaggatgatacgttcgcatagtccaaaactcagaaagtccagaagggaaatatctccccccaacactgtgcctctatcctgagttttttaatgaatccttacaaacgtgttttatgtatgttaccataatacgtacacacacacacatatacacctgccccctctctccacacaaataataacatactcaagatactcttctgtacctttatggtacaagtaccctaaccgccacttaggacttggccaaggccacagccaagtatgggcagggcgggcacttggcctctgagatctatgtccagtgctcgctcctcacagtgctccccaactcacccacaacagccgactcagccccagtctgcctctaacaaccacacacaaaagcagcaagaaatggccatgctgccttctgggcaggacactccatcctacagaagggacctttaggctcactcctccatctgcgaagctgggctcccaagggacggggccgtgtttggactcaccctatccgccttcttcttctgtgtagtgacagcagagagagcctgctctaactctcctgcaaacttccatgaatcatgcaggcggctgatcagatccctggcctctcctggaatgagagacattcagatgtggcccaaaggactccccctaaaggcctgtcaaagtgccaggttgaaggatgatggggtgccagattcccaccttccaactgcttgacagcatgctggctgtagtagagtgccatctgaagctcagttttctgacatgtaaggattcgtatggtatgaacctgggcctttgggagaaaagacaagcaaatgctgaaagagaagcaaagaaacattctccagagggcaggagggaacttcacaccctccactcacctctagctccctccttagggcttcctgatgttggtggcttgccttctgttcctatagaaagaggaaaacagagctcttactaggggtaggcagagatccacagcaagagacatgcccccagaatggcaccactgtcccagaacaggcccacccatgggaccagtttatcagggaccctgtggggatggggtggaatcttgggggtgagccttcttccccaggctgggagtgggtgaaatgagcctggggcctctacatctgagtgcccccaaacccagcggtcatgtcgtgagcaaagaaatcacactacttcttccagctgagctcggttctattgtttctgtggggagagtcaaaggaaggtgactgagggtggcccccttgactctattccccaggccaggaagcgataggcaggggccaggaatggatttaaaaggcacagttctcagacccaatgggaacatgaactggtcaactctcctcaactcccaaagaagaaggatttgggtctttttggtttttgcccacagccacagaactcaaagtctgaaactagattctcttgaaaagacagtaacagaaaccttcagaggtggagtgcgagaaaagcccacccttccgccagcttgtgatttagaaaggtgcattcactcagcaaacgttgagcacatacgggccagggacggttcttcacagcgggaatagaggtcagaaaaggcagacaggagcccttggccccgaggtttccattctagtgggcctttaactctcgggctctcagagctaacagaaacctctgatactctctaactctacctcaggaaacgcaagcccaagaaggagagtttacagcaggtcctggacgagggattaacataaaaacacaatgacaaatctcatttaaacttcacaaacgtaaggaaaacaatatcactcgtattttacggatgtgaaaagagaggcccaaagagctcaagcaatttgcgctaaatcatgtccctagcagatggaggggtaggattcaaacccagaattcttagccagtacctggcagttcttccacaatcttaacaattaccctccaccaccccttgggccctctgtccccaggagcccggccagccaagactcacatcctcaggcgagtggcaaccaccagaagtggttgtctcagggctagtgccattatttattttcttctttttggtgtcgcttgctgctgtaccaacactagggttggtctggggatgatggtctgtcaactgtggaaaggaagagcagtgatactcatgagaactacaagctcctacagtcacatcctgctttacagtttatactaaatactcttatagaccatctgatttaatgccaccaactgtaggaaatgttgtcacaatcacttagtgactgagagagattgataccatggctgaaaaaaaaggcagtaatggaacttaaacttagtcttctgactctgagctctgggattttgccctaaatcagcagctgccagggaccaaaaccagaggcagaggtagaaaagcaaatattaagtaggcaggaactgtgcactatgtggtttagggttattcaccctcacacgtctgttagtgttaaaaagtacaccagtacctctcaaacctttacatcaatgtctcctcatggcagaaggcagcctttctgctaaatctgggaatttaacagaaagaggacaacccaagcctcatttcagagagaagtcttgtatacgcttataaatctatgtgactttcatccctaagtacattaatgttttgcctctcaatagaatcaagggaaactgatgcttcagaaagatgccccatatttatcctgtggcactcaaagtaccccaggttgagatgagatgaggaagactcaagctaagttcagtttcccaagatctgttccacagaagataagcagatctcactccagaaccagtgactgaggggcactctggtcccagaacaatggagaattcaaatctgaggtgcagaactgagaaaaaatgttaaagtctctctggagagtagaagcctgggagaaaaccaaaccaaacccattctcccattgccacccagagacactgtcaacgtgttgagctcatgggggaggtgtaggcttttcacactgtcaaggtctgtggtaaggaagtcaggcagcctgaaacctctctcttctaggtcccacagtccccattccccttccagctggaaacctgtgctgcaaccagaggaaacagaagtgggcaagaacacttaggggactgggtcctaagaccaaaggccggtcttgtggtagtaatgacagtttgtagcgggactgtgacatcactacattctactcctcggtggagttgttgggggggacacatgagtgcaatgcccaagttgccgctttgagactggggagggggtcacaaaattgggagccaggtccttggagacgtgaccccaaagagccccgggaggtcaggcttggggcggcaggaggtgagggccaattaaggagcaaggagctccaggagtcacatccccaaagtcaccctgtggcaactggtgagggcaggttctggggcacccaggtccttggagatgtgagctcaaggagcccagggaggtcgggtttggggtagcaggaggtaagggcggagtatggagttggaagccccaggagtcacctgctcaaagtcaccctggtgtgccgggcagagcaggggcaggacttatgagggggttgggctggctgacaagattttggtgtggggagcccagaggcactggggtggggggcccagcctggtgtccctcaggagtggcacagactctggcagcagttcggctgtcagagggggcctcgggttgggttggggtgttggtgcgtttacctgttccttggcctcggccaatttgctctgtctggtttctttggacatcataggatgggtagggaggtggggatgggtagggaggtggggatgggtagggaggtggggatgggtagggaggtggggatgggtagggaggtggggatgggtagggaggtggggttggggccacatcagcatgatccaggtgaggacaagtatatacctccagtcacctctacgtcgctgtgtgactgagccagaggaggcgtaaccagggctgcactagaatgcagaataggggtgtggccttcatgcttgaagcccattggtcaatgagaaagatgaaaggaaaaggaggtgtggccagacagcagcgtgtcatcaaggacctgtgttgtcacaaggaaagctgcctatgcaaccgctgtccccgcccactccaggagaggggcggggctggctttcactttaaaaactttaaaactttattacctcaattgaggtacaagtcctattaaaatggaaattttatagtgtgcttgatgattgataaagcagactttattatccaacattccaataagataatcacaatgttttctcttttttggaaaaactttctcttattctcctacattagcgtttagtttttttaaaaaaaacaaacaaacaagaaacatgtctaatatctttaaaaatacaaagctttgagccaggcgtgatggctcatgcctgtaatcccagcactttgggaggctggggcgggtggatcacccgaattcaggagttcaagaccagcctggccaacatgatgaaatcctgtctctactaaaaatacaaaagtagctgggcatggtggcaggtgcctgtaatcctagctacttgggaggctgaggcaggagaatcccttgaacctgtgaggcagaggttgcagtgagccaaaatcatgccactgcacttcagcctgggctgctacagaatgtgactctgtctctaaatacacacacacacacacacacacgcacagacacacacacacacgcacacacacacacacacacacacacaaggctttccatttaataagcactcaaagttctttacaaggttaaagcaaatacaggacccttctaaagtaaggctaaatgctaagtgatgggggagagaaaaaggacataaataactcctactctcatgagttaatcactaaatccgatttttctagaatcacctggcctctaagccctgaaaatgaaactgaatttctcactcgatacttggctatgacttgcaatcatgaaaaccaagaattgtgttatgtcactgtgtattgcttgttacctgggatcaagggttgactttttcatgatttgctccattacctgtgtgcttcttctcccagtccaaactacgcttttttctagagttctacaatttacagttagtatgtaagggtggctctcaaacatgtagtctccggaccaggagcacctgggaacttcttataaatgtaaattctcaggccccaccctagacatgaatgaatcagaaactctgcagtagggcccagcaatccgtgctgcaataatccctccaggtgctcaggaacctctgccatacagcaggtagaaaaatgtgtttccttctgtaggtccaaagccagggatactatatgttctgtctcaatatgaaacaatgacatgcaattaaaagacataaatctccttcctacttccaccctccagccagtgtgttttatttttatgagttcaataagaaaacgtgtggcaatcagagatttcatctaaaaaatatatctacaggtatcagttctcatccagcctgatctcatccaatatcatttctatcctcttacatctaaagttttagaaaaggattttcacaacgtaagactcaggcgcactaggagttctatgataaaagaccaagtagatctgaatgtccaaacttactagagaagaaaagtggactcattggctatattttcaaattgcattcaacaggaaattaaagttttgaattttttccaccttcatccttccaagttaatagaattaaaccagaatactccattcttccaaagcctgtagccaggcaaacttttactgtattacttcttgcttttcaatggatataaagcagagtcctggtaggcacattttgtatacctgcaaagatgcaaaactaaacagttccctcggttcaatattaaaacaaaagtcctgtaaacctcagatggtgagtgtaatacttcagcactagcacgaaagcctcaaatataaaaagataccaagaaccttgctagcaaaccaaagtaagctcttggccgggagcagtagttcacgcccgtactcccagcatattggcaagctaaggtggggtaagtcaggagttaaagaccagcctgggcagcatagcgaattcatatctctacaaagaaaatttaaaaattagctgggcttggcggcacacacctgtagtcctagagctacttgggaggctgaggtgggaaaatcacttgagcccagaagtttgaggctgcagtagctatgatcatgccactgcactccagttggggtgacagagcgagatctaattattacattctgtcctgctcctgtttccactaaaatcactaacttaaaatgtgttcattcagcaggataaaaattaagtgaaatttgactttggtgctttgctagcaaaaaataaataaataaagtgaagtgacaaattacttactgggagaagatctttgtaacctcaatgacagattaaaggtttgtatccttagcctataaagaaatctttaaaattactcagaaaaaaaaatgaatgatttgcagcagaaaatgggcaatggagaaaccagcacttcccacaagaataaaaatggccaatgagcaaatgaaaaagattcaaaagcactagaaatcaaagaaaggtaatgaaaacaatgagattttctgcttaaagaccagcgaagacgacaaatggaaggcggaacctggagctctgtccctgttggtgggagcgtaaactcaaccaattttcctataggatgatttgaacatttgttttaaaaatcctaaaactgttttatattattttcttctagaaattctacttctatgaattcagtgcaaaaatcctcactcgagtccattaaaatatatatagaaggaaatccacctctggggtggcaatgattcacttaacatacatccagctgttgaaagtgatgatgccaggatatatttctcccatagaaacatgcttaaaatatagtaagtgacaaaagaccatgtattgtgattctactttttaaaatgtttacagcataaaaagtgtgaaaagcaacaaactggaatgttttgagtggcaaaattaaagatttttctttacattttgtcatccaaattattacaaaaacaatgtgatttcctttataatcatggaaaagtgttattttcatttatttatatttacatttcttttctttttcttcttttttctcctgtatgtatcccacataggctacagagcttaaatccctgcctcttgagagaaatcagcccattttcaggacatgcaatacacaaagctgccccatcttccctttatttttatttttatcttatttatttatttatttatttatttattatttatttatttatttatgttgagatggagtctcactctgttgcccaggctggagtgcggtggcgcatctcagctcactgcaacctccatatcccgagatcaagcgattcccctgcctcagcctcccgagtacctgggactataggcatgcaccaccatgcccagctaatttttgtatttttagtagagaggaagttttaccatcttggacaggctggtctcgaactcctgacctcaagtgatccgtctgccttggcctcccaaagtgctgggattacaggcatgagccactgtgcctggcctgtcatattatttctaaacatttgagtgacatttcaattaagtgaaatttaattcttactgatctgatctcttatcctctgtttaatgataccttccagttgaaaggtgtttcctctgtaatcacgggtgccaaaggaaatacaacatgtattcattaggtggatatccactaaaccacggattcatgcattgtagtccttagaccctcagcatcagaaacacgtgggaacttgttagacatgcaaattcctgggccagccccacacctcctgaatcagaaagtggggaaggacagctatctgtgctttaataagccttgagatgctccctgaagtttgaaaactacagaactagaatacatatggtagtaagtgctcatactttatccaaggtactagggactcttcccctcttttccattctcttttctgttgaaataaaatgagagctccttttgacttaatgggtataagaaagaaggcaatgagatgaccagggtttcaagttagagttcaaaatttaatcagtggacagtgacaggatgcaagccttctaaacagattgctgcaaggaagctgattataatctatacagtaggtatcattagtgtattgatgttaaattttgggggtggattaatggtattgtgattatataggagaagtcctggttcctagaagatatctgcgaaagtacttaacagtgaaatgctctgatactgccaacttactttgaaatgattcagagggaaaaagggcacatatacaatcttccatacgcagaagacagaaaacaagtgtgacaaaacattaactagtgaatccagttgaatagcatacagatgttcactgtatgattttatcaacttttctgtgtttgcaagttttcaaaataaaagttgagggaaagaaacatcaccccaaatctttctatgaaatgggaccacagaaaaagcagagaagtgaacactttgcagaaaagagcactgcacccatccggacagcatggtcaaagtgcaggctctcctccaggaggctcttctctggtctcttctgtgctgtcacttcccccacatgcagccaaggcttttttctaacaactctttttctaaagatgtaatttttgtcattcatctaagaaagagaagaaaagaattagtatacatttagaaaataaaattacacttacatttgtgaaaaagcaaaaaatactttgaaaagtggggaagcaagaaatgtactgttctacaattctgttctgttcttaccatctttttattctgccaatgacttcctattcctgctgtgtatggtggggtgagctgcaaatgatttcttttcctcattgatttaaaatgtcatgtttataatgtaccaaactcccccagaagcatttgggtttatttctgggctctattctattcaagtaatctatctgttcacaagccactatcaattttgattattggagcatcctaaagttaagtaattgttgtttttgtttttgagatgcagtctctcactctgccgcccagctggactgcagtggcgtgatctaggctcactgcaagctccacctcccgggttcatggcattctcctgcctcagtctcccgagtagctgggactacaggcacctgccaccacgcctggctaattttttgtatgtttagtagagatggggtttcaccttgttagccaggatggtctcgatctcctgacctcgtgatccgcctgcctcggcctcccaaagtgctgggattacaggcgtgagccaccgcgcctggccctgaatttgcttgagtttttagctctctcacccatttcaggattgtcaccacccatatctgacacatcctcctccttctctaaatcttctaggtcctcctggccatcagcctctgtttctgaaccagcctcttcatgctcctgttcttcactctctgggagaagactgatatcttcatctttctttcactaaccgcattctggaagcactgtaaaattgcttcattttgcaattccagttgttgcaaagtctgctcatcatcaaaactttctatcacaagtttttgtaaagagctgccatggattctaccattctctactgttttattaaagtcataaagcacttttgttaaagaagtgaactttggttccaatccatcttgaaacctattgggaggaattaaatgagatttagaattatagataataatttcacagccctcttaattaaaagaaaaataaaaacctcaactcttctgtaaaatcaaatttgaataaagtgtaagtatagattctggccccaataatatataagctgatgagccacaatgatatataaaacctgtcaaccaagtatttgtgaatcatctgtatagattgttggcaggaaaagcattacaaatctatttgcttggagatatatagagaattagccttaaattttctactctgctacattatataccactccattcattcattcccttattcactcaatgatcaacatttgctttggctacagtggtcaaggaaaacctctcctagatgtgacatctgagatgaaacttacagacaagtatagtcttataaagattgggaaacatgtattccaggcggaagaaacagcaagaacaaattctctaagatgcaattgagcttggtaagcctgaggaataaaaaagtgagcatggctatagcgtgaaggaggcagaaggtgaagttggagagactgatgggagccaaattctgcagggctcaagggtaagagtttgccgttttaagtgtaataagaaaatgtgagaagattttaagcagaaggatgaaatgatgatttatacgaaggaagaagaaagggaggaaggaggaggaggaaagtagagtgattagaaggttgatgcagcattccaggcaaaggatgatggtgatttaagctggagttagagcagtgaatatgctgagtacagtttggaggtagaactgacaggattgctaaggaattagatacagaatagagaaaagtgaagacatcaaaatagcagcctagttttatgtgcgagcaactggagagacagaactgccatttactgcgataggcaaggcttgagtggtggagcaaggggaaaggacttcagcggatggcagagtgtaggtgggtagaaacaacattctactgtattttggacacagtgaatttgtgatgctgagaggatcaaaatttaaaaaattgttaaaagccgtacggtgcggatatcccagttgtgcgctactgaattccaactaagctcagtctggagttgcttgtgagcaaggaactcaagggagaggttggagtttgaaacataaatgagtcataattttataggtcatatttgaagttcttcaacaaaatacacataaaacgtttgtgttgggaagagacatgaaagttctaattctcaagaagcttagtggggtagacagacaagtgacaagtttgtgctttcaataaagtatgatggcaggtaaacactgagtgctttaggagcacaggcggaaggagaaaccaacacagttgtgtgtagggggatgggggccgtaataagcctcaaggggagcttataggcgtgaataactgaggttaggttgatttcaataacattcatctgagagatccatactgtaaaagttttaacaatttttaaaattttgatagcctaggtcctctgaaatgtggggaaaagtgatttacatttccccttaccttcccccagctccacaatttgccaggggtctgcaacccgtgtccacgtgcgaccgcagtcgcacccgagcccgggatctgtgcacttacgtgaggatgcactcgggccagccagtggctttgcccacctccctcagacaccgctccagggtccgtcagcgccaggcccatgggccatggctgtctgcaactcccgacacaagctgcaaggcaagagagccgctgggaaaccgcaccgcaaggatgctggcattggaacaggaattaaaagaaatgaaaaaatgtgtaagcaaaaactcagctgtatgtaaaaaaaacccaattccccctgagaatgagaaagagccttagtcctttaaaaaaactacctgttttcctatggctagtgagccttatcgctcccttcccaggcattatcaaaaccctaattccctaactgtgcaactgcaaggtcactaaacaaacaaatgcaagtcacaaaacatatttttcctaaaaacgtaaaaaaaaaaaacataatgcgtgcttcaattaaataactctctgtttctcgcttctgtaatatgcttccccctgcacagatctacccgggctccacaaaatgctaaaagataactctttattcagctcaacgctttgatctgcctggcgtggtggctcactcttgtgatcccaggactttggacggccaagtagggtggatcgcttgtgccttggagttccagacaggcctgggcaacatggtgaaacctggtctttttgttttgtgttgttttgagacggagtttcgctcttgttgcccaggctggaatgcagtggctgggtctctgcttgccgcgacttccgcctcccgggtttcggtcgttgtcctgcatcagcctccagagtggctgggattgcaggcataagccaccaagcccggctaattttgtattttttttttatttttattttggtacagatggggtttctccctgttggtcaggctggtctcaaactcccgacctcaggtgatccacctgcctaggcctcccgaggtgctaggattgcaggcttgagccaccgctcccggcccaacttattaatcagaaaggaatagatcgtcctggtgtggtggctcacgcttgtgatcccagtacttcggatggcccagcgcggggtatcccttgagcctaggagttccagacctgcctgggcaacatggtgaaacccggtctctctctctctctctttttttttttgaggcggagtttcgctcttgttgcccagggtggagtgcagtggctgggtctccgctcgcagcgacttctgcctccagggttttagtagttctcctgcctcagtctccggagtggctgggattgcaggcctgaccaacattgctctgctaatttttttttatttgtttttggtagagacggggtttctccatgctgggcaagctgatctcaaactccagacctcaggttatccgcccacctcggcctccggggatgctggaattgcaggcgtgagccagcgcacacacccaatttatttttatttcattttttatttttatatatatatacttttgagacggagtctcactttgtcacccaggctggagtgcagtggtgcgctgtctcggctcactgcaacctctgcctcccaggttcaagcgattctcctgcctcagccgcctgagtagctgagattacaggcgcccgctagcacacccatctaattttttttttttttttgtatttttagtagagatgggttttcatcatgttggccaggctggtctcgaactccggacctcaggtaaacccacctcggcctcccaaagtgctgggatgacaggaaggatcggcctggcgtggtggctcacgcttttgatcccaggagtttggacgggccgagcgtggcggatcccttgatcctaggagttctagaccagcctgggcaacgtggtgaaaaccggtctctctctctctctcctttttttttttgaggcgtagtttccctcttgttgcagggctggagtgcagtggtgcggtgtcggctccccgcggcctctgcctctgggtttgggtggttctcctgcctcagcctccgagtgactgggattgcaggcgggagccaccatgcccggctctttttttttttttttttttttttttttttttctggtagagacaggtctctccatgttggtcaggctggtctcaaactcccgacctcaggtgatccgcccgccacggcctcccggggtgctgggactgcaggcgtgagccaccgctcccggcccaatttattaatcagaaagaaatagatcggcctggcgtggtggctcacgcttttgatcccaggactttggacaaccgagcgtggggaattgcttgagcctaagagttccagacctgcctgggcaacatggtgaaaatctgtctcttattattattttttttttttttgaggcggagtttccctcttgttgcccaggctggagtgcagtggctgggtctccgctcgcggcaaattctgcatcccgggttttggtggttctcctgcctcagcctcctgagtagctgggattacaggcgcctgccgccacacccggctaatttttttttttgtatttttagtagagacgggttttcatcatgttggccaggctggtctcaaattcctgacctccggtgatccacccacctccgcctccccaagtgctgggatgacaggcgtgatcggcctggcgtggtggctcacgcttttgattccaggactttggactggccaagcgtgggggattgcttgagcctaggagttccagaccggcctgggcaacatggttaaacccagtctttttttaaattcctttattattattattattatttttttttgagacggagtctctctgtcgcccaggctggagtgcagtggcgctatctcggctcactgcagcctctgcctcccagggtcaagggattctcctgcctcagcctcctgagtagctgggattacaggcgcccaccaccacacccggctaatttttttttattttttagtagatcgtggtaactgccttaaaatgatgattgttcagaaagtcagtttaatttagatactaaggatattgaggttatgtaacatttgagcaagttctaaaaaaaagagaaatagtatatttaattgctaataaagtattgtcaactcacaaatatattcacatagcatacatttcaagagcagaataaccatgaatataaaaggaattagcaaaaacgaaacaaaaaagacatgaagaaataaaaacagatggaacaaatagcacaaaatacgatgaaagttataaaagaaactatgccaacaatcacaataaatgtaaatagactgaataattaagagaaaatgactataaaacagaattagggcacgcgtggtggctcatgcctgtaatcccagcactttgggaggatgaggcaggcggagggatcacaaggtcaggagttcgagagcagcctgaccaacatggtgaaaccccatctctgctaatacaaaaattagccggcgtggtggtgaacatctgtaatcccagttactcaggaggctgaggcaggagaatcgcttgaatccaggaggcagaggttgcagtgccgagatcacaccattacactccagcctgggcaacagagcaagactccgtatcaaaaaaaaaaaaaaacacacaaaaaaacacaaaaaacagaaaataaacagtatgaaaagacatctaaaacataaagtcacagaaagactgagagagattgaaaaaagatacacctgtcatatgtacctaacccaaagaagggttggaagctatattattatcagataaaataggctttgggcaaaaagcaatatgggagattttttaaggccacaatataatgataaaaattctaataaaccaagggagaaggtaatctaaaatgttaatgtatctaataactagcactcaaaatacatgaaagcaaaatatgacaaaattgcaaccctcagagggcaatttaaatacatatctcagtatctgataaaagagacaaaaaacaatcagcatagacatagaagatttacatctctctagaaaattaacaagcttgacttaatgtacagaaaaaacatctctccaaagtgacagcattcacccccccaagtacatatgtactgagccataaggaaaatctcaacaaattccaaagaagcggaatcatgcacccatctttctctctaaccataatctcattaaactaaaaacaataataaaaagataaagtaaaaagccagaaaggcagatgctaaatgagaaagtgacagaaaagttacagattttgttaagcatacaaagcttctatggggtaaagcagtcaaagggatatgcaaatttacacagaaatccaaccgatataaatccttgaaagatactacatacagatatttcatcagttctcacatgccaaacccagcaaagccaaactttggagcctcccctgcgagcagacctgccacaggaggagaggcagcacaaacctccctttgcagtgaaaatgccacattgtgtgtgcttcttaccccatcacctctttggaagtggccccactcagcgctagctgagaatcgcttccctcataccactctcagtagttcaccccaagacacacgggacaactctgtacctggtaagtcattgtgaatccaattaataatggcattcagaaagttaggaatctttgaattattagattcatagtgatattcaaaagaaagaaaacgacatcatttctgttccacgcatgttgcccacattcactgcgtaaaaggcaaagggaactgtgagtacccacaaagaacctgatattgacggcacatacatttcttcattaggaagaataaatttagactgtaacaatttaaaaaaccagaaaatacaactgtacattttagttcttattaaaatccaagagttttaacttatttgctccttgtttaggtaattagtgtctaaaacatttcaaagataacatatatagtggctacgatttctagtactttttaaaaattcaagcccagtctcttctaattaaatgtataaatgatttatctctgtctttcttaaaaagaaccaagagccccaattaaaaagtaaaacttaaatttcctcttaaaaaattgttacgtcggccgggcgcggtggctcacgcctgtaatcccagcactttgggaggccgaggcgggcggatcacgaggtcaggagatcgagaccatcctggctaacacggtgaaaccccgtctctactaaaaaaatacaaaaaaaaattagccgggcgtggtagcgggcgcctgtagtcccagctactcgggaggctgaggcaggggaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaattgttacgtcaaaattatctaataaaccatagttcagaaaataatttctgaattaagaaaatatgaagaataaaaccaacagtttatgtgctgaatttcacatttttattttttattatttttaaaattttgttttaagttctagggtacatgtgcaggagtgttacgtagggaaacgtgtgccatggtggtttggtccacctatcaactcatcacctcagtgttaagcccagcacgcattagctatttttcctgatgctcctcccccacccgccctgacaggccccagtatgtgttgtttcccttcctgtgtccatgtgttctcactgaacctcacatttttaaatacagcatatgccaggtgtcatttcagtacccataattatacatagtatatgtatatgtgtaaatatatgtatatgtgtacatatatgtatgtaatatgtgtatgtaaatattatgtaaatatgtatgtatgtaaatatatatgtaaatatgtatgtgaatgtatgtaaatatatacacatgtaaatatgtatgtaaaaatatgtacgtaaatatatgtatgtaaatatatgtatatataaatgtaaaatatgtaaatatttgtaaatgtaaaatatgtaaatgtaaaataaatgtagaatgtcaaatgtaaatgtaaaatgtaaaataaatgtaaaatgtaaaataaatgtaaaatgtaaatgtaaaatatgtaaatatatgtatatgtgtaaatatatatgtgtaaatatatatgtatatgtgtaaatatatatgtgtaaatatatatgtatatgtgtaatatatatgtatatgtgtaaatatatatgtatatataacacagcatacagcatatgccaggagtcatttcagtacccataattatacatagtataattatacatagtataattagactactatgttagctaaaaaatgttgattagatacaaatgtataaatttatcttctctaaacgtggaaattctctagaggctatttccagcttctgtgtggattgtagagcaggctgctacctgtaccccaaaaatgaacaccttaaaaaaaagacaactttctcagcctccctattgcacacacatatgaaaaatatgttaaattcaacgccaaatattcctgagatcaacacagcagtgatcccaaagagaaaatttctctttgctaatgggcacaaacttgaagggcaaagcagtggaagggtaagtctgcagactcgcgtggggctcaagtcagaatcacgtggaagatcattgccacatgtttttgtttttttaaatagcaaccaccaccaagtggagcccgccgggtttagtagatattaaacctctaaggagtggcacatccgagactgaaattcccatcttttgattcccagctcaaggtctctgaaatgccagcaccagctgtgaaattgttcttctgcattttcatggagaccttttcttctatactgccatactcttttttttggaacagttatacctgatcttcctatttttgtgtgtgttccaccgaaactttttcactctaaatacttccctctttccaactgagcatttacatctgtaacaaggacaaaaacatctaacatctctctcacccttggtttgtgttttgttttgtttgtttttgagacagggtcttgctctgtcacccaggctggagtgcagtggcgtgatcactgttcactgcagcctcgagctcctgagctggagcaattttcccacctcaacctctgagtagctgagactataggtgtgtgccaccacgcctggctaatatgtgtattttttgtagagatgagtttttgccatgttgcccaggctggtattgaactcctggcttaagtgatcctcctgcctaggcttcccaaagtgctggaaggaattacaggtatgagccaccgtgcctggcctcaccattgttaaaattatggaaatcgtgtttgcaaagcaggttggcctgtttggaaaagggtgtcataatttctcaggtagctccaaaaagagaaagctacgaaaattaccttaatacattcattacagtctcagtataagattatagcttcctctcccaaagcgtaaccacaacctgacgcaggatgagttggtttgaaaataccgcatacaatatcctcttgagtagaatcataatttagaactctaaaaatgaccggaaacaaaactgtccaagtttgtttaacgtaatgtgtttcaacttatttgactagaaaacccttcattcgtgcaacacttataaatatcccatggcaaatctagttttctatgaataatgaacgaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatagcccatgtctggccaggctccatggctcaatcacacctgtaatcccagcaatttcagaagctgaggcgggaggatcactggcctttagtgatccttgaatgaaactccatctctaaaaaattaaaaatattagcttagagaatcatttgggcccaggagtttgaggctgtattgaactatgactatgctactgcattccagcctgggcaacaggctgcttaaacctggaggggcagagcttgcagtgagccgagatcgcgccactgcactccagcctgggcaaaggagccagactccgtggcaaaaaaagaaaaaaaaaaaaaaaaagagattctattcacaatagcaacaaaaccctgagaatatatctagcaaagtatacacaggcctttcatgaagagtattgccatagcctgaatgtgtctcccaaaattcatgtattaaaacttaattcccaagatgatagtactaagaagtggggcctttaagaagtgattaagacataagggtgagccctcatgcatgagattagtgccttccttataaaagggcttgtgggtggtggtaaatctgtcccttctgcctcatgagaacatagcatttgcctgctccagaggaagcagcattcaacgtaccatcttggaagcagagaccaggccctcactagacactgtgtctgctggagtcttgatcttgttcttcccaacctccagaactgagaaaataaacttctgctctgtgtaaattacccagtctcaggtgttttgttatagcactatgaagggactaagacaaatataaaaattacccagggacttaaaggaagaactgactaaactgaaatatatgccatatatattatgaatcgtaggactcaatgctataaacatactacttctcaacaaattaatctataaattcaagaaattcctacacaaatcccaatagaatttttttgtggaactcgagaggctgatcctaaaattcatacagtcacttgaggggccaagaatagtgtaacagggctggcggggctggtggctcacacctgtagtcccagtactttgggaagtcaagactggaggatggtttgaacccaggagttcaagaccagcctaggcaacatagcaagatgttgtctcaaaatattaaaaataaataaataaataaataaaaagaaggttaagtatgcacattttgttgtgaatttcaattttatagtgatttttttttttttttttgagacagggtcttgctctgtcacccaggctggagtgcagtggtgccatcttggttcactgcaacctctgcgtgggctcaagcaatcctcccgcctcactctctggagtagctgggaccacagttatgtgccaccacacctgactaatttttatatattttttttgtagagacggggtttttccatgttgcccaggttgttctcaaactcatccacctgccttggcctccgcaagtgagatcacagacatgggccactgtgcccggtctagtgcgcttttttttttttttttttaaccaaacaaacgatgaagtctcaggagtaaaagttgatacacaagtaaattttattggtaatgtttttgtgtggtctttaagcagagggaaaattagtctgcattatggtgtatccagactaaataactgatattaaaatgaaattatccttaggatttacaatcttagagaaaactttttcattttttttgagttacaaattatcttcacttacatttgagaacagtgagtcacagagggattaagtatcttactcaagatcttgcaagtgtttggtttgaacccaatcttttcactctgcagaactcagagtcactcttatttggaaactttttaactgatgtggatcctctaatatgggcttcctattattcattccgtattagtcagaagttttgcaagcaggcagaattcattttgccaattacgggattttccctcagttgcagtcaaggttcataaaactataactatttatctttaattataaattttgtttttgagacaaagtcttgctctgttgctcagactgggatccagtggcacagtaacagcccattgcagctttgaactcctgggctcaagggatcctccgcctcagcctcccaagtatctgggactacaagtgcatgccatcatccctggctaattttgttaaaaaaaaaaaaattgtagagatagggtcttgcttcgttgcccaggctggtctcaaactcctggcctcaagcaagccttcagccttggtctcccaaagtgctgagattacaggtgtcagccattgcacctggccaaaactgtaactatatatacacacacacataactacatatatatgtgtgtgtgtatgtatgtgtgtgtgtatatatatttttatatataaatagatatatctgaaaggcatcaaaagaaaaaagctgtaacttttagtcttgatcttgatagtgacttgattaggctatctgtttaacatcaaagatgcaaattaatgctttctttgggtgagcatattaaaaatgcagaaaatattggagtagttttttatgttaaataaattgtattctgtgtatttaaggtatacaacatgattttgtgggatgcatatagatggttaaaaaaattactacagtgaagcaaattaacgtatccttcaactcagatagttacccgttttctttttgtttggtggcaagaggagcttaaaatctcatttagcgtgaatcccaatacagcacaattttattacctatatttcttgcgttgtacattatatttctaggcttgttcatcctacatatctgctactgtgtaacctctgagctatgtccacccattttctctcttgccccccaagtaatttcctaaagtgtctcatataaaaaggcagtagctttcagcttaaactttttctctgtatatatttaagtcaatttctttgaggtatgtttttctctccagaatagttagatgtaggcataccactttaatgttgacactagttcacctagaacttatcttctgcaaatctgtctctatgtccatctctgtctccatctttgtctctatctttatctctgtctatctatctatccatccatccatccatccatctatctatctatccatctatctgtctatctaactaaagcaaattcatgcccttctcctatttatggaatcgagaccataaacagaggtgagggaaagaatttggcaggaattgcgatgtgtattacctgtggcataaggaaactttacagaactagggtcaaaagtatactttctagttctttcccatggcttttcactttgatgtagtccttatcaggcaactgaggttttatataagtcccctgattcttagaacatgaaggtgtagtattcaagtttggtcccttgaaagcacaatttttgttaaaaaaaattaagaaaattgtatgatttcctcagcaaatacatattgatcatctgttatacagccatgagaagtggttctgttgaacacgtttattttatcagatcccaattctaaaccaggcatagaatggaaaccatgaaggtaggatgaaataacttctgaatgtttgaaaatagtgtacttaaaaataaatatcaggtgtttttgttttgttttttgttttttgtttttgagacagggtctcactctgtcacccaggctggagtgtggtggtgccatctcacctcattgcagccttgacctcccaggctcgggtgatctcccacctcagcctcccaagtagctgggactacaggcacatgccaccatgcccagctaattttttgtattttttgtagagacagggtttcaccatgttgcccaggctggtctagaactcctgggcttaagcgatcttcccacctcagcctcccaaagtgccaggattacaggcatgagccaccatgcctggctgaaaataccaggtttttaagtatcagcactgcctcttcaatcttttctattactatgttgtgctcagtggtattttttattgaattagagcagtgctgttcaatggaaccttctttgaggatggaaatcttttatgtctctgctgtgtgggtatggtattagctgggtatggggcacctgcctatagtcccagctactcaagaggctgaggtgggaggatcacttgagcccaggaggccgagtctgcaggttcgtaccactgcaattcagcctgtgtgacagaatgagactcagtctcagaataaaatgaaataaggaaataaaaatgtaattgttgaaataagaaactagtggatggattagacacgagaagaaagaattaattgtttagacgattctctccaaaaagtaagtcagcatgtcacacagagagacatgaggatagatgatagggcagaagttggtgggcttggaggggagaggaagatcagaatgaggtccaaaatgtgtcttagtgaaatcccaggaggagatattaaaattatattagaaagtgaaagaaatagaagttttatttatttatttatttatttattttgagaaggagtctcgctctgtagcccaggctcgagtgcagtggcacgatctgagctcactgcaagctccacctcctgggttcacgccattctcctgcctcagcttcccaagtagctgggactacaggcacccaccaccacgcctggctaattttttgtatttttagtagagatgtggtttcacctttttagtcaggatggtctcaatctcctgacctcatgatccaccagcctcaggctcctaaagtgctggaattatacgcataagccactgcacccggcccaaaagctttgtgtttttacaaatattacacgtttcttgtttaagaaaaaaagtcttcacaataacgtaggagaataagagaaacatttttccaaaaaagagaagtcattgtgattattttatcttattggaatgttggataatatagtctgcttcagtaatcatcaagcatgctatggattttccattttcataggatctgtatctcggttaaggtaatactggtaatttttgtactctatgaaaaatataggccaaaatcatagaccttgcatagaagctggatcatgaagacagctctggaggaacacacaggtacacacacacagacacacatatatataaagtatacacatatatattttttaaaagcttttaaagcaaaagccggccctgcccctctcccagagttggcggcctctcccctctcttagggtgggtggggacagtggttgcatgggcagctttccttgtgagccaaaggtccctctggacacatgatgcctggccacgccccctttccctttcatctttctcattaaccaatgggcttggagcattaaggccacgcccctattctgccttctactgcatccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccaatcccgaggttcaccggactgggacccccacaccggtgcctctgggctacccccaccaaagttttgccagtcagccccaccccttcagcaagcagcccagtctctgccctcaccaatcaccccagggtgactttgggcaggtgaatcctggggctccccgctcctttactgggccctcatctcctgccaccccaagcttgacctcccagggctttttgggctcacatctccaaggacctgggtcccacagccccagaccccaccctcaccagtcatccctgggtgactttaggctggtgaatcctggggctccctgctgctgactcttcccttccctcctgctgcctcaaggtggacctccctaggctgtgtgcactggcgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcaagactggcctttgatcttatgacccagtcccctaagcattgccaccccatttctggttcctcttgtcacagcacaaatttccagctggaaggggaatggagattgggacctaggagcaagaggtttcaggctgcctcactcccttaacataaacattgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagtcagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaagagtataccagacctctctctgaaatgaggcttgggttgtcctctttctgataaattcccagatttaacagaaaggctgccttctgccatgaggatacattgatataagagtttgagaggtactggtgcacttcttcacactaacagacgtgtgaggatgtatgactctaaaccacatggcatacagttcctgccaacttaatgtttacttttctagctctgcctctggttttggtccctggcagctgatgattcttggtaataccccagagtttggagtcagaagactgagtttcaaagttcgtctgtcgcctttttcttttcttctttttttttctagccatgatatcaatctctttgagtcactaaatgattgtgacaacaccttgtacagttgttggtatcattaaatcagatggcgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagattgtggatggactgttgggtacctgtgaagaattctgggtttgaatcctgcctctttgtctgctagggatatgaattagggcaagttgcttgacctcatcgggcctctcttttcacatctgtataatagaggtggtattgtttcacttccatttgtgaagtttaaatgagatctgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccgcagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcagggcagccctccaacctcctcctccaggtgggacggggtgcccctctgccagctgagacagtccacacacaccccagccctaatgattgctctctctacctctccccccactcctcctccacctcctcctctctgcatgcgcctcagagcccgtgccaagaactagcagtagtcccagactcgaggtctgtaaaagtcagtcaactgaagaacaccatcaaatctttggtaagagtccactggggtcccctgattccacgctgccaatcctgggctctagtttctccttggggccctgaagaaaggggacaggggcccctggtgccaagggcgaatagggagctggggcacccaggcctcacctggagggaccccggagcatgcagcatggctctttttttgctgccctgtttgctgactctcccctctccagacgcccctgctcgagtccttgctacacacgccctgggattgttgcctcttggggaagtgctagcctgactggttgtcaggggccctgtatttctgccatgactcagtccctaatttgctctttgattctggacaagccacctctcctttttgggctcgtgtttccagaggaagtagtgagtatcataggtctctgttagctctgagagtctgagatttaaaggcctcctagaatggaaacctcagggccaaaggctcctgtctgtccttttccgccctaaatctgctgtgaagaaccgtacttggcccgtacgtgctcagtaaatgtttattgaatgaatgcacttttctaaatcacaagctggcagaagggggggcctttctcaaactccatctctagaggtttatgttactgtcctgtcaagagattccagattcagaccttgagttctgtggctgtgggcaaaagccaacaaagacccaaatcctctgtccttgggagcttgaggagagtttaccagttcgagttcccactgggtctgagaactttgcctttaaaatccattcctggtccctgcctaccacttcctgctctggggaatagagttgagggggccaccctccatcaccttaatgtgactctccccacagaaacaacagaagaaacaagtggtacatcagctggaagaagtaacatgatttctttgtttgctcgcgacatgactgctcggtttgggggacactcagatgtagaggccccgagtctcgtctcacccactcccagcctggggaagaaggctaaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacggtgtgcagttttctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctgggactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccccgtcccctgggagcctggcttcgcagacagaggagtgagcctaaaggtcccttctgcaggatggagtgtcctgcccagaaggcagcatggccatttctcactgcttttttgtatggttgttagcggcagcttgggactgagtcagctgctgtgggtgagttggggggcactctggggagagaacacaggacgtagagcttggaggccaagtgcctgccatgcctttacctggctgtggtcttggccaagtcctaagtggggtattggctacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtttgggactatgtgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtggttgcgaggattaaatgggattgctagcatggtatctggtgaagcactccataaaagttcaaacagtggtaataataacagtaataacaatagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctccccagattgaaacttctcactcttcagcagttctccagccgcagtaaagcacgtatggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtagagccagaggtggtcctgggactgggctttgtggaggtgggggcagagagggagatggtagcatgtccagcctccagcccctctctccagggccctttccccctgtgctttgggcaggtttgctcgttgaagaaggagaagaagcatgataaatatcgggtagagacgctggagaggagcttgtccaaactcaaacaccagatgggtaagatggggctggcgtgacctgacagcaggactggcatcagagggctgtgagggtggcttggagtgccccagcgaggtgggtggatgggaagggctttgaggcagagggaaagaggtctgttccaggagacggcaagtcttgtcatctcaatgagcctcagtgtccccatcagcaaagagggcccgttgtcagccacccgcagtgctctttctctgaaagtggtttggaagactggctaccatctgggtgcgaggaatcattagcagtgaggccaagtttgaggagcctgagaggagctgtgcgccaagaggagggtttttcttttccgagaatccagaggcccttattatctgcttcctttctcagctgaacccttgcccccggagcccccagcagtgccctctgaggtggagctgcagcacctgaggaaggaactagagagagtggcaggagcgctccaggcccaggtggagtacaatcagcgcataagtctcctgaatgaggggcaaaaggagagacttcgggagcaggaggagaggcttcaggagcagcaggagaggcttcgggagcaggaggagaggcttcagcagctggccgagccacagaacagcttcaaggagctggtgcgttgccccagctggggagcctgccctcctccctagccctccaggcctttgtttccccacctataaaatgtggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggcaccagcctctggggaggggaggtgccaggccagaggcagctccagcccgggggcaggtgaccccagcaccctccagggcagtcctgtggctgtttcttgcttcctgccctctgattttagaggtgggtagccctgggctcctcccaggtctggacatcatcattccagctagagacatggagcaccgccaatcacaggggaagagacagagtggtataacagtcttcttatgccagacgcggtggcttacgcctatagtgccaacactttgggaggctgaggcaggagaatcacttgaggtttggagtttgagatcagcctggccaacatggtaaaacctcatctctactaaaattacaaaaacaaaaaacaaaaaaaggaagaaaaattagtggggcatggtggtggcgcatgcctgtaatcccacctactcaggaggctgaggcacgagaattgcttgagcccaggaggtggaggttgcagtgagctgagattgcaccactgcactccggcctgggccacagagtgacactctgtctcaaaacaaaacaaaaagactccttagattaaaactggattccagcctcagttccactggtcaccattcaagtacttcacatctctaagtctctgtttctttaacttcaaaaggaagttagcattttccttacagaggtgctgaggattaaatgagataatacatgggaagcattaggcctgtagcacatttagcagatggtggttggctcccactacttttctaccattctgtggcctacagttgaaatggtgggaagaggacatgagatttgaggctggggaaggaggcatggggttctaggaaagggaggcagtcacttaggcctggagtaaggggccaggggcctgggcaggcgacagagccccacagtgccctcgctaccctattaatgggcccagaatctggaaaccagccaccacgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtgactgcagcagacccagctaatgaaccagctgcagcagcaggaagcttggggcaaagcggtggccgagatggcctgccaaaagttgcaggaggcccaggggagggagctgccgaggatggggccgtgagggggacgacctgacaaactctgtgccttctcactctttcctggccccttaggagcgcctggaagctgccagccagcagaaacagcagctaacggcccagctgagcctcatggctctccctggggaaggtacgggagaccgcttagaggaagaggagagagccccaggaggaaggggggactgctagcagcataggattgaggagttggaagagacctttagaacagctggtcattatactaaccgggtgcctgcactaagttcagcatcaatatggtgacctcctgggagcggggggccaccaagttgcctaaggatggctgaactggccgaggtcagaaagggagcaggtcagaactcccacaccgaccagtagtgggaatgtgcctgggcagtatagcaagatcttggttcttcaaagtaaaaataaataacagcagctcattcctctctggggagggcctggctcagggttacacaatgagggtggaggcagaggtgggcccacaatacttcccttgttgagttgtctgaagacccctctggccacccccaacaggacacggaggagaacatctggacagtgagggggaggaggcacctcggcccatgccgagtgtcccagaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtggccaacaggtgcactctctgaggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagcggtcccagccccagggcctgggggcgagtctgtgagtggggagacccaccgggccctgcaggaagtcatggagaagctggcccatgccggaactcacctccgccttctccatgacttgaaaatgccacctgagggcaggtcgctgccgagatgtgaccccattattttggctccagagcggctttatggaccacctggaggagaaggcagacctgagtgagctggtggagaaagaagaacttggattcttccagtactacagagagagatgccatcagtgagtgggaggccagggcgtggcagggggagctgcagggctgttggaggggccccagcgtctgagccctgtcctcccgcaggaaagtttatcaccctataacaaagccagggggcagtgccaaagatgcagcaccgggaggaggacaccatcaggctggccctggacagggaggagatgaaggtagagtgtgcaacatctctgcgggggtgggggtggctgtgacggtgagcgctggcagcagcgtgacagctgagcacccctccctccaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtggtgagtagagccctcaggcggggtgggcaggcaggagcaggggggctctcactgagctcagatccccgcctccctctctccaaagatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatgaccatcgtcaaagacctgctcaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggtcattagcatgcatattgagtttgcccttacgtggtgggagttcaaacacacaaagacccactatttgcacaaaactattcttgctggtttggaataggctgccatgtgtttttaatgttattgaagcatgtatattcattacagaattcagataaaatttgcctatgttctgctattgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctatggattaaatcacatactggcatatttaagctgaatgtcaatctggaaaataaattgactgtattaacagaaataccactctttgtgtagatatttgtcatatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagaaggcaacattggaaggttagagttcatcagaaacagaattctaaaatgtgagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgcaaagtgctgtttttgccttaaaattttattctgtgtgtcttgaaaaatatagtattaaaggtattgatactgtgcaaatgctgagcatgcttggcatgagataatgtttcatttttacaaaattgtaatataactatgcaagagtttattaaaagaacacaaaataaaaaagttatgggattaacaaaagttatggggtgaaaaagttatgggataaaaaatgtaaaaaagttgtggcaaaaaaatcttgtgaccaaaaagtagaaaaaagttttatgaaaagttaccaaaaatagttatgaaaaagaagttatgggatttaaaaaaaaaggcatgggataaaaataaaaattaaaattaaaagcaggcccctgtcagcaaagcctggagaagtggggctggggtctctccaccaccacactgtccctatctccccttcccagtcacccctttacaattagggtagcaagacaagaccactgtctaacgaggaaagacaaacagaccctttgccaccttgaccagagctgagtccttaaatttctggatgatattgttatttaagagccagaggctggtggagttggtttgtttggaggaggcctcatggcctccttactctcaccatagcaacttttccctcagtgggggctcgaatcttcttattcagagaggtagctgaggcaggacagtggggctaactgtggaccaggcgaaggcatgggctgctggggtggccccccttccccggtgtatatattgtgtctgtgtaaggttttgtatattccagagggtagggccacccctgtatcatacctagcggtggttggaggtggcacatggggaggaggttctaataattatttgtggctgggaaacttacttattgctagcataggacagaggaagaaggcagggatggggtcatggcttcccagtggtgtgatcacagttcactgcaacctccaactctcatgctcaagtgatcctcccacctcagccgcccaggtagctgggagtataagcatgcactactatgcctggctaatttttaaattttttgtagagaaaaggtcttgctatgttgcccatgctggtcttgaactcctgggctcaagcgattctcccatcttggcctcccaaagcactggggttacaggcatgagacattgctcctgtccataagattttctctttattactgttttgttgttggtggtggtgttttgttttgtttttattttttgacagagtctcggtctgttgcctaagctggagtgcagtggtgcaatctctgctcactgcaacctctgcctcctggttcaagcaattcttatgcctcagcctcccgagtacctggggttataggcataagccactgcgcctggctaatttttggatttttagtagagacagagttttgccatgttggccagattggtcttcaactcctggccttaagcaatccgccctcctcagcctcccaaagtgctgggattacaggtgtgagccactgctcctggctaagatcccatctctatttaaataaaaaaagaaaattcagaatctatggaacacagaacaccaaaggccagttatttacctctctgaggtaatctgtgtaaacaatttgatatatatcctttcaagttcatacttgctatgcatacatatatatacacacatacattgacatattcccccttccctgctgtcatgctattagtcttcttttttttgtagaaattggaccaactctatgttctttgctggcccgtatttctcctattcagtgatgtgttatgaatatctgtttaagtcaatgtatgcaactctttaatatcattttaaaaggttacgacatacgatcatatgaaggcattagaatttattccaacagttcccttttgcacatttaataatttccattgatttgccaggaagaacattctcgtgtcatggctaaatccttttgtatggacatccttaattattcccttaagataaacttttaaataaagttgctagattagtctcgtttcttaagttcctttttggtagtttatatgtaacactgtagttttatatgtacttacaaatacctatagtgccagtagaaaatgggataaaattaaactctttcacatatgccaaatatattttgatttagcgctttattaagtgcatgattacagtctctgtatcttttgatttacctttctatctttacaattttcagccgagacacttagcggtcacataataaattaaggttttctttttttaataatctccatctttctaaatatggtgagtcacagtcagctatttttggattgttgaaagctgtgactgttctaaatcggagcccagaaatcatgccacttaccaaatatgctttgtcttccaacatcagagtgtctggtagaaggtgactgttcttggaatttaaaaaatctgaacaggacaagacaagaatctggacactttttctgtttctgataatatgattgagtaggtagacatgctggataatccttgcaaagacatacttgaacttccccaaaaaaaaaataaaatccagaatctctaagaatgaagatggagtgaaaatcagaagggctgctgagagaataatggggaagcagccccagttatcaagggacatgtccatgtgttcaatagaaagtttcagatgtaaaaaaaagttgagaaaaataatatatatattatatataataaatgatataattgccctacatatacacatcatcaacaatttttcattcatggtatggacagtttttttttttttggttgttttttgtttgtttgtttgtttttaaaggtgggattttgctgtggttgcccaggctggagtgcagtggcatgatcttggctcactgcaacttccacctcccaggttcaagcgattctcctgcctcagcttcccgagtagctgggattacaggcacccggcaccacatccggctaattgttgtatttttagtagagatggtgtttcaccacgttggccaggctggtcttgaactcctgacctcaggtgatccacctgcctcggtctcccaaagtgctgagactacaggcgtgagccaccacacctggccacagccagttttgtttcatttacattcccacttcatttatatacattccttcttcctctgaattattttgaagtaaaacctatacatcctatcatttttaattaccttatatgtatctgtagaagacaaggaattcttaaaaataaatatattcacaatgccattaaatatcaaaaaattaatattctgaaaatagccacaaatccagagttgacattttgttgactttctcataggtgattttttttctagtttatctatttcaatcagataactgtttgctcatatttacattccttactgaacaatgtctaaacttaaactgacataaaatggagatgatcttctaaccagatgcttagtgtaagaaaaaacttcaaactgcaagaggagtccctccaaatacagaaaggatcagtattttaagaggtatgttaactaaaatgtggcaatgtaaggagcaaagcaggaagaacctttaagtcctcaacttacaagtcaatttcatagtcagtttccctggtccttccacaacaacctcccccatctgttttctctacaatggaggtaacaatagtagctattccagagcaggaaaaggcttagagcagtgctagaagagggtcgtggctatataaagtttagctatttgtatattgtaacaaacctacaacttttttttttttgtcaataatacatttcttttggaaaagtggcaccctcctgtgggggacacctgcagttccactaagcgaacatcggtgtctgctaacctttgcctctttgtctctcaataatatactgtcaagctgttccttgatttagcacttttgtatacttttttttttcctctcccgtttcctgagacacagtccctctctgttgctctgtctggactgcagcagcgccatcatggctcactgccacctccacccccgggctcaagcaatcctcctaggtcagccttgggagcagctgggactacctgtggggcggctaatctttgtggtttttgttttgtttttccgttatgggaccgggtttcgggccaggctcagtgactcacgcctgcaatcccagcaccccgggaggccgaggccggcggattacctgagggaggagctccagaccaccccgaccaacatggagaaaccctgtctctaccaaaaaaaataaaaactaaacaactaatggggtatggtggcacatgcctgcaatcccagccactcaggaggcaccatttattaatctttttgacatcagatgctcagtggctcacacctgtaatcccagcactttgggaggccaaggcaggtgaatcgcttgagccgaggagttcaagaccagcctggccaacgaggtgaaaccacgtctctgttgaaaatacaaaaattagccgggcatggtggcacacacctgtaatcccagctactcaggaggctgagacaggagaatcgcttgaacccaggaggtggaggttgcagtgagccgagatcacagcattccactccagcctggacaacagagtgagactctgtctcaaaattaaaaaaaaaaaaaaaaaattaaccagccatggtaccacacacctgtagtcccagctactctggggctggtgggggaggactatttgagcccaggaggtcgaggctttagtgagtttgatcatgccactacactctagcctgggcggcagagtgagttcgtgtctcaaaacaaaacaaaaatagtttccagccaggcgcggtggttcacgcctgaaatctcaacactttgggagtccaaggtggcgcatcatctgaggtcaggagttccagaccagcctggccaacgtggtgaaaccccatctctactaaaaatacaaaaattagctgggcatggtggctcatgcctgtaatcccagctactcaggaggctgagacaggagaaccgcttgaacccaggaggcggaggttgcagtgagccaagatcgcaccattgcattgcagcctggggcaacacagtgagactctgtctcaaaaaagaaaaaaaaaaagctaggcgtgagaagtgccttgattttgtattttcaatctgccaatacttgcacaggctctggctgcaaaacttttgccggtcaaacattcgcatttgagaaaccacgtccctgctgagagatagatctagacacagccttaactacatcatcagtagacacatgactggttttctttgtttgtttgtttgtttgtttgttttgagacggagtctcgctctgtcgcccaggctggagtgcagtggcgtgatctcagctcactgcaacctccacctcctggattcacgccattctcctgcctcagcctcccgagtagctgggactacaggcgcccgccaccacggccggctaattttttgtattttttagcagagacggagtttcaccgtattagccaggatggtctggatctcctgacctcgtgatccgcctgcctcggcctcccagagtgctgggattacaggcgtgagccaccgcgcccagcgacatatgactgtttttaaccagagggaggaaaatggctttcagatggttgtgtagctggttttaacagccttcagcagcgacactggcagcctccgacctctcagaccgagtaagccaagcgaagcctgtaggcgcacgcttgcagctcagcgcccgcggggactccggaagcctctcccaagtggcgcggtccgcaaggggcggctacagcttgggcgcaggcgccgctggctcaccggttctcttgggctcccctgggacgccgtaggatcgcaggcgcgcagccctcccggccgctctggccgccctgctcctcctttgaagaaagatagggccgctggcaggggccctccgcagccaccggggatggggctgaggccagtttttgtttttagtgcagccgccgccaggccgaccgccgggcttggctgcagccacggcgacactggcccgagttctgcgaggctgggggtgctggcgggcttggaggttgcctggcagctgctgcctgcaaaaagaaaaacaaacaaaaaagcagctgcagcttgggcgcccagggctagcggggcatggcctgggcagtcttgggattgcgagcgcgcgcggcctgagagtccgtacccttcgccgtgcctcctgccctcctcctctgccggacctcagaactgctggccaggccgtccgagggagtccggaccccactccgcagcctacagagatggggttgagcggcaggttctcagttctcgcccctctgcagccgccgccgggcagaccgcctggcttggccgcagccacggtgacatttggccctggttctgcgatgctgggagcgcgagcgagcttgggagttgccaggcagctactgcttgcaggcggagggcggctacagcttgggtgtccaggcagtggaacatggcctgggcggcctctggatcgcgagtacaccgagcctgagagcccgccaggccctgcccccgcctctgccagagctcaggaccgctggccaggggccctccgcagccaccggggatgggattaagtggcaggttctcgcccctgtgtagccgccatcgggcagaccatctggcttggctctagccaccgggacatctgtccccggttctgagatgttacgagtgcaggcgggcttagaggttccccagaggctgctgcctgcacacagagggtggctgcagcttgggtgcccaggcgggctggaggggcctggcccgggaggcctgcggatcgccagggcgcccaggctgagaagccccaagccgcgcatcccgcccggctcttccaccacagggagacaggagctgctggcatggggactccgcagtcacctgtgatggctttgagcggcaggttctcagttctcactcctgtgcagccgccgggacatctgaccccggttctgcgacgctggcagcgcgaccgggctcgggagttgacaggcggctgctacctgcacacacagggcagagggcagctgcaccttggcctgggcagcctccgaaatgcgtgcgcgccaggcctgagggcccccctggtggtgccacccgccccgctcctcctctgcaggagcctggagcagctggaatggccactctgcagggttatggttaagtattcttatcccatgcatgcacacaaaaaaggtaactattatgcgaggtaattaatatgttaattgacttcattttggtaatcatttcaaaatgcgcatgtagatagaaacatcacattgtaaactttgaatatgtacaatatttatttctcaaatatacctcagtaaagctgaaaaaaaatgaacaggattgaaaggataagcacacagttctataatagtagttggacacttcaatacctcattttaattaatggatagaaaaaccagacagaagcttcatgagaaatagaagacttgaacaacagtataagccatttagagctaatacacatatacagaacagtccaccccaaaacagcagaatatacattccttttaagtggatatggaactttctctaggataggtcatatcttcgtccacaaaaatatgtcctaatcatttacaaaagttttaaatcatacaaaatataatttacaaccacaatggaggaaacataaataaaaaatgaaacctgaaaaattcacaaatatgtagaaattaaacactacactcttaaactaccagtgaaagaataaatcataagtgaaattataaagtatcttaagacaaataaaaacaaaacataccaaaacttagtgactgcagtgaaagtagagtttgaaggaaaatgtatggacataaacaactacatttaaaaaaagctcaaatcagtaacctcactctacacctaaaaggcagtataaaaaccagagaaaactaaatctgaagctagcagaagtaaagaaataataaagattagagcataaatcaataaaatagaaggttggaaagcagtagaagaaataaacgtagctaaaagttggttctttgaaaagagtaatctcacctcagtagcctaagattcttctttaggaacgtagagaaagaacaacaacttaaatctaaggaactaaagaaaggagctaataacaattagggcagaaataagtgaaattcaaaaccaaagagagaaaaagggaaagagaagagagactacagattactaacagcaggactgaaagacaagctatcaatacacactataccataaataagtaaagctaaaaataattttatgcacacaaatctaatagatgagatgaaaaaaataaattcctctagagacacaacacatactaccaagtctcactgaagaagaaacaggtaacaaatagtcctgtattaattaagaaattgcatttgtaaataaaacctaccaaaaaatctagtcacatgttctttcactactgatttctatcaaatatttgaaggataaataattttgactgtacacaatcttttagagaaaatagatgagatgggagcactcccaactcattttataaggccagcattacaataacaccaaaaccaaaaaatgatatggagagaaaagaagactatagacaaatatcagtcatggacatatatgaaaaaatatcaacaaaatattgtgacatcaaattgaacatctccccatgtaggatgattcattatgtccaataaaaacaaggctgattcactattaaaatccaatccaagtaatctgctatagaatatttttaaaatattcttctcaagagatgcaggaagagcattcgatgaaatccaacatctatttctgaccaaaactcataaaattaggaataaaagaacttaggatatatgtttatatctgtatactatatggtgatgactgaatgatttttccttaagactggggacaggtcctattcgatattgtattagaaaatttgcaaagtgcaataagacaggaataagaaataaataacatacatattgcaaaggaagaagtaaaactgcctctatttgctgataaaactaatctttatatacacagtctacagtatttatgaaaagcttctaaaataaatacgtgaaattaagtgttttattatcaaaggtcaatatagaatgtcaataattttcctatgtgtgagtaattaacagttgaaaaaattaaattactatttaaaatagaagcaaaaattaagtgcttaggtattaatgtaacaatagaagtgcaggatctgtatgctgaaaactacaaaatataaatgcaataaatagaaaatttaaaaagaggggaatgaaatatttatgaattcagagtctcaatatagttaagatgccagtcttttccatttctgcttgtagagttccttcattaacaatgaaaattcctgtaagtttttttttttttgtagatatcaccaaggagattctaaaatttacatggaaaacaaaataactagaattgtcaaaacacttctgaaaaaaagttagaggacataaactactgattacaaggcttactattatgctacagttctcaaaatattgtggttttgttaaaatattgttaaaacactagatacgtagaccaatggaatgaatacagaccccagaaatagacccacacaaatatattcaactgcattttgaaaaagatgcagaggaaaaggggaaagtataatctattctgtaaatggggatgtaataatgggatctccccatgtaaaaaaaaaacgaaacttaatgcgtattttacaccttttacaaaagtggactgaaatagaccatataaaagtgtaaagtatacagcaataaaatactatcataaaacaggggaaattaggtatgactttggggtcattgatgagtttttagataaaacaccatacacatgatccataaaagaaaaaatgaaaaagcagactttgttatatctaaaaatgctcattctgtgaaagaaccattacaagagcaaaaagctaaaacaatcagggaaaaatattaagtcactgtattagtctgttctgctgctgctataaagaactgcttgaggctgggtaatttaccaggaaagaggtttaattgactcacagttccatgaggctggcaaagcctcaggaaacttacaatcatggcagaaggcaaacaaacatgttgttcttcacatggtggcaggagagagaagtgcttagcaaaggaagaaaagccctatataaaaccatcagattttatgagaactcactcactatctgagaacagcagcatgggggtaacctgcctccatgattctactaccttctgccaggtccctcccacaacacatagggattatgagaactacaattcaaaatgagatttgggtggggacacagtcagaccatatcagtcacgtatcttatacaagcttttatccaaaatgaataaagaacccttaaaactcaacaatacaaaacaaacaatccaatttaaaacaagcaaaaatcttgagcacgtacatctcaaaagaagacagacatatggcaaataagcatatgaaaacatggttattgttattaataagggaatgcaaaacataactacaatgggatactactacatgccattagaatagaaataaaaaattaaaatatcaagtgctcctgaagatgtgtagcaacaaagattctctttcattactgttgggaatgtaaaatgacatggtcactttaggagataatttggcagctttttataaagtaaaacatatgtccagtgtgaggttcagccattccactcctatatatttatcaatgtgtaatgaaaacaaattcacataaaagcccgtagtctaggcaaatgttttagcagctttacttataatctccaaaacctggaaacaaccaagacatctttctttttttttttttcttttttgagacggagtctcgcactgtcacccaggctggagtgcaatgtcacgatcttggctcactgcaacctccgcctcccaggttcaaggaattcttctgcctcagcttcccaagtagctgggaatacaggcacccaccaccatgcctggctaattttttgtatttttaatagagacagggtttcactatgttggccaggctggtctcgaactcctgacctcatgatctgcccgccttggcctcccaaagtgctgggattataggcatgagccaccacacccagcctaaccaacacatcttacaacaggtgaacagatagactattgcatcaataccatcaactgctattcagcaatacaaaggaacagactattcacttacacaacagtacagatgaacttacatgtgttttgctgtgtgaaagaagtcagccccaaatgtctacatattgtatgatttcattcgtataacattccggagaaggcaaaattataggtcaagaaaacagatcagagtttgcccacaattgggagaaagggaagggttgatcacaaaggcatcacacacagaattttagggtgatgcggctgttctgtgcagtgctggagggtggacacgtgtctctatggtttctcaaaccctaccaaatgctacactacaaaacctctttcttattttttgcaaaataaaaataataataaaaaaatccaccaggaagtcagaggattccaagaggaaaaagaaactgatcaaagacactttggaaaatggtattttgattggatactctaaggttaagaccaaacaagctgcatagaaacactccactttggttggtaattttgtttatcacaggggcaaatgataattttgacaccaggctagaaaaaataagtaagtaagttgcagataatgtgagctagagtttttactgttatgaaatgactttttcttgtagtgttgagaatgtttctttttttttcccaatcatgtgttaattctccccaggattctcaccaacctattcaagtatattttaaaatacttatgattttaagacaaaaacacatgtgttttcagcccagttggagaagcctcattactatcacatcctttgtgttctaaatgaaagtctgcacgtaaaacaacaaaggagcatgggaagtgttggaaaaatataataaggaagacagactccctggggaatgacacagtggtatgttccttgggtctcctgttcttctcatctgccctggagagagtgctgcagaagcctccaaccagaaaccacacccaacaaaaccaaacctaataaaaccccagctgtctcagccaaagaacctggaaaataatggcctagcaaggaatacccacctgagtgtagccaaacatcaatggaaaccccctctgcgaacaccatagttcagtgaaatcaagtgtggagctgatgatccacttcacttacacagagtggaaggaatcagcagtgctctgattcccttgccggatggtgtcagtggggccaagaagggagataaatcttctgtctcccacattgcaaaagaaggtggcattctggtatttccattttttttttttttttttttgagacggagtctcgctctgtcgcccagcctggagtgcagtggcgcgatctcagctcactgcaagttccacctcccgggttcacgccattctcctgcctcagtgtcccgagtatctgggaccacaggcgcccgccaccacacccggctaatgtttttgtatttttagtagagacggggtttcaccgtgttagccaggatggtctcgatctcctgacctcgtgatccacctgcctcagcctcccaaagtgctgggattacaggcctgagccactgcgcccggcctacagttatcttaaatataaattgtgtacatgtgtcaattaaaacacaaggaatatcaacctgaacacggaaacacgatacaaaaatacgtacgttacttatctcaattgatgcagaaagagcatttgccaaaatatagcacagttttatgataaaaactttcagaaacctagaaatacaaggaaacttcctgaactttatcaagagtatttatcaaaaacaaacagctatgtcatgcttaatgatgaaagaatgaatggttttcccctcagggtggaaacaaggcagagacacctgctctcaacaatgctatttgacagagcaccgaaagttctagtcggcacaattgggcaagaaacaaggcatactgattgaaaaaaaagagaaagaaggaaagtggcctctattgcagattacacgattgtctttgtaaagtctcagagaaactaaaaaaagtcttgtagaaataatatttagcaagttcacaggataaatgatccatcctccaaaattcatcatatttctatgaactaaaaatgaatgtgtggaaactgaatatacctttacaattgctctaaagaaaatacttaggcataaatctgacaagacatgcagaatcaagatggcaaaaattacaaaatgtgcatgaattgagagaagaactaaaattcaaacataccttattaatggtttggaagactcacgatagcaaatatgtcaactctcttcaaattgatgggtagacttaatgacagtcatatcaaaacaccagctacatatttttatgcatatagataaacctattttaagtttatatgaaaaggcacatgatactggtggagagatggacacataggtcagcagaacagaatgaagaactcagaaattgacacaagtaaatatgcccaactcatttctcatttttgacaatggtacaaaagtaattgaaagagaaagaatagtctttttaacaaatgttactggagaaaataaacacaggctcaaaatctcagtgtaaaccttgcactttatacactaattaactagaaatggtttgcaaacttaaatataaaaggttgtactataaaccttttaggaaaagagttctaaagaagttattgggatctagggctagataaaagtcctttgttcttatttacatgtatcttttaatttttttttattttcagtaaaagatcaatgtgtacgtgtacttattctaaaaaagaaaaaatgttcaatgtgctcttccaggttaatagacaaatcaaatagactcacctttctttatgaacccatagtgtatcagtgatccagccattattgttttcctgagaggaaaattctctttatgctcatcacacttttggagcattgaaccagagggcctaacgtgaggtgaacacgctgccagtggaggtgagcaggaaggaaatttccaaacccaagaactgacagaaactgctggagagagaaagttacttgggcaagtctagagaccaattgcgttgtgcccttctctgtagaataataaaaacggagtattcaagaaaaaaaataggacaagtgatactaaccaaatgatgttacaacacacccatgtctgtatgtgtatacagacctatgcacatatacacacatagatatgtgtaatatgtgtgtatttataactgaggttaaactgttaggcaataagaatgcagtcctatttttctaccctctcttttctaacatctttcaaacagatgatgttttgtaagattttcaattattttcaataattaaaaaaatttcaaacagaacaaatatgcatgctgaattatttctcaatcccctgttttacatgtggctttaagtacgtgacctgttatatagatatttcagcatcttagatgttaaagtaaacacatagctgctcctcatttttggaagggtgtatttacaatatatgtgtctgatgcaagttgtatatttaaattacttaaaaatacatcttctttggtaagagtttttaaaaataaatttgtggcacattagaatgtttttaagaaaaattgctttttaatttgtattatctaaacttcagaattttactctgaagtatttcaaaacttacaagaatattcatatttgatctataaaataagtaacttagatggaataatttgaatttggaaatttctttataccactaaatttgaagtatcaatgccacatttatttttacaaattttccttgaaacattatattggctactggaaagagctaataccctttatgaaaatatgattttagtgatgcaacttatatatgaggtagattaggaagctttacttcctgtgcccattaactaagaagattttatgaaacaatttttaacaggggccacagtcagtaccgggagtgtggtcaggtggtgaggcacgcctccctcctcattgggcccaccagaagatttcagggttctaggagaaacatacccaggcatgcagagattgtcacaagggaggaagggccagggtggggaacccagcacagggggcctgccctcacaggggagtcggacaaggttttctgaggaagctgtgtccaagccgagatccttcccgctccatgtgctccagcacaaggcctgcaggaggagccctgtgagcaaggccaacctagaccagccgggtggattcccttggcattgagggggagcatggcctgaggagctgagcgcggtctccgaaggacggcatcagaggaactctcaccgtttctatcatgaacacttacagtttgacatcagcatgggagttgtgattgggtgatcttgggaagggtctgtcagcgggtcggggggtcgctctaagttggacgctgtctgatagaggaggcttttctattgttcggcatctcatatctcaaggaatcttatctagaagagggcagagggccgccaggagaaagccgctgctggtaatgaggaagatgctgctcattttcaccaagtgcagtgctagggattttagcgggtggcaaagtgaccttgatatcttttctctgtgcaggtctctgttagagtcactgtgagtgtctctgtggggatctctgtgttggttttgaagggtctccgtgtgcgtctctgtcagaggtttctgtgggggggtccctctggggggtcttcatgggggggggtctcagtgttggggtctctgggggtcactgtggggaatctctgaaatctcaatgaatgtggggtctttgtgggaatctttgcgtgttggggtctaccgggggtccctgtggggttcctctgctgcaggtcacaggatcctgggtcccatagatgttgggcccacactggagctgcccaggtcaccaccccagacaggacttggctccaacagtagcctggacacccaaagtgacaccagggcgtgttcgaaacaggtccccggtgtgggtcccgccaggcctgggtacagacctgacaccttgtcctcagcctctgcagcccctgcaggtgcagagctctccctgggcagaaggcccctgggcagagccctctgaggaactggctcctgcctgccctgcccttgctcctgccttccctggggatggccaggaaggacccagtaccaggacgaagggagtgcaggactgggccctgtggggactgtccctgccaaccatgtgaccagattctctgagccccaatgtgtcccttgccagcacctgggcctggaaccatagatgtgctttgtaacccaggccagcccttgccttctgggtccccctcccctggcagtggcactgaccacttttgcttgtaatggtcaccagactgcaaggaccctggttacagctgtgggcagcttgtggatcctgcacttgcaaacttatgctcgtcttccctgattcttctcccacctctcaccctgggccccaaggtctcctcctgtgattcctgaccacagagtcctgccagaggggcaggcagcagccctaggtgcctcctgaaacagacaccccacactagtgggctgggagactgccctggagagtgaggcaggggacaccagacatgaacccaggggtgttatcaagcctgagccaagtgctggaggggcccaggtccatcccagatccggaactcagcagtcaggaaagggtctggggagggtgtcatctcttccccaccaggagatcccagaaagagcagtcccccctctgacccagggccagcacaagacaccccctacattcccaggctactgtgaggcagggaggctgctgggatccatcactcctccagcctgaggggagcctaccaccccccagtccgtgacgcccctgtagacccatcccctacagcagcacagaagtcgccttagaacagggaatgcagtgagccagagcccgggtgggatctccgtaagtttgctgtccttacatatcctgaaggctctgggtcatgatccagtttggaaaccagacacagtgtggggacagggagaaaagggggtcctccaggtccctgtcagcttcctctaggcccagccattctggaagccgcactcaggaggagctgacactgagcccttgcctgcagcctagcatggaacagacagaagccaccacctctgcagggaaaacaggtatattgggaacttctccgtggaagtcaggaacacatggggactgttgtcacccacgcaggacaggtttgttgtgtaggcgtccagtgttatttggatagaaccccctgtctcctccaggagaggtgtgggaagcctggtctggttcaggaggcaagacacctctgtgtagacctcagttcctgcagctgtggatggggctgcccgaggtgcttgccactcatggcctgtggtggtggggaccagctggggacacaagctccctgggaggtgggggcccaactgctgtctctgtctctgatgcccttgtttttgacaggacatttgtggcccttgggggtggctttggggctgcagaccagccccatctctctgctatgttcctggtagtagtgactcctgtggcagcaggaaggcacattctcctgggcgtggaggtcgcctttgtggcgactgacctctgagggaccacgtccctgctgaatccccagtttgtccaccaggatttgccccataactctgatgatggtctgggcttcatcagccatgctgtccataaacaaccttgctgggccagacccccagctctggacagcatctgcccaggcttgcctttctgcaggacgtcttcctgccctgagcccctcttcctgggatgtagaccctgtggacggtgactgatctttctctggaagttgctttctggtggtgcctgtcccttctctggctgaggctgattgtatttcctttcttgtttgtctcctatttccctcgtgtgggcagggtggctcctcccactggcttgggaggtcctgggtcctttggacctgtgtccctgctcccctggtctgggcctcctgtgggccttgcccttgtccaaagagcccagcatcttctgactcttctgtggggccttcacttttgggctcccaggttcctgctgccccagtctgtcccctcccttccataggagggcacatggcccctgggaagctgtcgtgttcctcctactgagcacactctgggaggtggacagaggggcctaagtgggtggcctgtatgtggctgggagcatgtccacatggcggcctggaaggcacaggcctgtggcgccctcctggaggaggatgctggaaacacggcctggcagctgctcctctgagtccacctgcactatgagcgcaatctcactgacaacctgtgctttcaggcacagctgccctggatcctgagcaacacagattgtagacactgaggggttactagtggtccccagagtccctgtgctcctcagatccacctgaacacttcctgatcttgccctcacactggctcccaaggtgactttccaatcagggggcttttcctccttggcctccagtgcctccagggcatctctggcccttgcccactgggaccccatgctgagctcttgcagggctctgctatgacaggggtctcctggggacatgctctcagtctcaagccatgcctcattcccagccatttctgaacccacactcccctcgagtctgggtttcccggaccccaggacagtccctctctgccaggttctgcctacaaggttgcatatgggggactgagaagatgccctgccctcctgtccagtcagagaggcctctgattgctcatgggtgtcagctgactgggaccctcttgggaccctctggacttcctcctgctcagttggtggggcagggacagggccactcatggtgggggctgacttgcttgttgttctattgtctcctggaccattctggggaggttttcccgacaaaatggcaaccttggctacagattcagccagagattcccaggaggcccaggggagaatggtggagtgtgggaggggtggaggctgagcctcccctgactagacatttatgggctctaaggactgaagttctggaccccacctgtgcctcacacagaacttgaaaagatgtgcttccagcatctgctgggtgcagggatggaggaaggacagctcctgggaggtgttcacgtgggctttcccacccctccaggatgtcacctttctcgatttcctgtgggtgtcagacttgggaatggcatgtttggccatgaattaggagcgatgcacagacacagggatccagccctccttgatctcccccaccttcctgtccagatggacctgtggcttgttttccagatgctgcttttctgggtccctgggtgcagaacttactgattggtacttccagggcctcctgaaatcaccttctgcttcctccttgtctttctccagaaccttcactgaagtccttcctgagccttgatcctggttctggctctagtttggaccctaagcaccccttcccagagaaccttccagagctcctgagccctgctttctgcacatccttcgtgccctttcctacaaattcagaatcccgggagggcaagagggccccctgcgtggcttctgcctgactctggggcctccctgggaattcccccttaggctgcagcaggtctccaggtgccttgaatctgctgggaggccacgggactgctcctggtggatggcactccttccttgccaccggtgctctgggagctcagggctggtggcaatcccgggaaggatgggggctgacttagggttcagggaggctggcctctcctggggaaggtgggaagtgggctggctcaggacagcctgagactttttgaggagagagggcaaaaccctcttccactttggtcatttctgcaagggccactcaagatacttttttccagtggggatgacagactgtgccctcttctgggatgtagggcaagatgctccacagaccctaatctggggtggagaagaggttgggacaggggttgagatttgccccactgtgtctggatcccagctagaggcgggggctgggactggggccaggttggagtgaaaggttggggctgggccacgtggtggggctggggccgtgcctgggaaagctgtgagggtgtctcaacctcagtttcacctggaagggaagtggaggctttatccgatggtacagagtgctcattctgtgaggaaatgttcctagaaacccaggccatggtcaccagggactcgctattgaaagaggggagatcccagaagagatggctgcatttctgctctaagtggtcccacatggccatggcgtcagagacctgctgaggatggggcagcttctgtggtaggtttgccacgttccagaagggatttagagtcgtgatgtcccactccttccccagtgatgtcatctgcgggtagtctgcccacccccattctttctcctgccacatcttcatcactgctctcttggagatgagtctccagcagcttctgcacgttgggatggaagaatgtgcggccacctgcctccatctgcctgggtgtggggtctccccagaaggaagcctctggggggtggttgggaagatgctgttgctgggatttgccctgtgagcaggtggagaggccccaggtggtggcagcctccctccagcgggagaggtcccggatgggaccgctggagcacccaaggccagagatcaccctggttggagaaggtggcccctggttgtgtagaggggagctctgggggacagggcgtattgtggagccacactgaagtccagccaggctgtgttcgggtggaggtggagaggaggccacgggaacatggggctgtggtgaagaaggaaaagcatatgtggccggactgcagggcattttaggggaagcaagggctctggaggcctggaggcactcagggttgagcgtggtccaaaaggctctgagaaggtcattgtgtctggtgacaggttggaggccagaggaactgggggagtccttggggacaagctgtcaggagatggatcttgcatgcatttcctatgcggctggtgggccttagcaggagctggtttgtacatatcacccagggctctccacctaagggcagatgggagccaccctccccagtgagctttctcaggtggctgcacaaggcacaagctgcagccaggggcaggtggggttgggaggtcgggagggctgggcacctggtgcccacagctcctccacctccgccactgctggcttcacagagctctgtctgtgcctgcccagggcttcagtccactcccgcctcttcccaggacctccccctcccaggtcaacactggaccctggggctgcctcagaggccctggtagaaaggacgacatggagagaaggggaatctcatctttccagaaggttggtcaggtcctgagtctcctccagctccctcaggaggattctgcaagctggaagtaaggagacagagttatggcggggagggcggtgccagcgaacctcatgggaggctgagtggtggatgtctctttaggggacaccatggggaactagaccctgaagcccatgcatctgtgtccaaggccacatggccccaatggtgacagcaaggtgtgcattgtgcagaactttgtcatttgcaaaaagtgcttccatgtacaacccctcatgggtgtcacaaccatcttgtggggagagtggatggggtggtctctaagaagagtcagccatggccgaggagaacagctgtccacgtggacctggggtctccctgacctccccccatatcctggcaggccttggtcccttccccacagcgcccccttatgggcaataccggttcccgggcccatggcttcattcccacagggaatatgaggaggccccgggttctgatttccctcccaggagcttccctctcaggcctctgcaaatgattccctcagggacagacgatgctcagtcacctctggggagtctcagggattagtagggcctcacaattcagagctgggatcttcttcctgctcctgggcctcccctatctcttcctttgatgccgagaggcaagcaagggtgaggggctgggaccagttctcagtctcctcttcccagaccagctgcacacacgcagtgctcttgaaggacacggctttctgcctgtagctcagggagctctgcgtgcgtttcttttactcatgtttaccattgatgaaatgttttctgttttccttcttagggaaatgcaagcaggggttttctgtgtgactccaccctggatatccccagtccctgctcctccgctgaaggcatacccaggctcaggcctacaggcacctctgagctgccagtaggattctgcttcagaggaggccagacgtgaatccaggctctagcgggaggctctcaggggttcagcacagctcccagatcaccccacacagaggagcctggacccccaggcacctgccttggaaaggggctgatgagccagagctggggcctgtcctcccacagagacctcacccctctcctgatctggtcctcgccactgagtccagtgttgggttttgccctgatgcctcccgcgcatgtcacagatagtctgggagctgaggatggaatcctctgcccactcccacccctgcctgctctgcccttccctagagggatgatgagatttcccatcgcaggagagtctctcattacttaggaaaagtggaaatgaggggaggaaaagaagagagaatctttctctgtggggctgggctgagggctccttaccttcctgctgctcctcttcctcccatgcgggggtgagggtgggacactggggaggtagggggctaataggaagaggaagcccaggctccacactgaggtgaggatgaaatccacaatccagggagtggagctggggcccagccacgtggcactagggctcttcagaggaaagagcattttttccatctgaagtgcaatgttgccctcaagcaactgagccctgggcatcgcttttgggactagggactggagcccaggcctgcatcacagagctggggcctcctcctcaccaagggctcctgggggcaggggaggggcagtgggaggaggaggctgaagcgcagcccctccttcaggtcccagttccagtccctccaccctcctgggtcccccagatctttccttcccactccagttgctcaccctgtcagagacagccctgggtccattttctattctgttccctggaacacagatgttacctggttttgtggagatctctgtgccagtccctcaatctcctgcatctttaaatctagacttctccctggagtttctgttatttctccagtttcttgctcttaggaactcatttgtttgcagttctaactttcccccttaatatgttcttgccctgcatcaactcagacatagaatttacattttttgtacttattgatcgttgtgaattttgattacaattttcatagttttttaaaagtttaatatttatttttgtgggcacacagtaggtgtatatgttaatggggcacatgagatactttcatacaggcatgcagtgtgtaataatcacagcatggtaaatggggtgtccatcacctcaagcctttttcctttgtgttacaaaccatccaattatactccttattttttaaatgaacaattaaattattattgactataggcattctattgctgtcaaatactacaaatacccagttttattcattctttctaattaccttctttatccattaaccatccccgtctctctccccctgtgccttcccagcctctagtaaccatccttctactctgtatctccatgagtttgactgtttaatttttagctctcacaagagagaacatgtgatgtttgttagtctttctttgcctgatttcacttaatgacctccagttctatccatgctattgcaaatgataggctctcattgtttttttatggctgaagagcactccactgcttatatgtaccaccttttctttatcctttcatctgttgatggacactcactaggttgattcctaatcttggctattgtgaacagtgctagaaggaacatgggagtgcaagtatcccttcaatatactgatttcctttcttctgggtgtgtacccagcagtgggattgctggatcatgaggtagctctagttttagtttttgaggaacctcctaactgttctccatagaagttgtactgactcacatttccaccaacagtgtatgagggttcccttcacatcctcgccagcatttgccattgtctgtcttttggatgaaagccattttaactggggcgagatgagatctccttgtagttttgattacctttctctgatatcattgatgttgagcaccttttcatatacctgtttgccattcatatgtcttcttttgagaaatgtctgttcacatcttttgtgtattttttattattttattttaacttccggggtacatgtgcaggatgtgcaggtttgttacataggtaaatgtgtgccatggtggtttgctgtacctatcaacccatcacataggtattaagccccgtatgcattagttatttttcctgatgctctctcctgcttctgacaggccccacagtgtgttgttcccctacctgtgtgcatgtgttccctttggtcagctcccacttataagtgagaacgtgtggtgtttggttttctgttcctgtgttagtttgctgaggataatggcttccagcttcattcatgtccctgcaaaggacataatctcattcttttttatggctgcataatattccatgttgtctatgcaccacattttctttatccagtctatcaccgatgggcatttgggttgattccatgtctttgcttctgtgaatagtgctgcaatgaatatataagtgcattcatctttataacagaataatttatattctttgggtacatacccagtaatgggattgctgggtcaaatagtatttcccattctaaatctttgaggaatcgccacaatgtctgccacaatggttgaactaatttacattcctgccaacagtgtaaaattgtttctatttctccccaacctcaccagcatcagttgtttcttgactttttaataattgccattttgactggcatgtgatggtatctcattgtggttttgatttccatttgtctaacaatcagtgatgttgagcttttttccttatgtttgttggctgcatctatgtcttcttttgagaagtgtttgttcatgtcctttgcccactttttaatggggtcttttgttttcttcttgtaaatttccttaaattccctgtagattctggatattggacctttgtcagatggatacattgcaaaaattttctcccattctgtaggttgtctgttcactctgatgatagtttctttgctgcgtgaaactctttagtttaattagttcccatttgtcaatttttgcttttattacaattgcttttggcgatttcaacataaaatatatgcccatgactatgacctgaatggtattgcctacatttttttctagggtttttatagttttggcttttacatttaagactttactttatcttgagttagtttttgtatagggtgtaaggaaaagatccagtttcagttttctgtgtatagctagccagttttcacaccatttattaaataggaaatcctttccccattgcttgtttttgtcaggtttgttgtcttgcctagaggttacacactgaattaccatttggagatcatccattcccacctggtgtggatcaaagataacaggggccaacaggagaaagtttgagccttgccaggtcaacactggtgctgaacaaagtgacttgcgtctgttttgctacatgtattttgctttggctgggatggaaaatattaatttgattccccatgcagcctgttgagcagcatcttgcaaaattgggaagcttatgcctatggttccatcaaacagaaaagcataattttattttgtaatggaacttggctcccatagctatgttacactgagcaaggtcatcaaagctgctctgttcttctgaaagctgcagagaaagggaacccagaaacctggtatgctggcgaaaaaagggtaagaaattcttaccaaccaagtttctcatatttctctctctctccctgtctctctccctccctctccctctgtgtgtttgtgtgtgtgcgtgtgaatgcaaatggtaaatatcactgtttgtcttctctcctctgttttctcttttctacaaatagaaaaaaggatttgtgagactagtcttaggctgtagcaaatctggagcactttgtgctaagaatttatctttctgctttgttctttaatggagagagaggtatcacaggagagaaggtgggcttaggacccctataagcctgcctttcaagccagcctggcagctggtcatttacaaactttgctgggggtccccaagaccagtgccatataaagtttccatcttttcgttttatgcccttgagagcttaaccttgtgaccatgtggggatactttctcttggtgtctgccattcagcggacaggaatttggggattcatgtcatagcactaaaaattatcttgagcaggtagaagcttttgcaaggtcaaaattggcacctctaggctccttctgggaagagcaacagaacctgctgaatgatgtagctcaataaccaaggcttttgtcttttgacagtggctgccccaggttcaattcttggctttgggaatgattcccttcttgtttgttatttgtgtaactgccattttttgagggattcccccctttctatggataatttctgatttcctgtcttgaattttcctttctgtgaactaccctggggaaattctaactcttgtttaaaaaaaactacttaccatctctttgaaacacatcatgagttcatggttaagttataaccttagttaaaacttattaatttcatgtgagaggttacctggtatagaattcaaaagccagaaatgtggggtgtcctcactagagcctggtaataagggattttgaaagtttttttttttttttaaacagcagagctctatggttaaaagtggcttaattaaaaatagacatccagggttgggtggggtaaccctagatatctattttcatgcctgtaatcccagtacttcagaaggccaaagcaggaggattgcttcagcaggagtttgagacaagcctggaaaacatagaccacatcttaaaattaaataaataaataaataaaagtacccaaactatatctatttaaaaggcctttatcttttcctcttctagattcatgtctttctggaataagttcttttcttctgaattgattttctccattttttcttcttgccatgcttaaagcacacctgagagaacctagataaattctaacagcctgggactcatagggaaaaacagaggaggcatcacagaccccattctgggaaaaacctccattttcctcatgaaaccccaggagctgaaagttgatagatctccctcaaaatctaagtctcggttcaattttcaattttacattatgttacctgactttttttgttttttttttttacttttgggtatatcagaaattgcttcacattatgggagagcttttagccatggtttataataaccagataggaaatacactataagggactgctaatggcaattaggaggaatacttggctccttgcatgcttggatcagagaagcacactcttgaccacctagaaggtatgaaaacatccctatcccccactgagagatgagaatcccatgggggatgggctgattacaaaatgggctgattggctttggattgtcttgcaataaaatgcagggtagaagcactgcactagcttcttctgtagtatttccctctttttggggggaatccaggatcccatataaaatggcacccttaatttgggggatctgtttttgccttccagctgtgcctgcttattaggccctagaaattgcaagctttcccagccctatttttcaaagggctccagcctgaatctagtaatcccactaggaaacttaagaactggcaaatgaaaaatcttacaactactggatcttctgtctgtctatgtatttatatatgttttgtgtgtgatgtttacataaaagctctaattaattggtttaaagaaaagtaggcacttaagtcaaatattttgtcagtaaaattaaaactaatgccctttagttcacctaactttagtaatcttttggtaataaagacagattaaaaattattgataaaataggctgggcacagtggctcacacctgtaatcccagcactttgggaggctgagctgggcagatcatgaggtcaggagatcaaggccatcctggctaacacggtgaaaccccatatctactaaaaatacaaaaaaattagccaggcgtggtggtgagcacctgcattcccagctactcgggaggctgaggcaggagaatgacgtgaaccctggaggcggagcttgcagtgagctgagactgcgccactgcacttcagcccgggtgacagagtgagattttgtctaaaaaaaaaaattggtaaaataaaatgtcttcaaaatttagacatttggtctaaattgggtctgatgttaggtttgctaaatgctttaagatcataaactgcttctttaacttttaaaaattgttcaatttacctagcttggagtcattactttctagataaggcccggtgacatgtgaaattagccccctagctgctcaaagaaggttaaaaagaaaagagattttgtataagaaaggatcttgtatggtaaatttttgtcctaaagtgaaatgactggttgttgaaatgaccgttgtccaagcatgtaatagatggtctaagccatgaaaggattcatgaaagggaatttatgcaagaaacgttgtacaatttaaaggttattaggctgcctaaatgcttcacaaacgccactgtgactcttaactatacacttacctgcgttactgctaggtaagtgctgggcatatgtggagatagccacattccatagctatgctggaaaaagtcagacttgatctgcacttctgtcctttgtctgtcctaagctccacacttggtacataattaaaatgtcctactaaccaggtttttcaccaaaaatagaagttgcacagagttaacagtgtaacatgtattgaggctactgaagaaacatttccacattcaaggcatgtaagaaaagtagaatgtacttttggtaaaagattataagaagacctgggaatatggatttctttcccaagtttagagggttattgttttaagtgagacaggaaaagtctaaaggttttttttttgtttgtttgcttttgttttttgagatggagtctcgctctgtcgcccaggctggagtgcagtggcgcaatctcggctcactgcaagctccgcctcccaggttcacgccattctcctgcctcagcctcccaagtagctgggactacaggcgcccgccactacgcctggctaattttttgtatttttagtagagacggggtttcaccattttagccgggatggtctcgatctcctgacctcgtgatccgcccgcctcggcctcccaaagtgctgggattacaggcgtgagccaccgcgcccggcctaaaggtttaagcaagttgtgaaaagtttataaaaaattaattgtaaaagagattctgtgtgtaaacatattggctaaagttaaaggggtattagtcaatgtttccataagttgaacattggaataaaagcataacagagttttcttaaaacatggttctgctctgtaacaacaacaactaaattgtaaagggttataaaaggtttataagaacattaacttatggtcaaactaattaaaactggatagatttataaaattttaataaaaactagctttagcattaaaggtgcaataatgcaaacatgaaatttggttttctcttttgaaaaagattcttgtgtaatattgagaagcaatgaaaaaattttgtttgccttttaagggaggggagagagaagtgaccaattcaggggacggcttcactgggtcttgtagtttgagaagctgagtctcttttctatcaaactaaaggttttttcctttttaaaactttgtgagttatcattttggctaaataactgacttatggtgacctggcattctattttgtgacatccagtgttttaaaccatatttgacaaacctgacaagatcaaattagaagttaaacaaaaataggtcccctacagtccaaaaagatataatctgcttatttaatgtattaaaatcatgcagaaaacatggccaaatataaaatgatgtttaactttctttgggttatattcatataaatacgttattagcatgtgtttcaaaactgtataagattcttataagtttgatatgccttagcatatgttatcagtaataattataattgatacattaaattattgtgtgccacagaggttaaaaattttcttgttttataatcagctatgaaacttggatgggtgctcttgaatgcaagtttctgatagctttggagattgcaacattagaataaaggaaaaaacgttcaggactctcatggagagctgacttgttcaggaacattaagcagaacaagagtttactgaatggaatgaactaatagaaaactgaactaatcttttccttttttttttttgcttaaaatgtggctgttccttttcatttttcagagagccaagaaaacttttcttttgattacagcttttaacaactgagaaaaatatactcctgtgaacaaaatttggagcatgtttgtttctctctacctgatttctcaagaatctggaagctatttgcaagtattcttaatttatggcaacataattatttgcataagtgcaataagaatgttttcttttgcaacaggacacaattggagaaactgtttattttactaaggttttgactgggatggcatgcttttgtttaaggaatcaaacttgatttacaaagccaataaaaacccctagggtaaactggcctcataccttgtctacgcagtccctgtacagggttcctaacgtatggtaagtaaagaatgtcactttccaaaaggccccggaatcttaagttatcttgggatctcaagaagaggggaatgtacccaactcataggcatttgagggtacaaacccatggctgggatgggctttaaaaaaagtctatctaagactctttatgcagagttccatcaaagccaacttaaaaggcccatgtgaaaaataattattcttgctgtgctctttgcaaataatcatgccaagtataataaaattaaagtttatttcacaaacaaaatcggtcctatcaggatttgtttttaataaaaataagaactgaagagagaaaaaattgtttcaaaaactacagtacacctgttgttagttgtttttgaggatttttttttctgccatttagactgaatcctaaattttgggaggctacaagtgctcaaactaatgcttttaagtctttacttttaaaactgggaatggcactccttgttccggaactcattacttaccttattgtacactgtttgtgtaaatgtcgtactaaaactgtagatgagaatacgaatgcctttgtcatgaaagccttggaagctcagcctggcctgcgtgagtacactcaaacagctcagacagctgcaaagcagttccactcctctcaccttggggtcaacacctaccccactatgccccctgtctgcaggaagaatccagagtgatcgacggccttttcccatcttcatagcccacaccttaagaataaggtgctatgaaaccctaagggagggattgaaacagcctttgcaaaaattataactgagaaaataatgacagtgaaagagatcagacctaaccgactccatcttgcttctaacctttaagctgtccttgttcattcctgggcataggccgaactaacctcgggaaggaatttgcagaccctgcactccatggatcagctgacaccgcctagactggtaatctggctcaatcagttctgagatcctacccaggaacagaagatagcaaggaaacctcacttcgaccccctatgattccatctccaacttgatcaatcagcactccccacttctctagcccctacccgtcaaattgtctctaaaaacttaagctgagcacggtggcttacgcctgtaattccagcactttgggaggccgaggcgggcggatcacgaggtgaggatttggagagcagcctggccaacataatgaaacaccgtctctactaaaaatacaaaaaaacagctaagcgtggtggcgggcacctgtaatcccagctacttggaaggctgaggcaggagaatcgcttgaaccctggaggcagaagttgcagtgagctgagatcacaccattgcactccagcccaggcaatagtgcgaggctccatcttaaaacaaaacaaaacaaatgctcaagaagtctgatttgaataataatgaaactctggtcttccgcaaaaataaagtaaaaatacaggtaagttaattctaataaggtctattgttacaaagtctttttgagtttctatacagcagaacaatattacaagacagaaccttcaaaaaccacttcattgcaactctgagtccctaaggaaaagagaaaaaaatgtggaaaaatcaaacgcttttttaatggcacagaggtcattgttttcttctataattgcaacagcaaaatctagatatctgggtatatatacatgtatatgtgttttttacattttagatagcatgccattctccattttatgaaaatttcatatagaatacatatatttgaaatatgaactgaaaaacattaagcattaataaagaaaataatgaacatctcctactggaataacttaccattattgtttttatatttatcaacagctctagaactttaacatggacatatataaaagtgaccacttccttagaattccattttgagttctcgttttgttgtgttttattttgttttgttttggttttgttttggtttgttttgagacggagtctcgctctgtcgcccaggctggagtgcagtggcacaatctcggctcactgcaaccttcgcctccccagttcaagcgattctcttgcctcagcctcctgagtagctgggattacaggcgtctgccaccgcgcccggctaatgtttgtattttttttaggtttcaccatgttggccaggctggtgatttcccgttttgaaaagtaaaggtttcagccgaacggagacctactttctgctgtgtcacatcgccctctggtggctaaatggctttcttacacagtaaccccaaataataactatcatataaaagaactttttaaaaaatcgtgataacattaaaatgattagaaatatataactcataagcaaagtcacagcactatgatatttacatgtttatcacacgtcaaatacatttaaatattttgtgatgtgtgaatcttcacattcctgaaccacctataaagttccatttcccaaggttaaattgaggcaggatttttaaagacttttaactagctaacagagaaaaatgtacaatttccattaacctccccagtgacaagctttctcaagacccagcgaggttgtatgtgtgtttgtgttttgtttttgtttttgtttttgttttgagacggagtctcgctctgtcgcccaggctggagtgcagtggcgccatctcggctcactgcaagctctgcctcctgggttcacgccattctcctgcctcagcctctcgagtagctgggactacaggcgcccgccaccacacccggctaacttttttgtattttttagtagaaacggggttttaccgtgttagccaggatggtctcgatctcctgacctcctgatccacccgcctcggcctcccaaagtgctgggattacaggcatcagccaccacgcccggccgtgtgtttgtgttttaatatggtttttctgtgtataaaagctatacgtgttcatcttagaaaatttagaaatgacagaatttgattttgcttattctaaatcccttgggattatttccagtatagatggcagtgaggaaggaataatttcaggacactggctttcttcttccacaagaccccagctgggcaaagggaactggatggccttgggcctgtggccccagtgcaccctcctctggggcctgtacctggctctggatagtaatccccactgcagaatggaagaggctgctcccacataagccattgagtccagactccagaaacctgggtccgtgcagtactcaaaaaggaaagtaccgaccacccagaccagagctggcaagaaggcgaaatgggattgattcattcattcaacaaatactcgctgagctccagccgaatgctaggcaccatgttcaggatagagatgattgatgtaatccctggccttggcagtttggggtaaagagctatcatcactgctgacttcataacaatcacatgccttcagagataaagtgaacactcacttctaacaaagcaaaaataagaagaaaaagaaatgcacactcccgatttctttgtccaaagtggtatgactgggtgatttgtgaccttcccatttgcatgcccgattgccaaaaagcatggcaattaccccacacacctttactcatcccaaactaactatgctgaaaacactgcacaatggagatttcctttatgcctgctcaggcctaacagttccatattcactggcctggctgtcttctccaagctgaaagaggcagagccattaccagtatttttcttggaagggcaggaagtaaaaacacatctgagtaacactcaagaaaatattgtttatgtccaagatgatgaattaatctttttttattctctctttctcttttttttttttttgagacagtctttctctggcacccaggttggagtgcagtggcatgatcacagctcactacatccttgacctcccaagttcaagccatcctccatcagtctccagagttgctgggactacaggtgcaccttgcctggataaattttttattctttgtagaaatgggggctcactatattgcccaggctgcatctttattctttcatcccatcctcaactaaagtcatgttactgtaatagaagtgaaataccatagccccgtgtgcctcagcaggcaggggctgtcagcactcttcatattgctgagcatttcaaagctgtgttggcagctgttccacagtcgacttcagggtccctgagatgattggctcttggagatgatccagcagggttctggtagctgagctcatccaccaagtccacactggcagtgaaaatggcttctgggcttggggctttctgggcccagccccagggcagactgagtcaacacacgaaggacagccttctgcacccacagcagacaggggaggggcaaagggagacacgcggtcccagtggggcagggaggctagaacacggccacaccctttgcgagccacaaacatttttgctgagcacaaaattctctccagctgggcagacagaggaaaaaagcaaaatgaatgagtagagcacgtggcacatcatcagggagttccatggaggaaagtggagcaggtgaagggcaggacgagggacatggagtgccagctaggggcttgagaaagtgatggcaagagctatgtaaggctgacattgggatatggttctgaagggagtgaggatggtgacgtggctgtgtgtggaaagggaatgtcaggcgggggtgacagcagggataaatgcctggagagcatggctgtgtgtggaaagggaatgtcaggccggggtgacagcagggataaatgcctggagagcagagtggcccgctatttcccaggaggaaggacctgtggctcaagtgtcaatgaaagtgagcggagagggctgaagtcggggtaacagggccagcctgtgtgcagccccctggatgtgggtgagggagttgtctctgccgtgtgagaggaacagccacaggagggctttcaggagagcgcatggtgtgaggtttttcagactcactgtggctactgtgggaagagtgttttaggtgcctcccctttaccccactgggtgagcagggtttctgccctaggcctagggggatggctgcacacacacgcacgacacttgacagaggagatgagcactggcttattagccacatagacagactcataccccgaggaggagaaccccaggccatgcagggggaatccgcgggaatgaacagccctgagctcaggagagggtctacatgcattgcaattaaaaaggaaatgcagccgggtgtggtagctcatgcctgtaatcccagcactttgggaggccgaggtggacgggtcacctgaggtcaggagtttgagaccagcctggccaacacggagaaacccggtctcaactaaaaacacaaaaaaattagccatgtgtgatggtgcatgcctgttatcccaggtattcgggaggctgaggcatgagaatcacttcaacctggggggcagagattgcagtgagctgagatcacaccactgcactccagcctgggtgacagagtgagactgtgtctcaaaaaaaaagaaaatgcatgccgtcaagtccgctcgtgccgagatgaggtgtctccagttgtccagcatcacatcgcggtacagggtcctctgaacagggcccaagcgctgccaatcctcctggcggacccccagccacgtccttgaatgacactgatacctgtaattgtgcatttctcagcactttgggggttcggaaacagggacatggaaaacacatttgggatgtgattcctactatgtttattgttgcaaatctaaacaagttactgtaaggtatgcctattttagttctagttttgccttacgcttttggggtaactcaagcagtaaacatattttgaacatcgtaactcatttgtacatgagcgtgcattagatacatatactatcatgtactaagctaacactagtattgttttaaaaaattcttatttaggtgaaaatcagtgtaattagagttttcacaatttcctttccacactttaaaagatcatcttgggcattccctgggctgtacacaccctccttgaagatcctgctgtggctactggggagtctgtaaagtgatccatgtaaggcctgaatgtgctgtatcagacttatgtcaaagaagcaatgcttcagaagagtggacggtggctgaaggggaagccagaaccagagacctgaaaaagagatgaccgccttcactaaagcaacagcaatggggaaaggaatcggggactagtcccatggcagaagccgcaacggaatttgtcatccatttcttgagtggcttccctgaatgagtagctgggtcaatgctggtgccatctatagtattaagggaaagatggcaaagtcagagtctataaatgaggattctacggcagttctggaccttgtggaactttatgtctaactggaaagatccagaaatggcagttttcactaatctgcgaagtgcagaggcaggggcagcacgggctctgaggactgagatgaggaaggacaagtggaaagagaagaggatcggttttgtggatgaggccatcagacttgactcatgacaaaccaggaggaatggagaagctgatggggcagggttcaaggtccatgcagccccagtgagagcatgaggtgaagctgtgtcagaacagcaggatgtgtccgggatttagtcgcacctgagaataaagttacatggtgaacttttctcatcactttccccagtggacagtaaaccccactgtgggaaacggcattttcagctgtaactgtgcagatgccacacccctgggcagtcctcactctgcaggctccgattctcacagcgcccagtgatgccagcaaaacactttatcaggagtgtccaatcttttggctttcctgggccacactggaagaagaactgtcttggactgcacataaaatacattaacactaacaaaagctgatgagctaaagaaaaaaaatgacaaaaaatacctcataatgttttaagaaagcttacaaatgtttgttgggcctcattcaaagctgtcctgggctgcatgcagcccgggggctgttggttggacatgaaggggattcttagagagatttcactgcactgaatgctcacagtttatttacataacagttcaaactccagttatcactgtgccttcaaagtgcacacgtcgctcctagcacctctgcccaccagcctctacatgaacaccaggagcaagtggcgatcagtgaccaaccacaccactcccttcagaatctgcagggcccttccctccgcatgcacagctcggttcctgtacagacaacaccacgtgtagtcatcttgcttcttagattcctagtaataaaaccactcggaatgttacaaagataaaaactggaagagtggattggccaacaaagaggaaagtgcaggaaagaaaggaagagtgacagcctcggaagtaccattcagacctccaggaaagggcactgtggtgctgcctctgtgggtgctgacattgcactggtcaggaggtgcaccaagccaggctaggggccaccaagcctggcttttaatacatttttataaagaaataagcttgaactatcagtgtgtctaaagattttaaattacaatatatgaaataaatatcagttttcctgagtttcgttttcatgtgttcatatgaagacaatatgcaatggtaagagacatgttaacgtgtggataaaaaaattcaaaggttgcagaacactcatgattttctccactgattattaagatcactttatagttttggcttgcatggtcgttcttatagtcacagactactatgcgaagtgaggactatgtcgatataaggaaatctttgttggatagaagaacactaggagtttcaaaaggagacatgggaagaagtcatgtccccaaagtcctctatttggtactgagaagctactcacttcggtataaggagggggtgacagactttccagagggaggaggcattatctgagttcagacgaaagatgtgctgagcaggggaagagacaggtgacctggttcaggagagaaaacaaaactttgaaatatatttaagaatataaaaaactggccgggtgcggtggctcatgcctataatcccagcactttgggaggccaaggcgggtggatcacgaggtcagcagttccagaccagcctggctgagatgatgaaaccccgtctctactaaaaatacaaaaaattagccggactcagtgcaggtgcctgtaatcccagctactcgggaggctgaggcgggagaattgcttgaatttggatggcagaggttgcagtgagccaagatcatgccactgcactccagcctgggtgacagagtaagactccgtctcagaaaaaaaaaaaaaaaaggatataaaaaactgatagttttgacctaaaaacagcaaaactagaaagacccaatgcccaactggatgtggcaggagctgagagggcgggagggtgggttagggtgacattgtccccagggagcagggggatgggtgtgatgtgggagccaccccaagccgtccggtgcctggccctggggtgaccaggtgagggaatcaatattcctgcaggataagagccacataaagaaggtagtggaggggggagcctataggagcagttaatttgcttgtgaaaggcgtgtttatcacctctaagaattagctggccctgggaggagcagtctttccccagccagagaggccccagatgccagagcaccaagaacacagaaataaataaaaacatgggtaacgtatttgtctgtagtcaagtcactggtgggtggaagccataggcaaatggtttccatttgtgataatggaatttccacgagagaaaatgcaccaccaaacagggatttggaacatgaatgataagcgtggaaacattttgcagagagcaggatcgtaagctgtcaagagacttgcagatcacaagtattactatcttaatggacatccattctccctccaggtattccagactttatccccgccagaggcaagaacatcataaagacatcgacctccacttctggaagccagtactgagctctggcttgccacactgccttcctcttccattgaagagccagcagggacagcagcctgtgtgagctcagggttgtcactgcaaggtggttgctacatgacttacacaaagacatttttcagatttcacttttctttttctctcacgaggaatcagttaggtttatgcttcttatcaatgcacatatttaaacacatagtatccctcatggccttggctatctggcctggcctggctatctgagctatgctcagaaatagctttgtaccaagagtaactgtgtatgtctacatgccaactttgccttgcaattgatcagttctatgttttctctggttaattggaccattggactacatttagacacacagaccttgaacccccctacagaagccattgtaaagcaaggtggttggttcctaaacagatcacctgaaaccttctcattttctgttgttctggaaggagtgaggaggacaggaaggtgtcacagagcggggaggaaggagaagtggagttgagtgagacctgaatggtcttaccgctcctacatcgcatccacatgcctgaaaccctggaccctgggccaggtgaagtcttccctggggtgtactcttccttggcccttgagccgaagcaggagggccccgtagaggcagcacagcctgtccacccacaacgctcatgagtatgtggactcacatttgtagttttgcagagagttaatgtcaactttgttgtccattgacttattaacaacttatttctcctttgcacggaaaaaattcagagaattgataatatagattacagtagccaaagaatgaaacaacatggtatagaaaaaatagccttattgtttggctgcattcccactagcgctgttgagacttgggagcaccaggcaagtctctgaaaaggggatgaggaagccgaaagcaagctgcattttgcttggctctaacttcctctgggttttcccagtgaatcttttgttatgaagtttctggtcatttactgcgacagagagaacagcagagccctgaattttcctcctggccctgttgtccacacatgggctatcttagatatattattcattctcaagatgtctttcacctttcaagctcagcacctttctccagaagcctgctcctctgtgctgtgtttctggcctcagtgagtgaggacagtcacccagccatcacgcgaggaactcagcggccatctgtgccttcatcttccttgcagtcagaggatcactaagtctcactgttcttctttaaagccctccccatttctgccctgaattactgcagccgcctccctgctctgccatccatctgggcattactgccagggtaatctttccgtatgtgagtgctgctgatattggttctccaaaaggactgctgtggctcctgtctccttcggggtgagattcgagccatggagcagcagcttcagcatccagtccatttgttgggtctcaggtcctccagttttccttggattctccttcctcaccaatccaccgcacacttcactccaaccacacaaaacacagttttcagaacaagccacactgcttcatgcctcccatcggggtctctcaatctccgtattatttatgctcggggctggagagctgtgttgtaggggcctggcctgtgtgctgtaggatgttagcagcaaacctggcctctacccaccacgtgccaatagcatacccaccccccagttttgataacaaaacacctttggacattaccaaatgtgccctgaaaaatcatccccagttgaaagcagttgctctttgcttttacaaatgctggtccttttacctggaataaccttcccttcatactgaactcctacccagtcatctcttcgaaacttcaacccagtcatcttcaaagcttcaaaagtcaacccagtcatctcttcttctctggtgacctccttgctcaggcacagccagagctaatccttattttcctggtgaagccagcattctttgtaatacctctaaaatcaagctcatctcactatactggagtcttttgcttgcaagtgtctttctttgcactggcctatgagtgtccaggagaaatggcagagatcatggcttctttgtgccctccttgtctggggtagatcctagcaaggcacacacctggggaaagtttgttcaaagaaggaactgaattcatcttattctctcatgttaatggcaattaaaacatgttcctttatggtgatgttgacaccaatattttgtgtttactaagataaactctaaaccaaaactggagcctaattttgcttctgaggttctgatttagaatgctaaaaggaaacaggtgtgaaagctaagcacttattctacaggtgggaatgtcaatgatggggaacaaaatcaaaattccttatggagcccaaccaagccgtcgtttcttctcatcataaaactgatcttagcggcatttatttagggtctaatatatgtcatgctatactaagatttaatgagatcactatctgatttcccaaatctttctgaaacaaatagattagcaaattctaccataaacttacacaaattggcatcaacttttgaaaagctggcatttgcacataaattactatttcatgatgactctatgtacaacagatgtctgatgtattctcccagctctagaatagtcaatagaggaataagaatatcaaaattattaagcaaatccagaaagtgaaatttttacccaggcaactggtcttatcccttcaaaaatcgatgtaaatcactagacaaggaaaacacgttaccaaacactaaagaattaatcctggaaaagggaaacatacaggtaaatataaaatacttttatcttgcttttcataattttttatgaaataatttacagtttaagcaaaaataacaaagcatgatggtgtttaggacgtatgtagaaacaaactgtatgaaagtatggctgtggcatgtcattgaaacatatacatatatgttttcatccacagttccttgttcataactctcatagcccttgtgacagtaaacagaatctctctctcacaccttctcctgcccttctttcccctgcccatggctggattctgtgggtcatgagaccctcattccaaagagggttttgtctcataacctggaggaaggaaggctacacagagaggccaagaagaatctgaacacacaggccttgctgggtttagaacccattttgtccaatcacatttccacagtcacccatgcttcaatcaggcctatccaacaaattccccatataaagacccaagaggacagggtttggaagcttctggagagctgaacacatgaagggtgactaaaaggtgaagaactcattcacgtgctgagagggtggtgctccctgaatccacatggacacaagctcctgcacctgggacccttcaaaatcttccagacctcatcctgtgtgtatctcttcatatggctgtccatccgtatcctttaaaatgtccttcataataaactggtaaacaacataagcatttccctgagttctgtgagccactccagcaaattaatcaaacccatagaggggattgtgggaagcccagcttgaagccagttgattagaaattccagaagcctggacttatgactggtgtctgggggtggggaagtggcagccttgcagaacgggccctctctttgtgggatctgatgccagctctgggtagatagagttggaattgaactggaggacgtccagctggtgcccactgcagaggtgactgcctgcttgctggtgaggagaaagcccccacatactcagggtctcagaagtctgctgtgtagattgctgttgtgttggtgtggacgcagaggagaaacagttcgggtttttcctaagaatgacagtagcacaaaagatgggaggaggagatagaaatatattgttgcaaggtttttacaatatacgtgaatgggtatcatattatatgaaattaaatggtgataagtttaaattgcaaaatataaatccagagaattcttctggcccttatccaagaccatcaaggcagtacttctctgagtctgcaagaatcacagtgttactgggtttggggtgccccctaatacagatatggcttagactgcaacacccaagtcccttggaatacctggaaagctttcccagaaaggatgggtacaaacaagcccaactgcaaagatgacactgcctaactcttcaatgcccagacactaccaaacatccacaagcatcaagactctccaggaaaatatggcctcgtcaaataaataagtcaccaggagccaattccagaaagacagaggtatgtgatctttcagagaattcaaaatagctgttttgaggaaactcaatgaaattcaatataacacagggaagcaatttaggatcctagcaaacacatttaacaaagagattgaaataatttttaaaaatcaagcagaaattctggagttaaaaaatgcaactgacatactaaagaatgcatctgaatctcttaatagcagaattgatcatgaagaagaaggaattagtgagcttggggccaggcctggtgactcacgcatgtaataccagcattttgggaggctgaggctagcagatcacctgaggtcaggagttcaagacttccctggccaacatggtgaaacctcatctctactacaaatacaaaaattagccaggtatggtgatgggcacctgtaatcccaggtactagggaggctgaaacacgagaatcacttgaacccagatggcggacgttgcagtgagctgagattgggccactgttctctagcctgggtgacagagcaagactttgtctttagaaaaaaaaaaaaaagatttagtgaccttgaagacaggctaattgaaaatacctcctagtcaaaggagacaaaaggaaaaaaatgaaatagaatgaagcaggcctagaagatctagaaaatacccttcaagtggcaaatccaagagttattggccttacaaggaggtagagagagataggggtccaaagtttatacaaagggaaatttcttacaactgcatgtgaaatgaatctataattatacacacaattttagttgtaaaaaactagataaaatagtctttttgaacagacatttcacaaaagaagataaaaaaaggccaataagcacatgaaagattctcagcataattagttctctggaaatgcaaattaaaatcataatgagatactactacatacccattaacatagccaaaattacccaaataaccacccagaaaaataccaaatattggcaagcatacatttctgtatgagagaagcaaggatgtcatatatttaatggaaactatcacacattcctggtggaaatataatgcaatgagttttattatcattctatttatacatttttaaaaaagggagcaacggcaggtcatttacttataaaagtctcaaaatcattctaccggtgacttcctttcataaataaccactctctataaaacacttgccaagaaacacatggatcctacaagggtcgggtgttactcttatcaatcattattgataaacaattatgatgaggggacccaaagaaggcgatgtacccgctgtggcaccggtggccacaaggtggcgtgaatgtcgagcggctgccccagccacctagaaagagattggagcagccaggcttccagaagcagaggaggcctcacagagggcaccgagactagacaggaacctctcaccttgtgaatttccctaaagaggggtcttcctagataagctttgaaggaagacccagtacctacacagtaaggcacaagttactgtgaagaaatctacgtcaaactagatgaggcctatgttaccttaactacggcctcatttaccctacctaggacctgatggggcttaaattatcctacacccacattattctagatcagggtttcttagccctctcattattgacagtttgggctggagaattctttgactcctcggtttggggagcctctgcccacctgcccaactgtggcaaacaaattcatctccagtccttgcccatgacccttactgggcaaaattgctcacagttgagagccactgccccaaataaggcttaaattactagtaaggctgatattacaccaaaaccagtctccattttcttagatcaatggttcttaaactagagcctgcaaagaatccccgaaggagcttgtgaagctgcctacacctgagccttcccccggagttcctggtttctgtgtctaacctatttctagatgatgtagatgctgtcgatgcaaggacctcactttgagaagcactgtcccagatggtgactacattacccatacgcacatttctctaaagcctccatttccctaggaccaccttatcctaattgaggcttacaacagacttgaggtgttcatgttactatttttattattaaggtaaaaccaggaaattttcatagaaaagaattcaaaagcttctgaacaaggtattatatgcatagaaatacctcaacataacatagatgctgggaaacaaaggcattgtcagccttgggcatgaggaagggcagggtgcaggcagggcacaggcagggctgctggcttcagccctgggtcttctttgaagatggaaaaggaaaacaatagaagacatcagtttaaacaaatacttcagtaattttcatgttgaaattagaagagcttctgttgcactttgggaattgctactttattttgactctagatatgaataagcaaatagcatgctactgcaatcaactttgacaaagacaaaattgtactggtgactttttcaagggcagcttatggaagacgtccgattacaaacttggtgaatggcgaagaatattcatccctcacagattttttaaaattatcttggtttttagtaaaaatcacgttgtctttaacagccacagacaccaaagaagttccaccacatcattttttcatatgattacggctcatttataagaatttctactatttcaaagtgtatttatttgtaactcaaaagaagatcagtctatttttctgcctactcggctgtagaataccaccctctactaatggctcattgactcaaggttaccttaaaggaaaccagacccagggtcaagaaggaatcaagccctgtgcatactcagtgctattcatgtgttcacagaatgattatgggacagacattgcacgtgggcatttgtttcatatttgcatcacgtggaggtttacatagcaaatattaactattccaggccaggcctgatggctcacgcctgtaatcccagcgcattgggatgcagaggcgggtggatcacctgaggtcaggagttcgaaaccagcctggccagcatggtgaaaccccatctctactaaaaatacaaagtgagccgggtgtgacaccacacacttgtaatcccagctggctcacagagcatttttctccaagcatctcaagcccagtatgaagtggatgtgtcctggctcagaatgttccctcagtgacagcaattgcttctcacaccacctcttacaataggaataggccttagaaaacccagcaatctattgggatacttcagcgcagcaagcaaggaatcactaaagccaccaggaggcccctcccctggagctccatatgcactgatacctccagacacatggcaagtgcaggaactgatggggactttggggcagcctcttttttttaggattctgtggttgaagattatatcagattagaactttatgcacagaccctgtttctcaaagcccctgcccccacactcacagtggaatatttgcacagtaacaaacctcaaatttgccctccttcctagtgtcttgccaatgaaaagtgcttccgactctgaccctagtcctgcttatgtttgttgttttgttgtttgttttttccaagcagagctaaagcaagctcagtactattggagatttggaaagtgccttcacattctttgccaattctcacctgagagccctgcagacgccccacgagaggaaaatctaaggtcattgagggaggggccgtgatcttggtcctgaagctgttgctttcagaggctttaaatcacttcactgtacttgacttgttctctcccattgcctttggtttccctaagttctagtccttagacagagcatgtgccttgcaaaacttttctctttaatccatcttaatcctagtgagcaggtgatatggtgggcaggggagcagtatatgttcaatgatttcttgctgtgctttctttaggctgtaccctttacaaggagtctccagtcatacagctgattttcctctgtcctctactccacctcctggctgtagcatacacagattattgtcttgaatctgaccccagttgtttattaattataccccttttcatgacacgggaaggctaagatgaagctgtctgggatggaaaagaatcccttcctctcacatagaataaagatcttgaaaagtattttttctttgtagggtctgtctggagaaagttctgggcatatttatcagaaaatagttctcctgatgacagagccatgagggcatctgtttgaattctcgtcttgagaacccagaagcttttggagggaaattccataaaagtgtgaggtgtgtggcccccagttcttaccctaccctttccctgcttctcctccaggcatttatggaattaccatgtaactcttcgcaccagcttgtgctttcaatggaagaatcacccaatctatcaatttagaaaggagattttatttctgaaaaagggttggagctgcaggacggccatcttaacaggctggaaagcaaagcctcccacagagactgtgagcaggcacttcaagagagggaaagacaagaaatgaattcatgcgaatggattggccaagcgtacacactcagcaggctatagaaggacctattgatagtcacatgacaggcaggctctcatgtgtaataagcaaacacaaacgttacatgcatttcatatttgcttttgggtgaggacatgagaactagacgaattacaatctggctctgtacacgaaaacggctttgtgcaggggcagaaagacacacagtgcacagcctccggaaattggccaggacaagtccatggtcagtctcagctctttttcctcaacttcagttctacctggttccacttcagcactgtgcctggaaactcccttaaggaagcatctgagcgtgcattcatcagaggactccttttgtttatttcccacctctcagcaattactgtccttgttacctgttgtcacacatcataaaattgaatttaagaaatttcactatgttttacaagtatttctggtggaaagatacatctggtctctgttgtcaaacctagtttgaaagtgatcatcttgcacaaaaaatattagaattaattttatgatgttcaccaagatttatcttggaatgtatacaaatattcaaccttaaatttcaaggtatcacaaaattttgttacatatatatatatactctatatatagtgtttattttgtcttacatatatattaattataccaatagaattatatagtgttattttgttttatatatatataaacattatatatagtgtttggtatatatatagtgtttattatatataatatatatagtgtttattttgttatatatataaacactatatatagtgtttggtatatatagtgtttattttattatatataatatatatatagtgtttattttgttatatatatataaacactatatatagtgtttggtagaatatcatacctaattttaaaatattcaaaatatctatatctgtcacataagtaaagcacaagctctacattgccctaatagaagagcttcctatttgtctttctcccacaatgtcaggggatgaaagcaggtggtccccactgagagtacttcctggattagatccttggaatgtcagtttcctgcctgatcatctcattttcattcctcaaatcagaacatgaattccatcttgagttaacttctcctccagagtatgaaagcatcattcctgctgcttctcctctaggctgattcaacaggatgtgcttcatcttttgcactgtgaagatattctttggggtcaaaagccccttcctggctatctggttgtctggcgatgcgctcattattgtccctagaaccttcctgtatcctggtccctggagtatgctcttggcctgggggttcagttccttcctgaaacatgatgttttgctcagctccagcatgaggctgtagaactggctcagttcctaatcctggaagctgggaggagtttttcaggtggtagtggcacagagggcaggtctcctggacatacagccatttcttaagacagcctgcatggaaaaaatgaacgcaaggcgtgatcacagcagatttcatgtcccaaacagattcttatcgaaggagttacctgataacagatggcacaaatatcattgtgtttctcaagctgctctttcgtagcaatgggtaacgatttaatcttattcacagcatccctgtggagaagaaagctcttccaccccagctgggcctgaagccacacgttatagtaggaatgaatggatgatcattgagcccatcactgtccattctccaaagatggtctctgagacgcaataggccaccatacagacggccgcaagaaactccagcaggtggtaagtgccattcacatagtagatgacatcatccatgttttccaccggctcttttctgaattcctcaaccataaatcagacataaataaaaagtgttcccagaacctgaagagaggtaagaatgctgctggaaataatgataagaagccaaaaatccaggtggaaaaactggcaaatcatataagccatatgagcagggaataccaataaaaataaacaaagtcgcacagcacggaagtgtttccacaagctcttgtctctggatgctcccagtgccaaaacaataggatctgcaatttctaacatagactgtaggatagaagctgcaacaatgaaaaggataatactgagcaggaatgcccgatgaacaacctgcagttctatcagcccagtctgcactgccaggattaacagcgttactccttctgtcatgctccaattcatggcaggatcattcctgaaagctcgataaccctgcaagtaaaactcgcagagtgtgagaacacccaaggcaacaaaagaaaccgtgaagaccaaacccaaaagagagtaaggagtgctgcagcattctgcaatacttgtcagaaaaaggaaaagaagcctctcacgtgatgccggctgatctcgagtactgaaataggagtaaatctgaagagcaaataagatgagccagaaaaccatgaaaagaacagggactaccagttgattccacaaggacattcccaaggtgagaaggccatatacctccactacctgaaccaattctctgtatgcagatttagcaaggttataaggtagcaaaagattagacccaagaaaatagagaacttccaatccagtaaaaatcatagcaaatttattgatgataacaattgtctccaaaggaaccaggcagagtcgtgctagcagaggaagcacgtgagctgaaaacagccaaatctgctttgttttcatgacacaggagcataaagtacacaccaccaactgacctattaaggctgtggtaaaccgattcatagagagaggttctaaatacattggtccctcataggcaaaccgcagttcactccgaacgtagtccctggaaatttgatgtccagtatagaaaagcagagcagtcaaaaaatatagataaagctgaaccagatgttgcctgggcaatgttagcagcaccacacttaagatataacctcaggctgtggactccctccctggggagcggtgctgccggcggcgggcgggctccgcaactccccggctctctcgcccgccctcccgttctcctcgggcggcggcgggggccgggactgcgccgctcacagcggcggctcttctgcgcccggcctcggaggcagtggcggtggcggccatggcctcctgcgttcgccgatgtcagcatttcgaactgagggtcatctcattgggactggttagacagtgggtgcagcccacggagggcgagttgaagcagggtggggtgtcacctcccccaggaagtccagtgggtcagggaactccctcccctagccaagggaggccgtgagggactgtgcccggtgagagactgtgccctgaggaaaggtgcactctggcccagatactacacttttcccacggtcttcaaaacccgcagaccaggagattccctcgggttcctacaccaccaggaccctgggtttcaaccacaaaaccgggccatttgggcagacaccaagctagctgcaagagttgtttttttttttttatactcctgtggcacctggaacgccagcgagagagcacctttcactcccctggaaagggggctgaaggcagggagccaagtggtctagctcaatggatccccccctacagagcccagcaagctaaaatccactggcttgagattcttgctgcccggacagcagtctgaagttgacctgggatgctcgagcttggtgggcggatgggcgtttgccattactgaggcttgagaaggcagttttcccctcacagtgtaaacagagtcacctggaagttcaaactggccggagcccaccacagctcagcaaagctgctgtagctagactgcctttctagattcctcctcgctatgcagggcatctcggaaaaaaaggcaactgtcccagtcaggggcttatagataaaacccccatctccctgggacagagcacttgggggaaggggtggctgtggacacagcttcagcagacttaaacattcctgcctgctggctctgaagagatgagcagatctcccaacacagcggtccacgctgctaagggacagaccgcctcttccagtgggtccctggcccccatgcctcctgactgggagacacctcccaacaggggttgacagactcctcatacaggagtgctccagcaggcatctggcaggtgcccctctaggacgaatcagaagaagaagcaggcagcaatctttgctgttctgcagtctctgctggtgatacccaggcaaataggatctagagtggatctccagcaaactcagcagacctgcagctgagaggcctgacttttagaaggaaaactaacaaacagaaaggaatagtatcaacatcaacaaaaaggacgtccacacagaaaccccatctgaaggtcaccaacatcaaagaccaaaggtagataaatccacaaagatgaggataaaccagttcaaaagggcttaaaattcccaaaaccagaacacctcttctcctctaaaggatcacaactcctcatcagcaaggggaacaaaactggacggaaaatgagtttgacgaactgacagaaggaggcatcagaaggtgggtaataacaaactcctctgaggcaaaggagcgtgttctaacccaatgcagggaagctaagaaccttgaaaaaaggttagacgaattgctaactagaataaccagtttaaagaagaacataaattacctgatggagctgtaaaacacagcacaacaacttcgtgacgcatacacaaatatcaatagttgaattgaacaagtggaagaaaggatatcagagattcaagaccaatttaatgaaataaagtgtgaacacaagattagagaaaaaagaatgaaaggaatgaacaaagcctccaagaaatattggagtatgtgataagaccaaaccttcgtttgactggtgtacctgaaagtgatggggagaatggaaccaagttggaaaacactcttcaggatattatccaggagaactttcccaacctagcaagacaggccaacattcaaattcaggaaatacagagatactcctcgggaagagcaactgcaagacacataatcttcagattcaccaaggttgaaatgaatgaaaaaatgttaagggcagccagagagaaaggtcggtttacccgtaaagggaagcccatcagactatcagcagatctctctgcagaaaccctacaagccagaagagagtgggggccaatattcaatattcttaaagaaaagaattttcaacccagaatttcatatccagccaaactaaacttcataagcaaaggataaataaaaacctttacagacaagcaaatactgagattttttgcaccaccaggcctgccttacaagagcttctgagggaagcactaaatatggaaaggaaaaaccagtaccagccactgcaaaaacataccaaattgtaaagatcatcaacagtatgaagaaactacatcaactaatgggcacaacaatcagctaacatcataatgacaggatcaaatttatacataacaatgttaaccttaaatgtaaacaggctaaatgccccaattaaaacacagagactgacaaattagatcaagactcaagacccattggtgtgctgtagtcaggagacgcatctcatgtgcaaagactcaccaaggtctcaaaataaagggatgcaggaatatttaccaatcaaatggaaagaaaaaaaaatagtggttgcacccctagtgtgttataaaacagactttaaaccaacaaacatcaaaaaagacaaagaagaggattacctaatggtaaaggtatcaatgcaacgagaagagctaactatcctaaatatatattcacccaatacaggagcacccagattcataaagcaagttcttagagacctacaaagagacttagactcccgcacaataatagctggagactttaacacctcactgtcaatatttgacagatcaatgagacagaaaattaacaaggatattcagaacttgaactcagctctggaccaagtggatctaatggacatctacataaatctccaccccaaatcaacagaatatacattcttctcagcaccacatcacacttattctaaaactgaccatattattggaagtaaaacactcttcagcaaatacaaaagaatggaaatcagaacaaacagtctcccagaccacagtgcaatcaaattagaactcaggattaagaaactcttcaaaactgctcaagtacatgaaaactgaacaagctgctcctgaatgactactgggtaaataatgaaattaaggcagaaataaataagttctttgaaaccaatgagaacaaagatacaatgtaccagaatctctgggacccagctaaagcagtgtttagagggaaatttatagcactaaatgcccacaagaggaagcatgaaagatctaaaatcaacacactaacatcacaattaaagaactagagaagcgagagcaaactaattcaaaagctagcagaagacaagaaataactaagatcagagcagaactgaaagagatagagacacaaaaatcccttcaaaaaatcagtgaatccagtaggtgattttttgaaaagattaacaaaatagatagactgctagccagactaataaagaagaaaagagagaagaatcaaatagacacaataaaaaatgaggaaaggcatatcgtcactcatcccacagaaatacaaactaccattagagaatactataagcacctctatacaaataaactagaaaatcagaggaaatggataacttcctggacacacacaccctcccaaaactaaaccaggaagaggtcgaatctctgaagagaccaataacaagttctgaaattgaggcagtaattaattgcctaccaaccaaaaaaagcccaggtcaagacagattcacagatgaattcttccagaggtacaaagaggtgctggtaccattccttctgaaactattccaaacaacagaaaaagagggactccaccctaactcattttatgaagccagcatcatcctgataccaaaacctgtcagagacacaacatcaaaaaaatttcaagcctatatccctgataaacattgatgcaaaaatcctcaataaaatactggccaaccaaatccagcagcacataaagaagctgatccaccatgatcaagtcggcttcatccctgggatgcaaggctggttcaacatacacaaatcaataaacataatccatcacataaacagaaccaatggaaaaaaacacacaattatctcaatagaagcagaaaaggccgtcaataaaattcaacaccacttcatgctaaaaactttcaataaactaggtattgatggaacatatttcaaaataataagagctattcatgacaaatccacggccaatatcatactgaatgggcataaactggaagcattctctttgaaaaccagcaaaagacaaagatgccctccctcaccactcctcctattcaacatagtattggaagctctggccagagcaatcaggccagagaaagaaataaaggtattcaaatagaaagagaggaagtcaaattatctctgtttgcagatgacatgattgtatatttagaaaacctcctcctctcagcccaaaatctccttaagctgataagcgacttcagcaaagtctcaggatacaaaatcaatgtgcaaaaatcacaacaattcctatacaccaataatagacaaccagagaaccaaataatgagtgaactcccattcacaattgctacaaagagaataaaatacctaggaatacaacttacaagggatgtgaaggatctcttcaaggagaactacaaaccactgcccaaggaaataagagaggacacaaacaaatggaaaaatatttcatggacatggaaaggaagaatcaatattgtaaaaacagccatactgcccaaagtaatttatggatttaatgctatccccatcaagctaccattgactttcttctcagaattagaaaaaaaactactttacatttcatatggaaccaaaaaagagactgtaaagcgaagacaatcctaagcaaaaacaaacaaacaaacaaagctggaggcatcatgctacctgatttcaaactatactataaggctacagtaaccaaaacagcatgatgctgacaccaaaacagatatatagactaatggaacagaacaggggcctcagaaataatgccacacatctagaacatctgatctctgacaaacctgacaaaaacaagcaatggggaaaggatttgctatttaataaatggtgtatggaaaactggctagacatatgcagaaaactaaaactggaccccttccttacactttacacaaaaattaactcaagatggattaaagacttaaatgtaagacctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctgcacagcaaaagaaactgtcattggagtgaacaggcaacctacagaatgggagaaaatttttgcaatctatccatctgacaaagagctaatatccagaatctctaaggaacttagacaaatttaaaagaaaaaaaacaaacaacgccatcaaaaagtgggtgaaggatatgagcagacacttctcaaaagaaaacatttatgagaccaacaaacatatgaaaaaaaggtcatcatcgctggtcattagagaaatgcaaatcaaaaccacagtgagatagcatctcatgccagttagaatggcaatcattaaaaagtcaggaaacaacagatgctggagaggatgtagagaaataggaatgcttttacactattggtgggagggtaaattagttcaaccattgtggaagacactgtggcaattcctcaaggatctaggcctagagataccatttgtcccagcaatcccattactgggtatatacccaaaggatgaacaattaatccactataaagacacatgcacgtgtatgtttattgcagcaccgttgacaatagcaaagacttggaaccaacccgaatgcccatcagtgatagactggataaagaaaatatgtcacatatacattacggaatactatgcagccataaaaaagaatgagttcatgttctttgcaaggacatggatgaatctggaaaccatcatcctcagcaaactaacacaggaacagaaaaccaaacactgcatgttctccctcatgagggagagttgaacaatgagaacacatggacacagggaggggaacatcacacaacagggcctgttggggggtgaggggctaggggaggaataacattaggagaaacacctaatatagatgacgggttgatgggtgcagcaaaccaccatggcatatgtatagctatgtaacaaacctgcacgttctgcacatgtatcccatcacttaaagtataattaaaaaaggtaactttgcaaaatatttagagagatttattctgagccaaatgtgaggaccatgccctgtgacacaccttagaagaccttgagaacatgtgcccaaagtggtttgattgctcttatatctaatgtcttagagagacatttgacatcaatcaatacatgtgagatatgtgttgatttggtctataaagacaaaacagcaagaagtgaggcagtgtggggaggggattacagcttacaggtggattcaaagtttttcttattggcaattgattaaaagacttaaggttttatctaaagacctgaaatcagttgaaaaagtttctagatttagagagcgggctttggagaacaatattcttattatgcagatgaagtctcttatgtggccacccttagaggcaatagatggcaagtgttttctattaagacctttaaaagatgctagactctcagttaatctcctccatataacaaaaacacctggaaaggtaaagcgattctctacagaatgtaaatttctctcacaaaatataactgtgcagggcaatttaaaatatgtcaaaaatatactttagggcaaaagactttgattcctctcaaggcctgctgtcatgtgatgctattcttgagtcaggttagaatttggtatcttactgctacaaagaatctgttttctgagccttaagatctgtttgaatgaaaatgctggttagttgtgcttgaattccaaaggcaggagtgcataatgaggcatttctgatcctttcttgctaacatggcctaaactagcttttcaagtatctctggaactcctttttgaagaggaagggtccattcagccagttgggttgcttagaattctatttttagtttataggacatatatgagacttatcctaatcaggggtatcagaaaatattcattgaggtaatcactttaaagttgagacatgaaagatggtcccagattcctccctgcaaaccttctctcctgatactagaagaaaagttacaagaaacaaatgttaacatttcttctgtgttcaaaattgccccccattaggaaaataattaaacttgcaagacttatctttagaaacaagtaatctagttgatttctaaagtccttttacaaacccacagattctgattagtttacagattacatagagcatcccatctaatgggaatctgcaattagctggattcccctgcatttgatttttaaatgttgaatttatacagatacataacagttcaaaacctttatgtggtacatgtgatattttgataaaataatatgtgcagtgatcaaacctggataaccgggatatccttcatctcaatcattgattatttctttgtgttaaggacattctaaattttctcttctagctattttcaaatatacaataaattattaactgtagttgtctatgtaccattttagcattcccaacagcagtaagtgaaagttcctgattttcagctttctcttcaccatttggtattgtctatattgtttattttacccattttagcaggttagcagtattttttgaatattaaatgtacatttacctaataaaaatcaaactgatcactttttatctttacttttagatgtggtttctcttcaggtctttgcccattttaaaaataaattttgtggttttgtttttgttcaattataagtcaatttatatatttgtgataaaagcccttttccaaatattggatttgcaagcaaattctccaaatctatggctgatcttttcagtctcagttaagggtttattttcaaatatctaggttagtttgtccatctatgaaaagaggataatcttaattctaaattcttagaattattagaataataatgtaagttgaaattattccagtatctggcccttcacaagttttagtataacaccagtgagaaaaatttgcagattgttctgtgtagaccagaaatcagaaggtgataaaggggcaattagatttgaataatccggagatatgaagtgtatttggtattcacctccttctatttctctatgaagacaaaatggatagatgacctctccatgtgaaatgggacacataagtttttaagatgattctgaaagaaagttccttatacaatcactcaggtgatgttccaaacacagggctgtggaggggatggtggctgccggtggttgctgtcagccacagggttggtttgtttcccacaggttccagaaatagtttctaataacaaatgtcatattttgtttagaattgatttattttttataatttattttctccctgtaggcagcactcagaagtatgttctcagaataattcctgatcctctgtgagttcctggtgcagctcctggaggcaaagcctgcatgggggagggagtcctcctcacatgcagccctgaggctgccacgtcacttcacccaccgttgcccttcagtcacttcctgaacacttatgagttgatcttcctgaaacatgtggtatttggcagtgtctttcccaggtaagataatacttccattctgtttatccctgcaggcacctgtccctttctggaatataaattggtttcgattgtgtggtagtggataagtggggggaggaggtttgtgtgcatcttgtcatcttccagagtgcacccctcatggggttgacagtgacaagcatgcagatgggcttgctcagctggaagatgacaggcattttggtaacctgtgaccccagtgaggctctctcgctgcaagatcaatcaggctcaggcctctggctaaagtgcagccagcaaggggtccagtgcccaaccctgagagctccttccaggtaccaaaccactttctaagggaagcttttttcctgcctggatcccatgcatgtgtttgtattttcttcacaaaggcctttatccagaaacaccccccaagagcttatagtgttttgaattcaactgaagggcattattcatgaaagccctcatggccaaagtcttcacttctcattaaaggacattgattatgggattcaccagaagctgctggcctttcacaggcacagaccttcctctacaccagtggtccccaacatttttggcaccagggaacggtttcgtggcagacaatttttccatggatgatggcggtgagtgattatgggatgaacttactccacctgcattcatcaagcattagattctcatagggagcactcaaactaggtcctttgcatgcccagttcacaatagaatttggatcctaggagaatctagtgcacagctgatctgacaagaggcggagctcaggcagtgatgctcacccgccgctcacctgctgtgctgcctggtttctaacaggctgctgaccagttctggttcactgcctaggggttggggacctctgctgtaaatgcttggagaccttaccctctgggaaggggcatagaaaaacaagtcagatgagctccaaatcaatgtacattttatggattcttgaggaaagagtgcaaagaggaacgtccccacccactttccctctacctggcatcattcccagtaatccgcttgaggaacccggggtgtttcaagatagtttaggcttgttatactaggggacgccagaaaaggaaacaattaatgtgtccatgcgggtttgtcagttgcaagttattacttcagtgcagggtattgatcacggagaagtctgtgcgtatcttgggcaggaatacatgggaactctgtttcttctactcaaatttgctgtgatcctaaaagtgttttaaaataaatgtaatgtaaaaaaagtggcaaagacattttggaagaaatgttggccacttcttagaaattatgtttagtcttaccacgtgataaagcaatcctgctccaaatgatttatccattcgattttaaaatgttatgtccccacaaggcttccatgggagtgtttgcatcagcctgattgattgctgcctttcccactctgtgaattttacttacagggtgaaagttgaaaagactatttcctatataattagagtgtatacatctttctattgcttcttttcctcaattacttaacccattttctaaacacgtttaaacctcataaatcctgtcatcttctcacccccagcacagctgcctccttcctcaaggtttctgacactctcaggatgtgggttttcacactgcgtgtcttgcacattaatatacggctgtgtcctcagatctcaggctgctcagctccatgtaggctgtgtctgtagacgtgtcccaggtcgtggtgactctgccctggaattctgtgcatatattgtttcaccatcttcaggatcaacacgttccatccactcaagcccttttccaggggcctgtcgcccccagtgtatgtagtggaaggtgaaggtgtatctgggatcaccttcactgaggacccaggtttcctcacctcagccccagactgcaccgattggacctgggaatgggcacctgtggagaggacagagaagtggttgagactccacttaactggacccagtcccctcatcagccctggaacttaggattctcttccctgtggctgctgccaccaagaggaggatcctcccggtccagtccatggtgaggtgctgtgctctgggggcttctgtaggggagggatgtggttgttgtgtgatgctctctgggcaaggacagatctgtatgtacctcggtagacagcagtgcatttgcatattcacgaggcaggtatttcatagctcaagccacctcaacctgaggaagaagataggtgacacacggaccacgccacagtgggatgcagagctccctgccctgaactttgtttaatgatatttgccctctgttatgctcagaagtccatgaagacagaactcgttttacagaaaaccagaatctcccaggacattgtcctcaatgtcatttcttgttcatatggcaccctgacaacctgaacttttcctgggccttgacctctgcacatctaaattctgggatgagtgtatcttccgacagtaacacccattgaattaataaaaccactcttcaattcctaactataaatacatttgaaaagaccagacatttctccttttaaatgctgtttgcattcaattatttggttaggtataggctacatatataatagaatacttaaagacacatcagtacttactacattcttatttagattttaggttattattgctttgaaataaagaacattcaattcctgagagaaaacccctccccagcctcctgtgcacctgctccagggctggatcctgtgctgggtgcgccctgagcgccccctgcagctcagctcctgccctgcaggaaagttcctgtctgggctcatagagaattctcctcccagcgtctcaagcacagtatgaagtggccttgccctgactcagaatgctctttcaatggcagcaattgcttctcccaccatctcttacagtagcaaataggccttagaacacccgacataatctaccgggagacctcagcacagcaacaaggaatcactaaagccaccagggagccccttccctggagttctaggtgcactgatagggtccggacacatggcaagtctaggaaccgatgggaactttggggcagcctctatttttttttaggattctgtggttgacgatcacatcagattgtaactttacacaaagaccctatgtctcaaagcacccccccacacacacacacacatacactcacagtggcacatttgcacagtaacgagactcagatttgccctccttccaagtgtctcaatgaaaagtgcttccaacactggccatagtcctgcttgtgtttgttgttgttattttttccagacagagctaaagcaagctcagtattactggagatttgggaagtgccttcatgttctctttgccagttctcacctgggaaccctgcagatgccccatgagaagtaaatctaaggccattgagggagaggctgtgaccttggtcctgaagctgttgttctcagaggctttgaatcacttcactgtccttgacttgttctctcccactgcctttggtttccctaagttgtagtgtttggacagagtctgtgcattatcacacttttctctttaatccagattaatcctattggtgaggaggggaggtaatgcagtggacaggggagcagtatatgttctggaaattgacttccaatgttttcttgctgtgttttctctaggctgcaccctttacaaggagtctccagtggtacagcggattttcctccatcctccactccccttcctggctgcagcatccacagattattttcttgaatctgaccccagttgtttattaattataccccttttcatgacacgggaaggctaagatgaagctgtctgggatggaaaagaatcccttcctctcacatagaataaagatcttgaaaagtattttgtctctgtagcatctgttaggagaaagttctgggcatatttatcacagaatagttctcctgacgacagagctacgagtgattctgtttggactctcatcttgagaacccagaattttctggagggaaattccatgatagtgtggggtgtgtggccccccaggagttcttaccccatccctgtctacacctgtcctccagacatttatggaattaccatgtttccgccagcttgtgctgtcaactgaagaatcacccaatttattgatttagaaaggggactttatttctgagaaaggattgaagctgcaggacggccatcttaacaggctgggaagcaaagcctcccacagagacattgagcaggtacttcaagacagggaaagacgagaaatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattccaaggacccctctagctcctacactctgggccaaggtttcctctgagccgcagtcagcctagaggacctaggatacatcttccttggacagagacccaccataggggcagcaggaggtaggggtgggggtaggcaagattcctgtggggaggtggagctgtcatcagagatggtgtctgcaggcagtgggtgtatcgtggctctgctactacttgctgggtggccccatgacgtttctttccccactctgacctcagtttccctatctgttccgtggagataagatgcctgcctacatatttgtggactgggatgtgtgtgggccagttgcagtgtttcttggtgtggtcctggggcaggctgcaccaccccatagagatttctgggccccaccctaggctcacaggaccagaatctctgggaatgaagcctgggaatttgcatttccacaggcatctggctgattctgacatgactgaaaagcactaatagtatatagcaagctctttataaaaggtaaattcatagctgccttttactaaacataaatctcaccttcccttcctcagttaaggacacacaccgcagttgaaaatcactgtgcctttccagatgcagaatctgacctttccgataagattctgttaactgctgctttctgcagtttgtattccaaaacaaggggaatatgtttccattttttcaatacaaatgtttaagtcggatatgctttctcaaactggacacgcactcacacagcttagggtttcagctatggcttcctctcaaattattagcctctttctgccagggagcagtttttcccagacaagaccctggacagaggttggtggggccctcctcatcagaatcactagattatgactgacccctagaggtggcttttctgcttaagtgtcagcccatgggctgggttgtgacccccaaagctgcggcagaagcttccacccatcctgggccccccctgccatctatggggaaaggcctgtcccttgtcttctgggcccagccggcctcacaggcattcagcagattggaaagtcgaagcatgtgctgtgcttggctgggctctcctgcgcccctttttggggtgaggtggagtgcatccagcccccagcatccctgccgtttattcccacccctcatccccacccccatacacactcacaagtacaaacacaagcacagtcactggcacacaccactctggacagcaccatttccagcctcagcggggcagtttccttacagggaagttaatgaggcactaacgaaggctcaggggacagggggaacctctatcgagaagaggctcctagacctggttctgcctctgaattgctgggggtccttgagaaagttgctatccctctctggtctcagtttcctcaggtgagaaatggggggccggccaaatggtctaaggttctgggaacctctaaatcagagcccgtagctggtggtcaagatgagggagaggccctcagggtcagccgaatgcctgagaggccggacaggcccaaaggtgagcaacgtgagcacatcaggtgggctcagagctggcgcatgagccccacagcctgcagagcagccctgtactcgggagcccgctcgcaccaacccagtgggacttcagagatgtggggtccagcctttcctactattgctgggctgagggctgggagctgcagattctgaccccacagctgccttagacatgccagatggtctggggcaagacacacccctctctatgaaatgagcagccagtccaaataggtacattagagaagggctgtgggatggacccagctgtagcctggggctacagactggcttccggggtactcaagcagctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggcggctgctccccacagccaggagtccggcccagcacccacctgagtccgcctcagtcctgctcaattgggttatccgtgctcttggccctctggtcccacccacagagggaggtctttggggcgaccaggtgagctggcccttgtgggaggatgtaactgactcctgagcctggcgagccaggcagcccctcgccaacgtccccacccctacctctccagcccccccgcattccctgatcctcccatccgctcccctgacccagcagttgcctctgctcactctcttttcctgctcccaggctcgcctggtcatgtgtccttcactctcctctgagtctccctctttccaagccgcctccactctacttgacacagtctcccttaagacaccagagtacacaagcgcaagtccctgcacctcacctttactcccagacatgggagggagatgacatgaagacccaaacgccacttagcaggagatctggggtatgcagaggggcagaacggaggctgtggaagctccaggggctcccttcaggaggccacatgtaagctggctattgaatgtggctctgagctgagacctctccttgaagctccagaccaggagccagctgatagctggacccctccatttggtgcctcagagaaactttgcactctctaggtctaactttgaacccagaaaattcccccatgtcggccctgtctcttcacagggaaagcaccacctcagacccagttctgcaccaaacccacatttgagtcacgaggctcctgccctgcactgtgagcactctggataagccagtgctgagggggaaagagctctgaatgccaagccaaaacatgagcttcaactccacctccagctctgagagctgtgggtagggaagggccctagtccagtttgctgtagaaagaccagtctgccactgtatggcacatggatggcaggggcagagtgcaggtggagagaacagaaggtgggcagggcgggggaggcagggacatggctgtagccgtggagatgggaggacagacaggacttggtggccacttgggtgaaccaagggaggagtcaggaagagacacccagttttgtatcagatgtgtagagcgtgggatgctgttcattgacggagggaggaggaggaggaagaggtatggcatggggaggaggtagctgagctctgtcgtgaatgtcatttgaagtccccagggaaagccaggccggccagcaccttcactgcttcagccagctctcagggtgtctgtgctccctggccctctcagctcctgcttcatagctgtcagctgcagtgggagacagctgcacaagggcccagcatgtctgtgtgtttacccaggggactgccgcatggcccatgccgagcagaaactgatggacgaccttctgaacaaaacctgttacaacaacctgatccgcccagccaccagctcctcacagctcatctccatccagacggcgctctccctggcccagtgcatcagcgtggtaggtgcagagggtacctgtggctcaggctcaggtgaagaggcagctcatgcccaagccctaagcagtcaatgtccagaggaatgaaatgactagagttgacttagactcaccggtacacggtggggaggctggaggagggtccatgaggtttataggtgtccagtatttaatgaggtcatggttttgttaacaaagaagaaatgagggtgggagcgagatcaccactggctaggcagccaatgggcctgcagagactctgctcagctgagtctccagcacgaccatgagcttctcatcctgatcctcccatccccaccctacttttctcccccagcttgctcaacaggtgaccttacaggctccctactctttgcagggaataagaaccagactgggggaactgacgggtacagaggcccaggtgtaggcgcaggaccacaggcagtgaagcgtctactgacccaggcgggtgagggtctggagagtgggcatggctgctgcaggcatggaaagcaggcacagatggcggcactcccagggcccattgtcagggtctccacatgtggacgtgtgcagaggtgggggtgctgagggaggaggggcagggaatttctcatcttctctctactgcctctgagttggagatgtcagagggagccatggcccactgtaaagtaacacaatgtccccacccacaggattagaacccctcccctggaagcagctctgaggggaacagtcacatgtagagagtgcagggcactgtgtccagccgggggaaggaggtcaccaagggggttgacccccctctggccaggtggctgccttctgacacaccagcctctgtctctagcacggtggcccccacacacccagcctgtgaaacctacagccctcaagaaggctttggccaaattaaggagcggctccctctcccaggaggaagcacaggtgaaggatgtggagggcagtagagttgtgtgtgctccgccccctttctccacagtcggatggaaagaagggggctttcagccaggctcgcccaggctggggtctgagtgtcactgtccagctattggcttcttgcttaatgggtgagcccagctgctcccgtgcagctgccgccctagtgagggtgaaccggcaggcgagttacatttctgaaagcctgggaatacagtaaatattaggctgtgggctgctgggccaggaagagttgtttatttttcagggtttgtttatctattgacttgatgagggagggttataggtacaaccagtttaaagatggaaattttgagagagcaggcagggatttagtgctgggtaagcctggtcaaagcggctcttttggggcggccagaatccagtaccaatgtcctcagcatgttcatcagctgctgggggagtgcgggacagcatgaaagcacaggagaactttctggatgatagaaatactctgtatcttcaaaggaggtgggttccatagtaatgttaaatgagttaaaactcatcaaaatgtaaaccagacctgtgcatttcactaatagaaattatacctccaattaaaaacatgttttaaaagacagatgggccggatgcagtggctcatacttgtaatcccagcactttgggaggctgaggcaggtagatcacctgagtcaggagctcgagaccagcctggaaaacatggtgacatcctgcctctattaaaggtataaaaaaaaattagccaggcatggtggcacacgctactcgggaagctgaggcaggagaattgcttgaacccaggaggcagaggttacagtgagcagagatcgtgccattgcactagagcctgggcaacagcgcaagactccatctcaacaacaacaaaaaaaggacagatgaaggttttcaactttcagtaaaggcagaggagcttgttacagattcgcctccccacaagagcagttagaaaaactggataaaaatgtgccccgcccccaatcaaaaacaattgttggaaggtaattggagacctcagtcaggacttgagtgaccaggcctaggaggtgatcctgacagtctgtagtgctttcccacatttggtgattggtcaacagtagagggctaagaggctaagaaactgagtatgaagtggtagttaagaggctggagagcctagctgaatgtttggcactctcacagggctgaaatgacctaatgagaatttgggtcccaggaaggagatgggaccttggtggggaccctggaagggccacccctgggagtccaaatgaataaaacatagaccagccatcagaaaacctaaaacctgctttgaaccagcttagtcccaaagtagatgaaggcgatctgcccttactccaattgtgtgccataaactcaaagtcaatactctctggaggcagataaaagtttactatgaatgtcaaaagacaacacaagactaaatgagaaagaccaagaagaaaactaatagaaacatacatgtaaggaagaaacttttttttttgagacggagtttcgctctgtcacccaggcttgagtgcagtggcacgatctcagctcactgcaacctctgcctcccaggttcaagcgattctcctgcctcagcctcccaagtagctgggattacaggcatgcgccaccatgcccggctaatttttgtattggccaggctggtcttgaactcttgacctcaggtcatccatttacctcggcctcccaaattgctaggattacaggcgtgagctaccatgcctggccagtattttgccacaatttaaaataaataaaatttttttttcaggtttgtgctcagactatattctaaacagtcacatggcggcttactcttctccaggccttgctgccggcttttacatgtttattgtctttgccttcttgtcatgtgctcattagatggcagcttccaggtgctcctaaggggccaggaaagagagtgagaaggcacggaggttgccagatcatcccccttggggccccgccctcatcaactccctcaaccgggtctcctgcaactattggtgggccatctcggccaccgcttcgccctgagcttcctgctgctgcagctgggcagtgcctccttctcagaggccagctgctgataggcggccacgtactgctgcaggtgacccaggtaatggtctcgctgctgctgcagactcagcctcttggctcttcagctccacctgcaggataggcgtcagggtaggtagtggctggcttccagattctgggcccataaacagggtagtgagggcactgcggggctctgtcgcctacccaggcccctggccctggccccttcctccaggcctaaatgactgcctcccttgcctagaggcccatgcctccctccccagcctcaaatctcacacccttcttcccaccatttaaactgtaggccacagactggtggaaaagcagagggagccaaccaccatctgctaagttgtggtgaggtcattctgtatgatctccagggtttgcacacacctccgcctgctccccccaagagctcggccttctgccccagcttccccagcctctcctccagctcctgcagcctcacctggtgttcctgcatcttctcctcctgctgccgcagcctcacttcctgctcccacatcttctcctcctgcctccgcatcttctcctcctgttcttgcatcttctcttcctgctcacacatcttctcctcctgctcccacatcttctcttcctgttcctgcatcatctcctcctgctctcgtatcttctcctcctgctcccgtatcttcttctcctgctcccgtatcttctcctcctgcctccgcatcttctcctcctgttcttgcatcttctcttcctgctcacacatcttctcctcctgctcccccatcttctcttcctgttcctgcgtcatctcctcctgctctcgtatcttctcctcctgctcccgtatcttctcctcctgctcccgtatcttctcctcctgcctccacaccttctcctcctgctcccgtatcttctcctcctggtcgtgcatcttctcctcctgcctccacatcttctcctcctgcttccgtatcttctcctcctgctcgtgtatcttctccttttgcctccatatctcctcctgctcccttatcttctcctcctgcctccacatctcctcctgctcctgcctcttctcctcctcccgtatcttctcctgctcgtgaatcttctcctcctgcctccacatcttttcctcctgctcccgtatcttctcttcctgctcccgtatcttctcctcctgcctccacatcttcgcctcctgctcctgcctcttctcctgctcgcgtatcttctcctcctcctgcctcttctcttcctgctcccgtatcttctcctgctcgtgcatcttctcttccagctcccgtatcttctcctccttctcccacatcatctcctcctgcctccgcatcttctcctccttctcccacatcatctcctcctgcctccgcatcttctcctccttctcccacatcatctcctcctgcctccgcatcttctcctccttctcccacatcatctcctcctgcctccgcatcttctcctcctgctcccgtatcttctcctcctgctcccgtatcttctcctcctgctcctgtatcttctcctcccactcctgtatcttctcctcctgcctccacatcttctcctcctgttgctggttcaggcggttccacaactcgttctcttccacctgggcttggagctttgctgacacactctgcagctccttacccaggtggtcagcctccgcctgcagctgctgctggaatagtgaaagtgtttttttttgaacctcagaaggaagcagaatcatgagctagccacataaatgtaatctataggctgggagccgtggctcacgcctgtaatcccagcactttgggaggccgaggtgggcggatcacgaggtcaggagatcgagaccatcctggttaacacagtgaaaccccgtctctactaaaaatacaaaaaattagccgggtgtggtggtgggcacctgtagtcccagctacttgggaggctgaggcaggagaatggcgtgaagccggggggtggagcttgcagtgagccgagattgcgccactgcactctggcctgggtgacagagtgagactacttctcaaataaataaataaataaataaataaataaataaatgtaatctataaaataatggttttcatccatgatcctttaaaaaaatatttttaagccctaactcttgagattctgattccccaggcagggccccaatttgtacatttttagtacactctagaggattctatggcgggaccagaacaaggacccaaattttccagctcttggctggagcctccccataccctgcatgatccctagaccatggtcccagctggatgggtctcccacaacccccggggctgcagctgctcacctgtggcagcaggagcttggccctctccagtttcctttttagctcctttacgttgagctggatctcagacttttcagattctacaagttgaagtttttcttgtagtttggcatttttctccttcagctcctcatcagttatgctatggccagaggcagtagagaaaggaatgaatgaagaacataaaagaccactttggtgattgaccccctaccctcgccccacaaccacagaaccgtggcgctggaagggaccccaggaattaaaagtcccaggtggcaggccagagagaagacatgagttgcctgaggctaccccatgagtcagtggcacagccagcactagagcttccgtgtgcacacatgaaaacatgtatgagcctctccccacactcacctggaccccccacctcccagcacaccacccatgctaagggcccccagacctcccattccaccttcccccatcctacgtgttcctgtacagttccagactcagggcgtccctctcctttgttaactcctcaatgtactgcaaatagagaaaggttaagtcaggatagagcaggcacagcagtagctggacgaccaggaacaactgctacagtgactactccacagtaacacttcctcactctcaatcacacctgacgtgttctcaaggcatttccaagcccatggtctcatttgtttttctttctttctttctttcttttttttttttttttggcagagtttcattcttgttgccctcactggagtgcaatggcacaatctcagctcaccacaacctacacctcctgggttcaagcaattctcctgcctcagcttcccgagtagttgggattacaggcatgtgccaccacaccgggctaattttgtatttttagtagagacggggtttcttcgtgttggtcagtctagtcttgaactcctgaccgcaggtgatccgcccacctcagcctcccaaagtgctggcattacaggcgtgagcgagagcacctggccctcatttgtttttcaaagaactcagtggatgtggaagggacagggaaagagattgaatttagggctggctaacaggggcccagagcgatcagataatattgttattgctattactgttagtactaccactgttcgaacctttattgagtgcttcaccaggcactatgctaacaatcccatttaatcctcacaacctccataggagatggttaccattattacctctattgtgtagatgaaaaacatgcggtattaaaggttaagtgctgcctaagatcacttggagctgggatttcaacacccagctatatctgattctctaagcccattcttccgctggaggtaggggcacagttaagaaggaggaaattaatcctttgttgaatttttgaaaggatgatacgttcgcatagtccaaaactcagaaagtccagaagggaaatatctccccccaacactgtgcctctatcctgagttttttaatgaatccttacaaacgtgttttatgtatgttaccataatacgtacacacacacacatatacacctgccccctctctccacacaaataataacatactcaagatactcttctgtacctttatggtacaagtaccctaaccgccacttaggacttggccaaggccacagccaagtatgggcagggcgggcacttggcctctgagctctatgtccagtgctcgctcctcacagtgctccccaactcacccacaacagccgactcagccccagtctgcctctaacaaccacacacaaaagcagcaagaaatggccatgctgccttctgggcaggacactccatcctacagaagggacctttaggctcactcctccatctgcgaagctgggctcccaagggacggggccgtgtttggactcaccctatccgccttcttcttctgtgtagcgacagcagagagagcctgctctaactctcctgcaaacttccatgaatcatgcaggcggctgatcagatccctggcctctcctggaatgagagacattcagatgtggcccaaaggactccccctaaaggcctgtcaaagtgccaggttgaaggatgatggggtgccagattcccaccttccaactgcttgacagcatgctggctgtagtagagtgccatctgaagctcagttttctgacatgtaaggattcgtatggtatgaacctgggcctttgggagaaaagacaagcaaatgctgaaagagaagcaaagaaacattctccagagggcaggagggaacttcacaccctccactcacctctagctccctccttagggcttcctgatgttggtggcttgccttctgttcctatagaaagaggaaaacagagctcttactagggggaggcagagatccacagcaagagacatgcccccagaatggcaccactgccccagaacaggcccacccatgggaccagtttatcagggaccctgtggggatggggtggaatcttgggggtgagccttcttccccaggctgggagtgggtgagatgagcctggggcctctacatctgagtgcccccaaacccagcggtcatgtcgtgagcaaagaaatcacactacttcttccagctgagctcggttctattgtttctgtggggagagtcaaaggaaggtgactgagggtggcccccttgactctattccccaggccaggaagcgataggcaggggccaggaatggatttaaaaggcacagttctcagacccaatgggaacatgaactggtcacctctcctcaactcccaaagaagaaggatttgggtctttttggtttttgcccacagccacagaactcaaagtctgaaactagattctcttgaaaagacagtaacagaaaccttcagaggtggagtgcgagaaaagcccacccttccgccagcttgtgatttagaaaggtgcattcactcagcaaacgttgagcacatacgggccagggacggttcttcacagcgggaatagaggtcagaaaaggcagacaggagcccttggccccgaggtttccattctagtgggcctttaactctcgggctctcagagctaacagaaacctctgatactctctaactctacctcaggaaacgcaagcccaagaaggagagtttacagcaggtcctggacgagggattaacataaaaacacaatgacaaatctcatttaaacttcacaaacgtaaggaaaacaataccactcgtattttacggatgtgaaaagagaggcccaaagagctcaagcaatttgcgctaaatcatgtccctagcagatggaggggtaggattcaaacccagaattcttagccagtacctggcagttcttccacaatcttaacaattaccctccaccaccccttgggccctctgtccccaggagcccggccagccaagactcacatcctcaggcgagtggcaaccaccagaagtggttgtctcagggttagtgccattatttattttcttctttttggtgtcgcttgctgctgtaccaacactagggttggtctggggatgatggtctgtcaactgtggaaaggaagagcagtgatactcatgagaactacaagctcctacagtcacatcctgctttacagtttatactaaatacccttatagaccatctgatttaatgccaccaactgtaggaaatgttgtcacaatcacttagtgactgagagagattgataccatggctgaaaaaaaaggcagtaatggaacttaaactcagtcttctgactctgagctctgggattttgccctaaatcagcagctgccagggaccaaaaccagaggcagaggtagaaaagcaaatattaagtaggcaggaactgtgcactatgtggtttagggttattcaccctcacacgtctgttagtgttaaaaagtacaccagtacctctcaaacctttacatcaatgtctcctcatggcagaaggcagcctttctgctaaatctgggaatttaacagaaagaggacaacccaagcctcatttcagagagaagtcttgtatacgcttataaatctacgtgactttcatccctaagtacattaatgttttgcctctcaatagaatcaagggaaactgatgcttcagaaagatgccccatatttatcctgtggcactcaaagtaccccaggttgagatgagatgaggaagactcaagctaagttcagtttcccaagatctgttccacagaagataagcagatctcactccagaaccagtgactgaggggcactctggtcccagaacaatggagaattcaaatctgaggtgcagaactgagaaaaaatgttaaaatctctctggagagtagaagcctgggagaaaaccaaaccaaacccgttctcccattgccacccagagacactgtcaacgtgtcgagctcatgggggaggtgtaggcttttcacactgtcaaggtctgtggtaaggaagtcaggcagcctgaaacctctctcttctaggtcccacagtccccattccccttccagctggaaacctgtgctgcaaccagaggaaacagaagtgggcaagaacacttaggggactgggtcctaagaccaaaggccggtcttgtggtagtaatgacagtttgtagcgggactgtgacatcactacattctactcctcggtggagtggttgggggggacacatgagtgcaatgcccaagttgccgctttgagactggggagggggtcacaaaattgggagccaggtccttggagacgtgaccccaaagagccccgggaggtcaggcttggggcggcaggaggtgagggccaattaaggagcaaggagctccaggagtcacatccccaaagtcaccctgtggcaactggtgagggcaggttctggggcacccaggtccttggagatgtgagctcaaggagcccagggaggtcgggtttggggtagcaggaggtaagggcggagtatggagttggaagccccaggagtcacctgctcaaagtcaccctggtgtgccgggcagagcaggggcaggacttatgagggggttgggctggctgacaagattttggtgtggggagcccagaggcactggggtggggggcccagcctggtgtccctcaggagtggcacagactctggcagcagttcggctgtcagagggggcctcgggttgggttggggtgttggtgcgtttacctgttccttggcctcggccaatttgctctgtctggtttctttggacatcataggatgggtagggaggtggggatgggtagggaggtggggatgggtagggaggtggggttggggccacatcagcatgatccaggtgaggacaagtatatacctccagtcacctctacgtcgctgtgtgactgagccagaggaggcgtaaccagggctgcactagaatgcagaataggggtgtggccttcatgcttgaagcccattggtcaatgagaaagatgaaaggaaaaggaggtgtggccagacagcagcgtgtcatcaaggacctgtgttgtcacaaggaaagctgcctatgcaaccgctgtccccgcccactccaggagaggggcggggctggctttcactttaaaaactttaaaactttattacctcaattgaggtacaagtcctattaaaatggaaattttatagtgtgcttgatgattgataaagcagactttattatccaacattccaataagataatcacaatgttttctcttttttggaaaaactttctcttattctcctacattagcgtttagttttttttaaaaaaacaaacaaacaagaaacatgtctaatatctttaaaaatacaaagctttgagccaggcgtgatggctcatgcctgtaatcccagcactttgggaggctggggcgggtggatcacccgaattcaggagttcaagaccagcctggccaacatgatgaaatcctgtctctactaaaaatacaaaagtagctgggcatggtggcaggtgcctgtaatcctagctacttgggaggctgaggcaggagaatcccttgaacctgtgaggcagaggttgcagtgagccaaaatcatgccactgcacttcagcctgggctgctacagaatgtgactctgtctctaaatacacacacacacacacacacacgcacagacacacacacacacacacacacacacacacacacacacaaggctttccatttaataagcactcaaagttctttacaaggttaaagcaaatacaggacccttctaaagtaaggctaaatgctaagtgatgggggagagaaaaaggacataaataactcctactctcatgagttaatcactaaatccgatttttctagaatcacctggcctctaagccctgaaaatgaaactgaatttctcactcgatacttggctatgacttgcaatcatgaaaaccaagaattgtgttatgtcactgtgtattgcttgttacctgggatcaagggttgactttttcatgatttgctccattacctgtgtgcttcttctcccagtccaaactacgcttttttctagagttctacaatttacagttagtatgtaagggtggctctcaaacatgtagtctccggaccaggagcacctgggaacttcttataaatgtaaattctcaggccccaccctagacacgaatgaatcagaaactctgcagtagggcccagcaatccgtgctgcaataatccctccaggtgctcaggaacctctgccatacagcaggtagaaaaatgtgtttccttctgtaggtccaaagccagggatactatatgttctgtctcaatatgaaacaatgacatgcaattaaaagacataaatctccttcctacttccaccctccagccagtgtgttttatttttatgagttcaataagaaaacgtgtggcaatcagagatttcatctaaaaaatatatctacaggtatcagttctcatccagcctgatctcatccaatatcatttctatcctcttacatctaaagttttagaaaaggattttcacaacgtaagactcaggcgcactaggagttctatgataaaagaccaagtagatctgaatgtccaaacttactagagaagaaaagtggactcattggctatattttcaaattgcattcaacaggaaattaaagttttgaattttttccaccttcatccttccaagttaatagaattaaaccagaatactccattcttccaaagcctgtagccaggcaaacttttactgtattacttcttgcttttcaatggatataaagcagagtcctggtaggcacattttgtatacctgcaaagatgcaaaactaaacagttccctcggttcaatattaaaacaaaagtcctgtaaacctcagatggtgagtgtaatacttcagcactagcacgaaagcctcaaatataaaaagataccaagaaccttgctagcaaaccaaagtaagctcttggccgggagcagtagttcacgcccgtactcccagcatattggcaagctaaggtggggtaagtcaggagttaaagaccagcctgggcagcatagcgaattcatatctctacaaagaaaatttaaaaattagctgggcttggcggcacacacctgtagtcctagagctacttgggaggctgaggtgggaaaatcacttgagcccagaagtttgaggctgcagtagctatgatcatgccactgcactccagttggggtgacagagcgagatctaattattacattctgtcctgctcctgtttccactaaaatcactaacttaaaatgtgttcattcagcaggataaaaattaagtgaaatttgactttggtgctttgctagcaaaaaataaataaataaagtgaagtgacaaattacttactgggagaagatctttgtaacctcaatgacagattaaaggtttgtagccttagcctataaagaaatctttaaaattactcagaaaaaaaaatgaatgatttgcagcagaaaatgggcaatggagaaaccagcacttcccacaagaataaaaatggccaatgagcaaatgaaaaagattcaaaagcactagaaatcaaagaaaggtaatgaaaacaatgagattttctgcttaaagaccagcgaagatgacaaatggaagggggaacctggagctctgtccctgttggtgggagcataaactcaaccaattttcctgtaggatgatttgaacatttcttttaaaaatcctaaaactgttttatattactttcctctagaaattctacttctatgaattcagtgcaaaaatcctgactcgagtccattaaaatatatatagaaggaaatccacctctggggtggcaatgactcacttaacatacatccagtgatgatgccagggtatatttctccatagaaacatgcttaaaatatagtaagtgacaaaagaccatgtattgtgattctactttttaaaatgtttacagcataaaaagtgtgaaaagcaacaaaccggaatgttttgagtggcaaaattaaagatttttctttacattttgtcatccaaattattacaaaaacaatgtgatttcctttataatcatggaaaagtgttattttcatttatttatatttacatttcttttctttttcttcttttttctcctgtatgtatcccacataggctacagagcttaaatccctgcctcttgagagaaatcagcccattttcaggacatgcaatacacaaagctgccccatcttccctttatttttatttttatcttatttatttatttatttatttatttatttatttatttatttatttatttatgttgagatggagtctcactctgttgcccaggctggagtgcggtggcgcatctcagctcactgcaacctccatatcccgagatcaagcgattcccctgcctcagcctcccgagtacctgggactataggcatgcaccaccatgcccagctaatttttgtatttttagtagagaggaagttttaccatcttggacaggctggtctcgaactcctgacctcaagtgatccgtctgccttggcctcccaaagtgctgggattacaggcatgagccactgtgcctggcctgtcatattatttctaaacatttgagtgacatttcaattaagtgaaatttaattcttactgacctgatctcttatcctctgtttaatgataccttccagttgaaaggtgtttcctctgtaatcacgggtgccaaaggaaatacaacatgtattcattaggtggatccactaaaccacggattcacgcattgtagtccttacaccctcagcatcagaaacacgtgggaacttgttagacatgcaaattcctgggccagccccacacctcctgaatcagaaagtggggaaggacagctatctgtgctttaataagccttgagatgctccctgaagtttgaaaactacagaactagaatacatatggtagtaagtgctcatactttatccaaggtactagggactcttcccctcttttccattctcttttctgttgaaataaaatgagagctccttttgacttaatgggtataagcaagaaggcaatgagatgaccagggtttcaagttagagttcaaaatttaatcagtggacagtgacaggatgcaagccttctaaacagattgctgcaaggaagctgattataatctatacagtaggtatcattagtgtattgatgttaaattttgggggtggattaatggtattgtgattatataggagaagtcctggttcctagaagatatctgcgaaagtacttaacagtgaaatgctctgatactgccaacttactttgaaatgattcagggggaaaaagggcacatatacaatcttccatacgcagaagacagaaaacaagtgtgacaaaacattaactagtgaatccagttgaatagcatacagatgttcactgtatgattttatcaacttttctgtgtttgcaagttttcaaaataaaagttgagggaaagaaacatcaccccaaatctttctatgaaatgggaccacagaaaaagcagagaagtgaacactttgcagaaaagagcactgcacccatccggacagcatggtcaaagtgcaggctctcctccaggaggctcttctctggtctcttctgtgctgtcacttcccccacatgcagccaaggcttttttctaacaactctttttctaaagatgtaatttttgtcattcatctaagaaagagaagaaaagaattagtatacatttagaaaataaaattacacttacatttgtgaaaaagcaaaaaatactttgaaaagtggggaagcaagaaatgtactgttctacaattctgttctgttcttaccatctttttattctgccaatgacttcctattcctgctgtgtatggtggggtgagctgcaaatgatttcttttcctcattgatttaaaatgtcatgtttataatgtaccaaactcccccagaagcatttgggtttatttctgggctctattctattcaagtaatctatctgttcacaagccactatcaattttgattattggagcatcctaaagttaagtaattgttgtttttgtttttgagatgcagtctctcactctgccgcccagctggactgcagtggcgtgatctaggctcactgcaagctccacctcccgggttcatggcattctcctgcctcagcctcccgagtagctgggactacaggcacctgccaccacgcctggctaattttttgtatgtttagtggagatggggtttcaccttgttagccaggatggtctcgatctcctgacctcgtgatccgcctgcctcggcctcccaaagtgctgggattacaggcgtgagccaccgcgcctggccctgaatttgcttgagtttttagctctctcacccatttcaggattgtcaccacccatatctgacacgtcctcctcctcctctaaatcttctaggtcctcctggccatcagcctctgtttctgaaccagcctcttcatgctcctgttcttcactctctgggagaagactgatatcttcatctttctttcactaaccgcattctggaagcactgtaaaattgcttcattttgcaattccagttgttgcaaagtctgctcatcatcaaaactttctatcacaagtttttgtaaagagctgccatggattctaccattctctactgttttattaaagtcataaagcactttcgttaaagaagtgaactttggttccaatccagcttgaaacctattgggaggaattaaatgagatttagaattatagataataatttcacagccctcttaattaaaagaaaaataaaaacctcaactcttctgtaaaatcaaatttgaataaagtgtaagtatagattctggccccaacaatatataagctgatgagccacagtgatatataaaacctgtcaaccaagtatttgtgaatcagctgtatagattgttggcaggaaaagcattacaaatctatttgcttggagatgtatagagaattagccttaaattttctactctgctacattatataccactccattcattcattcccttattcactcaatgatcaacatttgctttggcttacagtggtcaaggaaaacctctcctagatgtgacatctgaggtgaaacttacagacaagtatagtcttataaagattgggaaacatgtattccaggcagaagaaacagcaagaacaaattctctaagatgcaattgagcttggtaagcctgaggaataaaaaagtgagcatggctatagcgtgaaggaggcagaaggtgaagtcggagagactgatgggagccaaattctgcagggctcaagggtaagagtttgccgttttaagtgtaataagaaaatgtgagaagattttaagcagaaggatgaaatgatgatttatacgaaggaagaagaaagggaggaaggaggaggaggaaagtagagtgattagaaggttgatgcagcattccaggcaaaggatgatggtgatttaagctggagttagagcagtgaatatgctgagtacagtttggaggtagaactgacaggattgctaaggaattagatacagaatagagaaaagtgaagacatcaaaatagcagcctagttttatgtgcgagcaactggagagacagaactgccatttactgcgataggcaaggcttgagtggtggagcaaggggaaaggacttcagcggatggcagagtgtaggtgggtagaaacaacattctactgtattttggacacggtgaatttgtgatgctgagaggaccaaaatttaaaaaattgttaaaagccgtacggtgcggatatcccagttgtgcgctactgaattccaactaagctcagtctggagttgcttgtgagcaaggaactcaagggagaggttggagtttgaaacataaatgagtcataattttataggtcatatttgaagttcttcaacaaaatacacataaaacgtttgtgttgggaagagacatgaaagttctaattctcaagaagcttagtggggtagacagacaagtgacaagtttgtgctttcaataaagtatgatggcaggtaaacactgagtgctttaggagcacaggcggaaggagaaaccaacacagttgtgtgtagggggatgggggccgtaataagcctcaaggggagcttataggcgtgaataactgaggttaggttgatttcaataacattcaactgagagatccatactgtaaaagttttaacaatttttaaaattttgatagcctaggtcctctgaaatgtggggaaaagtgatttacatttccccttaccttcccccagctccacaatttgccaggggtctgcaacccgtgtccacgtgcgaccgcagtcgcacccgagcccgggatctgtgcacttacgtgaggatgcactcgggccagccagtggctttgcccacctccctcagacaccgctccagggtccgtcagcgccaggcccatgggccatggctgtctgcaactcccgacacaagctgcaaggcaagagagccgctgggaaaccgcaccgcaaggatgctgggattggaacaggaattaaaagaaatgaaaaaatgtgtaagcaaaaactcagctgtatgtaaaaaaaacccaattccccctgagaatgagaaagagccttagtcctttaaaaaaactacctgttttcctatggctagtgagccttatcgctcccttcccaggcattatcaaaaccctaattccctaactgtgcaactgcaaggtcactaaacaaacaaatgcaagtcacaaaacatatttttcctaaaaacgtaaaaaaaaaaaaaacataatgcgtgcttcaattaaataactctctgtttctcgcttctgtaatatgcttccccctgcacagatctacccgggctccacaaaatgctaaaagataactctttattcagctcaacgctttgatctgcctggcgtggtggctcactcttgtgatcccaggactttggacggccaagtagggtggatcgcttgtgccttggagttccagacaggcctgggcaacatggtgaaacctggtctttttgttttgtgttgttttgagacggagtttcgctcttgttgcccaggctggaatgcagtggctgggtctctgcttgccgcgacttccgcctcccgggtttcggtcgttgtcctgcatcagcctccagagtggctgggattgcaggcataagccaccaagcccggctaattttgtattttttttttatttttattttggtacagatggggtttctccctgttggtcaggctggtctcaaactcccgacctcaggtgatccacctgcctaggcctcccgaggtgctaggattgcaggcttgagccaccgctcccggcccaacttattaatcagaaaggaatagatcgtcctggtgtggtggctcacgcttgtgatcccagtacttcggatggcccagcgcggggtatcccttgagcctaggagttccagacctgcctgggcaacatggtgaaacccggtctctctctctctctctctctctttttttttttgaggcggagtttcgctcttgttgcccagggtggagtgcagtggctgggtctccgctcgcagcgacttctgcctccagggttttagtagttctcctgcctcagtctccggagtggctgggattgcaggcctgaccaacattgctctgctaatttttttttatttgtttttggtagagacggggtttctccatgctgggcaagctgatctcaaactccagacctcaggttatccgcccacctcggcctccggggatgctggaattgcaggcgtgagccagcgcacacacccaatttatttttatttcattttttatttttatatatatatacttttgagacggagtctcactttgtcacccaggctggagtgcagtggtgcgctgtctcggctcactgcaacctctgcctcccaggttcaagcgattctcctgcctcagccgcctgagtagctgagattacaggcacccgctagcacacccatctaatttttttttttttttttttgtatttttagtagagatgggttttcatcatgttggccaggctggtctcgaactccggacctcaggtaaacccacctcggcctcccaaagtgctgggatgacaggaaggatcggcctggcgtggtggctcacgcttttgatcccaggagtttggaccggccgagcgtggcggatcccttgatcctaggagttctagaccagcctgggcaacatggtgaaaaccggtctctctctctctttttttttttttgaggcgtagtttccctcttgttgcagggctggagtgcagtggtgcggtgtcggctccccgcggcctctgcctctgggtttgggtggttctcctgcctcagcctccgagtgactgggattgcaggcgggagccaccatgcccggctcttttttttttttttttttttttctggtagagacaggtctctccatgttggtcaggctggtctcaaactcccgacctcaggtgatccgcccgccacggcctcccggggtgctgggactgcaggcgtgagccaccgctcccggcccaatttattaatcagaaagaaatagatcagcctggcgtggtggctcacgctttcgatcccaggactttggacaaccgagcgtggggaattgcttgagcctaagagttccagacctgcctgggcaacatggtgaaaatctgtctcttattattattattttttttttttttgaggcggagtttccttcttgttgcccaggctggagtgcagtggctgggtctccgctcgcggcaaattctgcatcccgggttttggtggttctcctgcctcagcctcctgagtagctgggattacaggcgcctgccgccacacccggctaatttttttttttgtatttttagtagagacgggttttcatcatgttggccaggctggtctcaaattcctgacctccggtgatccacccacctccgcctccccaagtgctgggatgacaggcgtgatcggcctggcgtggtggttcacgcttttgattccaggactttggactggccaagcgtgggggattgcttgagcctaggagttccagaccggcctgggcaacatggttaaacccagtctttttttaaattcctttattattattattattattatttttttgagacggagtctctctgtcgcccaggctggagtgcagtggcgctatctcggctcactgcagcctctgcctcccagggtcaagggattctcctgcctcagcctcctgagtagctgggattacaggcgcccaccaccactcccggctaatttttttttattttttagtagatcgtggtaactgccttaaaatgatgattgttcagaaagtcagtttaatttagatactaaggatattgaggttatgtaacatttgagcaagttctaaaaaaaaagagaaatagtatatttaattgctaataaagtattgtcaactcacaaatatattcacatagcatacatttcaagagcagaataaccatgaatataaaaggaattagcaaaaacgaaacaaaaaagacatgaagaaataaaaacagatggaacaaatagcacaaaatacgatgaaagttataaaagaaactatgccaacaatcacaataaatgtaaatagactgaataattaagagaaaatgactataaaacagaattagggcacgcgtggtggctcatgcctgtaatcccagcactttgggaggatgaggcaggcggagggatcacaaggtcaggagttcgagagcagcctgaccaacatggtgaaaccccatctctgctaatacaaaaattagccggcgtggtggtgaacatctgtaatcccagttactcaggaggctgaggcaggagaatcgcttgaatccaggaggcagaggttgcagtgccgagatcacaccattacactccagcctgggcaacagagcaagactccgtatcaaaaaaaaaaaacacacaaaaaaacacaaaaaacagaaaataaacagtatgaaaagacatctaaaacataaagtcacagaaagactgagagagattgaaaaaagatacacctgtcatatgtacctaacccaaagaagggttggaagctatattattatcagataaaataggctttgggcaaaaagcaatatgggagattttttaaggccacaatataatgataaaaattctaataaaccaagggagaaggtaatctaaaatgttaatgtatctaataactagcactcaaaatacatgaaagcaaaatatgacaaaattgcaaccctcagagggcaatttaaatacatatctcagtgtctgataaaagagacaaaaaacaatcagcatagacatagaagatttacatctctctagaaaattaacaagcttgacttaatgtacagaaaaaacatatctctccaaagtgacagcattcacccccccaagtacatatgtactgagccataaggaaaatctcaacaaattccaaagaagcggaatcatgcacccatctttctctctaaccataatctcattaaactaaaaacaataataaaaagataaagtaaaaagccagaaaggcagatgctaaatgagaaagtgacagaaaagttacagattttgttaagcatacaaagcttctatggggtaaagcagtcaaagggatatgcaaatttacacagaaatccaactgatataaatccttgaaagatactacatacagatatttcatcagttctcacatgccaaacccagcaaagccaaactttggagcctcccctgcgagcagacctgccacaggaggagaggcagcacaaacctccctttgcagtgaaaatgccacattgtgtgtgcttcttaccccatcacctctttggaagtggccccactcagcgctagctgagaatcgcttccctcataccactctcagtagttcaccccaagacacacgggacaactctgtacctggtaagtcattgtgaatccaattaataatggcattcagaaagttaggaatctttgaattattagattcatagtgatattcaaaagaaagaaaacgacatcatttctgttccacgcatgttgcccacattcactgcgtaaaaggcaaagggaactgtgagtacccacaaagaacctgatattgacggcacatacatttcttcattaggaagaataaatttagactgtaacaatttaaaaaaccagaaaatacaactgtacattttagttcttattaaaatccaagaggtttaacttatttgctccttgtttaggtaattagtgtctaaaacatttcaaagataacatatatagtggctatgatttctagtactttttaaaaattcaagcccagtctcttctaattaaatgtataaatgatttatctctgtctttcttaaaaagaaccaagagccccaattaaaaagtaaaacttaaatttcctcttaaaaaattgttacgtcaaaattatctaataaaccatagttcagaaaataatttctgaattaagaaaatatgaataataaaaccaacagtttatgtgctgaatttcacatttttattttttattatttttaaaattttgttttaagttctagggtacatgtgcaggagtgttacgtagggaaacgtgtgccatggtggtttggtccacctatcaactcatcacctcagtgttaagcccagcacgcattagctatttttcctgatgctcctcccccacccgccctgacaggccccagtatgtgttgtttcccttcctgtgtccatgtgttctcactgaacctcacatttttaaatacagcatatgccaggtgtcatttcagtacccataattatacatagtatatgtatatgtgtaaatatatgtatatgtgtacatatatgtatgtaatatgtgtatgtaaatattatgtaaatatgtatgtatgtaaatatatatgtaaatatgtatgtgaatgtatgtaaatatatacacatgtaaatatgtatgtaaaaatatgtacgtaaatatatgtatgtaaatatatgtatatataaatgtaaaatatgtaaatatttgtaaatgtaaaatatgtaaatgtaaaataaatgtagaatgtcaaatgtaaatgtaaaatgtaaaataaatgtaaaatgtaaatgtaaaatatgtaaatatatgtatatgtgtaaatatatatgtatatgtgtaaatatatatgtgtaaatatatatgtatatgtgtaatatatatgtatatgtgtaaatatatatgtatatataacacagcatacagcatatgccaggtgtcatttcagtacccataattatacatagtataattatacatagtataattagactactatgttagctaaaaaatgttgattagatacaaatgtataaatttatcttctctaaacgtggaaattctctagaggctatttccagcttctgtgtggattgtagagcaggctgctacctgtaccccaaaaatgaacaccttaaaaaaaagacaagtttctcagcctccctattgcacacacatatgaaaaatatgttaaattcaacgccaaatattcctgagatcaacacagcagtgatcccaaagagaaaatttctctttgctaatgggcacaaacttgaagggcaaagcagtggaagggtaagtctgcagactcgggtggggctcaagtcagaatcacgtggaagatcattgccacatgtttttgtttttttaaatagcaaacaccaccaagtggagcccgccgggtttagtagatattaaacctctaaggagtggcacatccgagactgaaattcccatcttttgattcccagctcaaggtctctgaaatgccagcaccagctgtgaaattgttcttctgcattttcatggagaccttttcttctatactgccatactcttttttttggaacagttatacctgatcttcctatttttgtgtgtgttccaccgaaagtttttcactctaaatacttccctctttccaactgagcatttacatctgtaacaaggacaaaaacatctaacatctctctcacccttggtttgtgttttgttttgtttgtttttgagacagggtcttgctctgtcacccaggctggagtgcagtggcgtgatcaccgttcactgcagcctcgagctcctgagctgaagcaattttcccacctcaacctctgagtagctgagactataggtgtgtgccaccacgcctggctaatatgtgtattttttgtagagatgagtttttgccatgttgcccaggctggtattgaactcctggcttaagtgatcctcctgcctaggcttcccaaagtgctggaaggaattacaggtatgagccaccgtgcctggcctcaccattgttaaaattatggaaatcgtgtttgcaaagcaggttggcctgtttggaaaagggtgtcataatttctcaggtaactccaaaaagagaaagctacgaaaattaccttaatacattcattacagtctcagtataagattatagcttcctctcccaaagcgtaaccacaacctgacgcaggatgagttggtttgaaaataccgcatacaatatcctcttgagtagaatcataatttagaactctaaaaatgaccggaaacaaaactgtccaagtttgtttaacgtaatgtgtttcaacttatttgactagaaaacccttcattcgtgcaacacttataaatatcccatggcaaatctagttttctatgaataatgaacgaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatagcccatgtctggccaggctccatggctcaatcacacctgtaatcccagcaatttcagaagctgaggcgggaggatcactggcctttagtgatccttgaatgaaactccatctctaaaaaattaaaaatattagcttagagaatcatttgggcccaggagtttgaggctgtattgaactatgactatgctactgcattccagcctgggcaacaggctgcttaaacctggaggggcagagcttgcagtgagccgagatcacgccactgcactccagcctgggcaaaggagccagactccgtggcaaaaaaaaaaaaaaaaaagagattctattgacaatagcaacaaaaccctgagaatatatctagcaaagtatacacaggcctttcatgaagagtattgccatagcctgaatgtgtctcccaaaattcatgtattaaaacttaattcccaagatgatagtactaagaagtggggcctttaagaagtgattaagacataagggtgagccctcatgcatgagattagtgccttccttataaaagggcttgtgggtggtggtaaatctgtcccttctgcctcatgagaacatagcatttgcctgctccagaggaagcagcattcaacgtaccatcttggaagcagagaccaggccctcactagacactgtgtctgctggagtcttgatcttgttcttcccaacctccagaactgagaaaataaacttctgctctgtgtaaattacccagtctcaggtgttttgttatggcactatgaagggactaagacaaatataaaaattacccagggacttaaagggagaactgactaaactgaaatatatgccatatatattatgaatcgtaggactcaatgctataaacatactacttctcaacaaattaatctataaattcaagaaattcctacacaaatcccaatagaatttttttgtggaactcgagaggctgatcctaaaattcatacagtcacttgaggggccaagaatagtgtaacagggctggcggggctggtggctcacacctgtagtcccagtactttgggaagtcaagactggaggatggtttgaacccaggagttcaagaccagcctaggcaacatagcaagatgttgtctcaaaatattaaaaataaataaataaataaataaaaagaaggttaagtatgcacattttgttgtgaatttcaattttatagtgatttttttttttttgagacagggtcttgctctgtcacccaggctggagtgcagtggtgccatcttggttcactgcaacctctgcgtgggctcaagcaatcctcccgcctcactctctggagtagctgggaccacagttatgtgccaccacacctgactaatttttatatattttttttgtagagacggggtttttccatgttgcccaggttgttctcaaactcatccacctgccttggcctccgcaagtgagatcacagacatgggccactgtgcccggtctagtgcgcttttttttttttttttttaaccaaacaaacgatgaagtctcaggagtaaaagttgatacacaagtaaattttattggtaatgtttttgtgtggtctttaagcagagggaaaattagtctgcattatggtgtatccagactaaataactgatattaaaatgaaattatccttaggatttgcaatcttagagaaaactttttcattttttttgagttacaaattatcttcacttacatttgagaacagtgagtcacagagggattaagtatcttactcaagatcttgcaagtgtttggtttgaacccaatcttttcactctgcagaactcagagtcactcttatttggaaactttttaactgatgtggatcctctaatatgggcttcctattattcattccgtattagtcagaagttttgcaagcaggcagaattcattttgccaattacgggattttccctcagttgcagtcaaggttcataaaactataactataaattttgtttttgagacaaagtcttgctctgttgctcagactgggatccagtggcacagtaacagcccattgcagctttgaactcctgggctcaagggatcctccgcctcagcctcccaagtatctgggactacaagtgcatgccatcatccctggctaattttgtttaaaaaaaaaaattgtagagatagggtcttgcttcgttgcccaggctggtctcaaactcctggcctcaagcaagccttcagccttggtctcccaaagtgctgagattacaggtgtcagccattgcacctggccaaaactgtaactatatatacacacacacataactacatatagatgtgtgtgtgtatgtatgtgtgtgtgtatatatatttttatatataaatagatatatctgaaaggcatcaaaagaaaaaagctgtaacttttagtcttgatcttgatagtgacttgattaggctatctgtttaacatcaaagatgcaaattaatgctttctttgggtgagcatattaaaaatgcagaaaatattggagtagttttttatgttaaataaattgtattctgtgtatttaaggtatacaacatgattttgtgggatgcatatagatggttaaaaaaattactacagtgaagcaaattaacgtatccttcaactcagatagttacccgttttctttttgtttggtggcaagaggagcttaaaatctcatttagcgtgaatcccaatacagcacaattttattacctatatttctcgcgttgtacattatatttctaggcttgttcatcctacatatctgctactgtgtaacctctgagctatgtccacccattttctctcttgccccccaagtaatttcctaaagtgtctcatataaaaaggcagtagctttcagcttaaactttttctctgtatatatttaagtcaatttctttgaggtatgtttttctctccagaatagttagatgtaggcataccactttaatgttgacactagttcacctagaacttatcttctgcaaatctgtctctatgtccatctctgtctccatctttgtctctatctttatctctgtctatctatctatccatccatccatccatccatccatctatctatctatccatctatctgtctatctaactaaagcaaattcatgcccttctcctatttatggaatcgagaccataaacagaagtgagggaaagaatttggcaggaattgcgatgtgtattacctgtggcataaggaaactttacagaactagggtcaaaagtatactttctagttctttcccatggcttttcactttgatgtagtccttatcaggcaactgaggttttatataagtcccctgattcttagaacatgaaggtgtagtattcaagtttggtcccttgaaagcacaatttttgttaaaaaaatttaagaaaattgtatgatttcctcagcaaatacatattgatcatctgttatacagccatgagaagtggttctgttgaacacgtttattttatcagatcccaattctaaaccaggcatagaatggaaaccatgaaggtaggatgaaataacttctgaatgtttgaaaatagtgtacttaaaaataaatatcaggtgtttttgttttgttttttgttttttgtttttgagacagggtctcactctgtcacccaggctggagtgtgatggtgccatctcacctcattgcagccttgacctcccaggctcgggtgatctcccacctcagcctcccaagtagctgggactacaggcacatgccaccatgcccagctaattttttgtattttttgtagagacagggtttcaccatgttgcccaggctggtctagaactcctgggcttaagcgatcttcccacctcagcctcccaaagtgccaggattacaggcatgagccaccatgcctggctgaaaataccaggtttttaagtatcagcactgcctcttcaatcttttctattactatgttgtgctcagtggtattttttattgaattagagcagtgctgttcaatggaaccttctttgaggatggaaatcttttatgtctctgctgtgtgggtatggtattagctgggtatggggcacctgcctatagtcccagctactcaagaggctgaggtgggaggatcacttgagcccaggaggccgagtctgcaggttcgtaccactgcaattcagcctgtgtgacagaatgagactcagtcgcagaataaaatgaaataaggaaataaaaatgtaattgttgaaataagaaactagtggatggattagacacgagaagaaagaattaattgtttaggcgattctctccaaaaagtaagtcagcatgtcacacagagagacatgaggatagatgatagggcagaagttggtgggcttggaggggagaggaagatcagaatgaggtccaaaatgtgtcttagtgaaatcccaggaggagatattaaaattatattagaaagtgaaagaaatagaagttttatttatttatttatttatttattttgagaaggagtctcgctctgtagcccaggctcgagtgcagtggcacgatctgagctcactgcaagctccacctcctgggttcacgccattctcctgcctcagcttcccaagtagctgggactacaggcacccaccaccacgcctggctagttttttgtatttttagtagagatgtggtttcacctttttagtcaggatggtctcaatctcctgacctcatgatccaccagcctcaggctcctaaagtgctggaattatacgcataagccactgcacccggcccaaaagctttgtgtttttacaaatattacacatgtttcttgtttaagaaaaaaagtcttcacaataacgtaggagaataagagaaacatttttccaaaaaagagaagtcattgtgattattttatcttattggaatgttggataatacagtctgcttcagtaatcatcaagcatgctatggattttccattttcataggatctgtatctcggttaaggtaatactggtaatttttgtactctatgaaaaatataggccaaaatcatagaccttgcatagaagctggatcatgaagacagctctggaggaacacacaggtacacacacacagacacacatatatataaagtatacacatatatattttttaaaagcttttaaagcaaaagccggccctgcccctctcccagagttggcggcctctcccctctcttagagtgggtggggacagtggttgcatgggcagctttccttgtgagccaaaggtccctctggacacatgatgcctggccacgccccctttccctttcatctttctcattaaccaatgggcttggagcattaaggccacgcccctattctgccttctactgcatccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccactcccgaggttcaccggactggggcccccacaccagtgcctctgggctacccccaccaaagttttgccagtcagccccaccccttcagcaagcagcccagtctctgccctcaccaatcaccccagggtgactttgggcaggtgaatcctggggctccccgctcctttactgggccctcatctcctgccaccccaagcttgacctcccagggctttttgggctcacatctccaaggacctgggtcccacagccccagaccccaccctcaccagtcatccctgggtgactttaggctggtgaatcctggggctccctgctgctgactcttcccttccctcctgctgcctcaaggtggacctccctaggctgtgtgcactggcgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcgagactggcctttgatcttatgacccagtcccctaagcattgccaccccatttctggttcctcttgtcacagcacaaatttccagctggaaggggaatggagattgggacctaggagcaagaggtttcaggctgcctcactcccttaacacaaacattgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagtcagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaacagtataccagacttctctctgaaatgaggcttgggttgtcctctttctgataaattcccagatttaacagaaaggctgccttctgccatgaggacacattgatataagagtttgagaggtacaggtgcacttcttcacactaacagacgtgtgaggatgtatgactaaaccacatggcatacagttcctgcctacttaatgtttacttttctagctctgcctctggttttggtccctggcagctgatgattcttggtaaaaccccagagtttggagtcagaagactgagtttcaaagttcatctgtcgcctttttcttttcttctttttttttctagccatgatatcaatctctttgagtcactaaatgattgtgacaacaccttgtacagttgttggtatcattaaatcagatggtgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagattgtggatggactgttgggtacctgtgaagaattctgggtttgaatcctgcctctttgtctgctagggatatgaattagggcaagttgctagacctcatcgggcctctcttttcacatctgtataatagaggtggtattgtttcacttccatttgtgaagtttaaatgagatttgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccgcagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcaggccagccctccaacctcctcctccaggtgggacggggtgcccctctgccagctgagacagtccacacacaccccagccctaatgattgttctctctacctctccccccactcctcctccacctcctcctctctgcatgcgcctcagagcccgtgccaagaactagcagtagtcccagactcgaggtccgtaaaagtcagtcaactgaagaacaccatcaaatctttggtaagagtccactggggtcccctgattccacgctgccaatcctgggctctagtttccccttggggccctgaagaaaggggacggcggcccctggtgccaagggcgaatagggagctggggcgcccaggcctcacctggagggaccccggagcatgcagcatggctctttttttgctgccctgtttgctgactctcccctctccagatgcccctgctcgagtccttgctacacacgccctgggattgttgcctcttggggaagtgctagcctgactggttgtcagggtccctgtatttctgccatgactcagtccctaatttgctctttgattctggacaagccacctctcctttttgggctcatgtttccatgaagtagtgagtatcaaaggtctctgttagctctcgagtctgagatttaaaggcctcctagaatggaaacctcagggccaaaggctcctgtctgtccttttccaccctaaatcttctgtgaagaaccgtacttggcccatacgtgctcagtaaatgtttattgaatgaatgcacttttctaaatcacaagctggcagaagggggggcctttctcaaactccatctctagaggtttatattgctgtcctctcaagagattccagattcagaccttcagttctgtggctgtgggcaaaagccaacaaagacccaaatcctctgtccttgggagcttgaggagagtttaccagttcgagttcccactgggtctgagaactttgcctttaaaatccattcctggtccctgcctaccacttcctgctctggggaatagagttgagggggccaccctccatcaccttaatgtgactctccccacagaaacaacagaagaaacaagtggtacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacggtgtgcagttttctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctggcactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccccgtcccctgggagcctggctttgcagacagaggagtgagcctaaaggtcccttctgcaggatggagtgtcctgcccagaaggcagcatggccatttctcactgcttttttgtatggttgttagcggcagcttgggactgagtcagctgctgtgggtgagttggggggcactctggggacaaagcacaggacgtagagcttggaggccaagtgcctgccatgcctttacctggctgtggtcttggccaagtcctcagtgggtattgggtacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtctgggactatttgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtggttgtgaggattaaatgggattgctagcatggtatctggtgaagcactccataaaagttcaaacagtggtaataataacagtaataacaacagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctccccagattgaaacttctcactcttcagcagttctccagccgcagtaaagcacgtacggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtagagccagaggtggtcatgggactgggctttgtggaggtgggggcagagagggagagggcagcctgtccagcctccagcccctctctccagggccctttccccctgtgctttgggcaggtttgctcgttgaagaaggagaagaagcatgataaatatcgggtagagacgctggagaggagcttgtccaaactcaaaaaccagatgggtaagatggggctggcgtgacctggcagcaggactggcatcagagggctgtgagggtggcttggagtgccccagcgaggtgggtggatggaagggctttgaggcagagggaaagaggtctgtgccaggagacggcaagtcttgtcatctcaatgagcctcagtgtccccatcagcaaagagggcccgttgtcagccacccgcagtgctctttctctgaaagtgctttggaagactggctaccatctgggtgcgaggaatcattagcagtgaggccaagtttgaggagccggagaggagctgtgcgccaagaggagggttttttcttttcttttcttttcttttcttttcttttctttttttttttttggaatccagaggctcttattgtctgcttcctttctcagctgaacctctgcccccggagcccccagcagtgccctctgaggcggagctgcagcacctgaggaaggaactagagagagtggcaggagcgctccaggcccaggtggagtacaatcagcgcataagtctcctgaatgaggggcaaaaggagaggcttcgggagcagcaggagaggcttccagagcaggaggagaggcttcagcagctggccgagccacagaacagcttcaaggagctggtgcgttgccccagctggggagcctgccctcctccctagccctccaggcctttgtttccccacctataaaatggggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggtgggcaccagcctctggggaggggaggtgccaggccagcggtagctccagcccaggggcaggtgaccccagcaccctccagggcagtcctgtggctgtttcttgcttcctgccctctgattttagaggtgggtagccctgggctcctcccaggtctggacatcatcattccagctagagacatggagcccccccaatcacaggggaagagacagagtggtataacagtcttcttatgccagatgcggtggcttacgcctatagtgccaacactttgggaggctgaggcaggagaatcacttgaggtttggagtttgagatcagcctggccgacatggtaaaacctcatctctactaaaattacaaaaacaaaaaacaaaaaaagaaagaaaaattagtggggcatggtggtggcgcatgcctgtaatcccacctactcaggaggctgaggcacgagaattgcttgagcccaggaggtggaggttgcagtgagctgagattgcaccactgcactccggcctgggccacagagtgacactctgtctcaaaacaaaacaaaaagactccttagattaaaactggattccagcctcagttccactggtcaccattcaagtacttcgcatctctaagtctctgtttctttaacttcaaaaggaagttagcattttccttacagaggtgctgaggattaaatgagataatacatgggaagcattaggcctgtagcacatttagcagatggtggttggctcccactacttttctaccattctgtggcctacagttgaaatggtgggaagaggacatgagatttgaggctggggaaggaggcatggggttctaggaaagcaaggcagtcacttaggcctgaagtaaggggccaggggcctgggcaggcgacagagccccacagtgccctcgctaccctattaatgggcccagaatctgcaaaccagccaccatgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtggctgcagcagacccagctaatgaaccagttgcagcagcaggaagcttggggcaaagcggtggccgagatggcctgccaaaagttgcaggaggcccaggggagggagctgccgaggatggggccgtgagggggacgacctggcaaactctgtgccttctcactctttcctggccccttaggagcgtctggaagctgccagccagcagaaacagcagctaacggcccagttgagcctcatggctctccctggggaaggtacgggagaccgctcagaggaagaggagagagccccaggaggaaggggggactgctagcagcataggattgaggagttggaagagacctttagaacagctggtcattatactaaccgggtgcctgcactaagttcagcatcaatatggtgacctcctgggagcggggggccaccaagttgcctaaggatggctgaactggccgaggtcagaaagggagcaggtcagaactcccgcaccgaccagtagtgggaatgtgcctgggcagtatagcaagatcttggttcttcaaagtaaaaataaataacagcagctcattcctctctggggaggggctggctcagggttacacaatgagggtggaggtagaggtgggcccacaatacttcccttgttgagttgtctgaggacccctctggccaccacccccacccccaggagatggaggaggacatctggacagtgagggggaggaggcacctcggcccattcctagcatcccacaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtgaccaacatgtgcagtctctggggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtggctgccagcgcctggctcacctggtggcctcggcccagaaggagccagaggcagccagaggccctggagccccagggcctgggggcgagtctgtgagtggggagacccactgggccctgcaggaagtcacggagaagctggcccatgccaggactcacctccaccttctccatgacttgaaaatgccacctgagggcaggtcgctgccgagatgtgactacaatattttggctccagagcagctttatggaccacctggaggagaaggcagacctgagtgagctggtgaagaaacaagaacttcgcttcattcaatactggcaagagagatgccatcagtgagtgggaggccagggcacagcagggggagctacagggccgtcggaggggccccagcgtctgagccctgtcctcccgcaggaaaatccatcaccttttatcagaaccagggggccgtgccaaagatgcggcactgggaggaggacaccatcaggctggagctcagggaggagatgaaggtagggtgtgcaacatctctgtgggggtgggggtgggggtgggtgtgagggtgggcgcaggcagcggcatggcagctgagcacccctccctccagatgaagctgctggagctgcagcagatggtattgcggcttacagcaactacaacaatgggcacagaaaattcctggccgctgcccacaaccctgctgatgagcccggtccaggagccccagccccccaggagcttggggctgcagacaagcatggtggtgagtagagccctcaggtggggtgggcaggcaggaagagggggctcccactgtgctcagatccctgcctccctctctccaaagatctttgtgaggtgagcctcacctcctctgcccaaggagaggccagggaggatcctctccttgacaagcctactgcacagccgatcgtgcaggaccaccaggagcacccaggcttgggcaacaactgctgtgtgccattcttttgctgggcttggctgccaagaagaaggagataaacatcaccatcatcaaagagctgctcaagaaatttttaaataagaaaccaagttatggggttaatctcctacacaattcatttacttcctttgaatgttagagtcactcatgattatttgtgtttctaatttatagttttaagtttatttgtaaaaagttaaaagagagtgggtgtctgtggctctcactgatgttcactctggcatcctttagcatttttcttttttaatttcataattgtaggtcattagcatgcatatcgagtttgcccttacgtggtgggggttcaaacacacaaagacccactctttgcccaaaactgttctcgctggtttggaataggctgccatgcttttttaatgttattgcagcatgtatattcactacagaattcagacaaaatttgcctatgttctgctgttgtttgatctaatcttaatcacagtgagctcttcgttagctcaatatgtagtttgcccccaagcgtgcactgtttattactttgtaatatgccactatgagtactgacatttagagttgtttaaaggccaagaactggaaacagcctttcctccattttctgtgtattggtgatgggagtgaaaccttttgagggagctttttaaatctcacagaagaggaaagtggcctcctctggcaggtatgtccaggatagagtgtgtttcatctgttccggtgccaggaattagcagtgtattatggtggttcccttaggatttgtatgtgctctgggctcatgaagatactgcatcatgagctgcagcagttgtactctttttcaatgacctaaaaagggcttatttctgaggaatgaaaggttcccatcgttgactgtggatgtggaaaacctttcctagcttagagcatttgtatctacaatacattttaaactcagagttcatgttacctgttttaatcacatgactacatgtcccagtacacaaaagggcactggttggcattcttcttaatgtatttagtaaagatcataagaaatcctttacgagttcaaatgtccctggaacaggcatacaggctctagtcaagaatgaattagagtgaaggaaagctgtgtgacacctggcattcctctctgttcacggagattctttgaggcttgaagattgattttaccatctagacctctttggctaatacctattcttcaaccaccttggttactctgacataggaatttacttctttttccttgaatggaaaacactttaaaaaataatagaaacattattataaactaatatatgtgagatacttagttgaaacaaaagggagttttagtagacggtattatactatctttgaaaatcaaggagaagtttatgaaacttaaaatgtgtacaaactgcagtgcaatctactgttcgtgaatgtcaatgtattatcaggaaacgtgcctatacaatcacagagttatattttctcacagacttctttacaaagtgaaatatgtttttgtatctctgggtttctgttcgggacatattttgtgcaatatttatgtgattgtgcctatgcatgatgaatgaatgcatttcagttatgtattgcctaaatcgtaacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttcaactgactcttccaaattttatgaatgtatcaatgtattagataaacccagtttcagaatgataaagaaaaaatgttagaccaaataatgcggctaattaacagtggtacgatttctagcccgtgggtttaaaatgcacttaaagtcctgttctcgccttttattttctgaacttgccgcttttgcattctttgagttcagtttaaagacggttactttaagagcattttaaaccctcgggctagaaatcggaccactgttaatcagccacattatttggtctaacgttttttcttttatcattctgaaactgggtttatctaatacattgataaattatttcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtcatatatttaagaaaaagctaaaaggaatggaaattgtatgacaataacttaagtctttctccaaagtgcatgcagtcttttgcgatacctcattcagccgagtatttgtgctcttcctcattcggtataaggcagctttcagtttgcttagaaggcaacattggaatgttagagttcatcagaaacatagaattttaaaatgtgagttccactgaatacattttaatttctgtaggaagaatcaaaacacctatttaaagatggcaatatataataatcattttaaaagtatttgattaaacctgataattttccagaaatgaaaaaaaaatcagctctaaaacgaaagctgattttagaaaatttgaaaatgtaaatcagccctatccataatatagtttctctaaaactttatcttagagtcattttaaaataatataactattaaaaatgtaactgctatcttaatgttctgaaataagttaaaacattttaaaatatgaatactatagtataaaagaaagaaacagtgggaaggaaaagcagagaaagaaatgccaattccagtccaaagctttatttgccaagttttgttagaatgaattttaccagtttgtgaattcttgtaaacagaatgtgtaatggaaatactgaaagatttttccctagagtggccttattgactgctggtgtgatgccactgtaatgtaataaatcattaaattgtttctaagtgttgtttttgccttaaaattttattttgtgtttcttgaaaactatagtattaaaggtattgatactgtgcaaatgctgggcatgcttgacatgagataatgtgtttcatttttacaaaattgtaatacaactatgcaagtgtttattaaaaacacaaaataaaaaagttatgggtttttttattaaaaaacttttattaaagttttataaaaagttattttattaaataactttttattaaaaatggttatggggtgaaaaagttatgggataaaaaatgtaaaaaagttgtggcaaaaaaacttctgggaaaaaagtagaaaaaagttttatgaaaagttacaaaaaaagttatgaaaaagaagttatgggatttttttaaaaagtcatggaataaaaataaaaattaaaagcaggcccctgtcagcaaagcctggagaagtggggccggagtctccaccgccaccatgtccctaccacctcttcccaggcacccctttacaattagggtagcaggacaagacctctgtctaatggggaaagacaaacagaccatttgccaccttgaccagggctgagtccctaaatttctggatgatgatgattgttacttaaaagccagaggctggtggagttggtttgtttggaggaggcctgatggtccccttactctcaccatggcaacgtttccctcaggggggctcccatcttcttattcagagaggtagctgaggccagaaagcggggctaactgtggaccagcgagggcatgggctgctggggtggcccaccttccccggtgtacatactgtgtctgtgtaacattttgtatattccagagggtagggctgcccctgtatcatacctagcagaggttggagctggcacatggggaggaggttctaataattatttgtggctgggaaacttatttattgctagcgcaggacagaggaaagaggcggggatggggtcgtggctctctggtggtatgatcacagcttactgcaacctccaactctcaggctcaagtgatcctcccacctcagcctcccaggtaactgggagtataagcatgcactactatgcctggctaatttttaaatttttttgtagagaaaaggtcttactatgttgccaatgctggtcttgaactcctggcctcaagcaattctcccatcttggcctcccaaagcactgggattacaggcatgagacattgcccctgtccattaggttttctctttattactgttttgttgttgtggttgttgttttgttttattttgttttgtttttttgacagagtcttggtctgttgcccaggctggagtgccgtggtgtgatctcggctcactgcaacttctgcctcctggttcaagcaattctcatgcctcagtctctcgagtgcctggggttacaggcatgagccactgcgcccctggctaatttttgaatttttagttgagacagagttttgccgtgttggccagattggtcttgaactcctgcctcaaacaatccgccctcctcagcctcccaaagtgctgggattacaggggtgagccactgctcctggctaagatcccatctctatttaaataaaaaaagaaaattcagagcatgtggaatacagaacaccaaagtccaaagttatttacctctctgaggtaatctgtgtaaacaatttgaaatatatcttttcaagttcatacttgctatgcatatacatacatatacacacatacgttgacatagttccccttccctgctgtcatgctattagagtcttctttttttggtagaaattggaccaactctatgttctttgctggcccatatttctcctattcagtgatgtgttacgaatgtgtgtttaagtcaatgtatgcaactcttcaatatcattttaaaaggttaaatatacaatcatatgaaggcattacaatttattccaacagttccattttgcacatttaataatttccgttggtttgccagggagaacattctcatgccatggctaaatccttttgtacggccatccttaattattccctgaagataaacttttaaataaagttgctagatgagtctcatttcttaaaaagttcttttttggtagtttatatgtaacactgtagttttatatgtacttgcaaatagctatagtgccagtaaaaaatgtgataaaattaaactctttcacgtatgccaaaaatattttgatttagtgcttcattaagtgcatgattacagtccctgtatcttttgatttacctttctacatttacaattttcagcccagatacttagaggtcacatagtaaattaaggttttcttttttttaataatctccgtctttctaaatttggtgagtcacagtaagttatttttgggttgttgaaagctgtggctctgttctaaatatgagcccagaaatcatgccacttacaaaatatgctttgtcttccaacaacagagagtctggtagaaggtgactgttcttggaacttaaaaagtctcaacaggacaagaacagaatctggaaaatatttctgtttctgataatacggctgagtaggtagacatgctggatactccttgcaaaggcatacttgaaattgccacaccaaaaaaaatccagaatctctaagactgaagatgaagtgaaaatcagaagggctactacaagaataatggggaagcagccccagttatcaagtgacgtgtgcatgtgttcaataaaaagttccaaacctaaaataagttgagaaaaataatgtaattgccctacatatacacatcatcaacaatttttcattcatggtatggacagttttttggtttttgtttttttgtttttttttttttaaaaggtgggattttgctgtggttgcccaggctggagtgcagtggcatgatcttgcctcactgcaacttccgcctcccaggttcaagcgactctcctgcctcagcctcccaagtagctcagattacaggcacccagcaccacatccggctaactgttgtatttttagtagagatggtgtttcaccacgttggtcaggctggtcttgaactcctgacctcaggtgatccacctgccttggtctcccatagtgctgggattacaggtgtaagccaccacacctggccacagccagttttgtttgatttatattcccacttcatttgtatacattccttcttcctcttattttgaagtaaaacctatacatcatatcattttttaattaccttatatgtatctgtagaagacaaggaatttttaaaaacaaatatattcacaatgccattaaataccaaaaaaattaatattctgaaaatagccacaaatccagagttcacattttcttgactttctcataagtgattttttctaggttatctaattcaatcaggtaactgtttgctcatatttacattcccacttgaaaaatgtctaaacttaaactgacataaaacgcagatgatcttccgaccaaatgcttagtgtaaaaaaaaaaacttccaactccaagaggagtccctccaaatacagaaaggaccagtattttaagaggtatgttaactaaaatgtggcaatttaaggagcagagcaggaagaacctttaagtccgaaacttacaacaagtcaatttcatagtccgtttccctggtccttccacagcaacctctggcatctgttttctctacaacggaggtaaaaatagtagctgtttcattagagcagtgctagaagagggtggtggctatataaagtttagctatttgtatattgtaacaaaccaactttttttttgttttggtcaataatagacttcttttggaaaagtagcagcctcctgtctggggacacctgcagttccactaagagaacattggtgtctgctaacctttgcctctatttctctcaataatatactgtcaagctgttccttgatttagcaattttatgtacttccttttcctttcttttttcttttcccttttcctgagacagagtcccactttgtcacccagtctggactgcagcagcgccatgatggctcactgccacctccccccgggctcaagcaatcctcctgcatcagttttcagagcagctgggattacccgcggggcccaccaggcccagctaatctttgtgggttttgttgtgtttttccgttaagagactgggtttccggccaggcgcagtgactcacgcctgcaatcccaaaacaccgggaggccgaggcccgcggatcaccggaggtgaggagctggagaccagcccgaccaacatggagaaaccccgtctctaccaaaataaataaataaaaaagtagctgggcatggtggctcacgcctgcaatcccagccactcaggagggtgaagcaggagaatcacccaaacctgggaggcggaggcccggggagccgagaccacgccactgtactccagcctggacaacaagagggaaactctgcctcaaaaaacaaaaaacaaaaaacaggtttcaccatgttgcccaggctggtctggatctcctaggatcaagcgattcgcagcactcagccgtccaaagtcctgggatcacaagcgtgagccatgacgccaggccgatctattcctgtctgattaaaaattgggccgggcgcggtggctcacgcctgcgatcccagcaccccgggaggccgaggcgggcggaaagcctgaggtcagattgaggccagcctgagcaacatggagaaaaccccatctctaccaaaaaaaaacaaaatacaaaagtagccgggcctggtggctcacgcctgcaatcccagccactcaggaggctgaggcagaagaaccacccaaacccgtgtggtcgaggctgcggggggccgagatcctgccactgcactccagcctgggcaacaagagtgaaactccctctcagaaaaaaaaaaaaaaagaggtagagagactgagtttcaccatgttgcccaggccggcgtgtaactcctaggctcaagcgatccgccgcgctcggccatccgaagtcctgggatcacaagcgtgagccgccacgccaggccaatctcttcttttctgattaataaattgggcctggcgcggtgactcactcctgcaatcccagcaccccgggaggccgaggcgagcggatcacctgaggtcgggagtttgagaccagcctgaccaacatggagaaaactgtctctaccgaaaaagaaaaaaaataaaaagctgggcatggtggctcatgcctgcaatgccagcaccccgggaggccgaggcgggcgggtaacctgaggtcaggagtttgagactaccctgacgaagggagaaaccccccgtctgtagcaaaaaaaaaaaaaaaaagtacaaaattagccaggtatggtggctcatgcctgcaatctcagccactcgggaggctgaggcaggggagtcacccaaacccgggaggcggaggccgcagggagctgagaccgcgccactgcactccagcctgggcaacaagagtgaaacttcacctcaaacaaacaaacaaaaacaaaacaaaaaagcgagaccgggtttcatcatgtggcccaggcctgtctggaactcctaggctcaagcgatcccccgcgctattcctttgtgattaataaattaggccttgcgcgctggctcaagcctgcaatcccagcacctccagacgccgaggcgggcagataatctgagctcgggagtttgacaccagccttatgaacatggagaaaccccatctccaacaacaaaaacaaacaaaaaacaaaatgagctgggcatggtggctcacgcgtgcaatcccagccactcgggaggctgtgacaggagaaccacccaaacccgggaggcggaggcccgttgagccaagacctcaccactgcactccagcctgggcaacaagagtgaaactccgcctcaaaaaaaaaaaaaaaaaaaagagagaccgagtttcaccatgttgcccaggcctgtctggatctcctaggctcaaatgatccccagtgctctgccatccaaagtccctgaatcacaagcatgagccatcatgccaggccgatctgttcctctctgattaataaattaggcggggcgcgctggctcacacctgcaatcctgtagcggaatttttaaggaattagatagactcacggggtttaggaggacatttattaattatttaggtgcaccggcccagtcggattaacatttaaaggattgagtactgaaccaagagttacctttcaagcattatgtagggcgaagggggagatctgtgcagggagaagcatattatagaagcgagaaacaaagatagttatttaattgaaacatgcatttttttttttactatttaaggaaaaatatgttttgtgacttgagtttatttgtttaggcacctagatttattttgtttatggagataatagtaggtacctcataggggattattagatcacgcttaaaattggaccatacttaatactttaactggggctttaaccatcatcatttacatcatccatatcccattatctttccttttggcagaaaggcatatagtgaaatctatgcaaattaaatgaacatatgggaaactcttttttgcagaaggtgttgtggggctccctctacatgacctgaaaagtacctatatggctgtaagacactttacatatcacctagtttataccctggcatgcccatatgacctactaaatcatacaaacacaccaggttctaatatacagtaatattcattttttaacttttcaattaacatataatcctaaattgcatgctttatgttgaagaaaaaaacagcaactaatataccatcatagtgacatattaaatgctagtttagcctgattctcccagtgtaacaatgtatttaaaattttgtagatatattcagtatatgtttcaacatgtctttgggccatatgtattttgtgctaaagtttctctttataaaaaagcaaagcaggagatgagagttttatggtgggaaatgaattcaattattatattctaagggagattaaagagaaaaataaattttcctgttaattctgtgaccaacaaaagtaagcaatatagctgagaaattcatctgagctcacagttgattatatatatataataatttttttttctctaacagagccacaaccaatgagacaattatagtttcaccaagtcaaatgtcagctagaggacttacagtttttacacttggcaaggcaaagcaaagaaatgtgaagaatcctcatttacttgttagccaaacttagtgtcaaaaaaaaaaatattcatcattggttgtcaaacacagggtagttctctgtcactggaaacttctgcagacaggataattactatgattaaatggcagtggatttaaaatatttcggtagtggttaaagtaacttgaatactgatggtataatatcaaatcaaagctgcaaaactgtccgctaattatccagagtataaagtatctgatgctgtgtaagtataacgccaaagcacattcacaggtacagaaattgatgagggcttaatcatgctttttggaaatatagtaaagaagataatgttttttctaccttaaaaaataaattttagaccatgtccttcaagctatacagtttgtattattgacaattggctctgattatataatttactctagccattgctttcaatttatttatctatatttctgattattcctctaacacaaagatactgagggctttctctgtgttaggcaacagctgcaaagctaactcttggaatacagagatgtgaaacaatgctagcatggctcagaaatagtttattgcctcatgaaatttttagcttagtcctattcccataaacatttctatgtgagtggtggggactgggggggcacctcactctcctccagggacaggccatgtcctaagcagtagtttgaaggtatcactttggagaatttaggtctggagactctgtagaaatcagtgaggtttcaaagcatcattattacattgcaaagtcacatgggcaggagtagataagaagtaatatgttgtatttcctcttttgtagtgtgagttagttgatctaaatgttcactgtgttttctctatctttgaattatgtgtaacaacgtagatagcaaagagctgtcaagaggccatgagatttcaaataaacagttaagagcatactccaggaaactgtaaaagaactaattagagtccacgtgttcagtgtcagttcaaagacacagagagataggtgctcaacagatggaatatgttagaacccgtaaaaatgaccaagatgggatggcacaaaatcagcagagctataatcaataaccaatgaattgggactctcttctgtcttttccactgtatttgggtcttcgtaggttattcaatcatgtttgaagtgatgaaaaaccattattcattctcaaggcaaaagaactagatatgcttttgggaaaaagaggataacggaaggtttttaaacttttacaatgggccattctacatgcagtgtacaaatcatctaaaattcatttttcccctagaaagacagatcttaaaccagctagaagttataaataatgtggttcatcagagctgtatactcttaaattcagattttctgagtccatcccacattatcctagttccacaagataactgcaaaaatgtctcattgccaaatacattcaacagtgaactatatagttgcctccaagaaattcattgcacattggtctgttcattgcattaagaaaccttgcagttaaaaacaaacaaaaaatgtacttagtatgttttaaaatatagcatctccaatattatttaaaacttactttccttgttgtttctctgaatatttctcaaaagaactattggaaaatattgcttaacatgattgatcttccatttgattgacctgcgtttacgcccatgcctattttgtgcaggtgatcaattcatttgtgaagagtgctttcataattatgcattgaaatgcacaaggttgtcatccctcaaaaatgctactattatcacccataattaagtctaccaaatttacactagaaaacaaacacaaagagaacagtgggtagttgttagatcatttagcaatcagaggtaaaaattagtagcagaaacaaaattattgtcatttctcaaattattttcaaagacaatgttgccttattactaatatttgattgggaacatttacaaccattaatctagaaaagaaattcttctactgcaatgcacctcctctatttacgtgtgtgaatgagtgtccattttcttaaagttccaagttacttattcattcattaggtaatcttttttcacatggaacgaaatttttgtggtaatttatgatagttgaaaaaaagatttggggtgattataaccctatttagatatttctgcctgcatctacatcatatcaaaaaaagtagggcctcctctcccttccctgaattaactattggagggggccaggcatggtagctcacaattatagtaccaccactctgggaagctgaagcaggaggatggcttgagcccaggagtttaagaccagcctgggcaatatagtgaaaccttttctctaccaaaaaaaaaaaaatttttttttaaatattagctgcacgggcctgtagtcccaggtacttaggaggctgaatcgggaggatcgcttgaaccctggagttttgactgcagtgagctatgatcccatcactgcactccaacgtgggggacacagcaagaccttgtcttaagaaaaaaaagaaagaaaaagtattggagaagtttttaatctgtagcatccttagtcttcaaatttcatacctttattaccactgtcatgtttcatgtgctcaacaaatgttaaaataatgaatctcagcatgatttctagagatcgtactgagcaggatttagaggggcaggggggtttccccacttgtattcctgtccttcatatctgtctcttctggattttttagtttattacttttcagggacaagcttttcgtttttctcctctagatcagcataatctgaaaaatattaaaattaaaataactaataatagactgcattaatagattagttccttgtacagctttcatcgttttaagtgaaaactttctataagttatttagggttttgaatttataatactgtaattaaaataagggttttttcctcccactgacagtaaagctgtcactgccacaagatttgagctaaaagaaaatcgtagattttgtacttctttgtcagcgctgccaaaaaaaaaaaaaagagagagagagagaaagagacatcttgacaacttttaattcaatcagagaacttgagtgaatcgagctttcttctgaagcaccattcatcgagcaagacccctgacggtgccaggtggaaacttaatggatcctttccacctggtttgttttcagtgtttaatcctattagtatcagcaggatgtaagtcagggtatcaggtgcagaacctgtggaatcagccaatttggcttgctcgtttactttaataaggtcccataatgagtgagagtacaaagttcaagccctgttgagggtctgcattaaactctcagaagtatttagagtgtgccaggagccgcgagggtctggttcgggtggtggcgggaactgtgttagagcgctaggtacggcgcgacaaagtctgtccaacccaaaacggtgctgaggcatggggtctgagctccggtactcagaaaagcacctcagccggtactcaacagatcctcgggggcttgggggctcagcattggcagtgagggcatgaaagatataaaagacagggcactacctgtgggtattttctgttctccaaggaggaagtagcaaaaattaggatgctggaatatcctgtgttgtagcaatcccagaacaactggtgctcagcaaataccacacaaaacaaatttttaaaaatttaatctcgccggctacagtggctcacgcctataatcccagcacttctggagggcgaggcgggcagattacctgaggtcaagagtccaagaccagcctggccaacatggcaaaaccccgtctctactaaaaatgcaaaaattagcctggcatggtggtgcacacctgtaatcccagctactcgggaggctgaggcaggagaatcacttgaaccagggaggcggaggttgcagtaagctgagatcatgccattgcactacagcctgggttacaagagcgaaactccgtctgaaaaaataaaaatgtgatctctttgtatctgttctttttcttttaatttttttcttgacccaagcatgtgaactcatagtatacattttgatatcgaagatacactaagaattaagtactagacccaatcccagataacaaaaagtgacataaatagtggaagaaaggactatttattgggtttatactattagacagcgtgctaggaacatcctttattgtcttgtctagaccttttaaacatgcagtaagatgcagatactctttcccagttgtacagaggaaactgaggcttagagttgcagacttaaaagtatctaactgacatgtgggaggatgggaaactcatccagactttagaggaaatgaaggattcattacacaggtgagtgtttcttgcagctgttctagatcagaaacaattaccaatctagactttcatgtgataaagtcattcgatagaaatccaagcgggctgggcatggtggctcacgcctgttattccaccaccttgggtcaggagttcgagaccagcctggccaacatggcgaaaccctgtctctactaaaaatacaaaaattagctgggaatggtggtgctcccagctacttgggaggctgaggcaggagactcgcttgagcccgggaggctggggttgcagtaagcccagatggcgccactgcactccagcctgggtgacagagcaagactccaagactccgtctcaagaaataaacaaagaaagagagaggagggagggagggagggaaagccaagtaaccactctccttcagggcttctagtttatgtatacactatgtactcagcaaatatttttctcttaagtgtggttgtttcgatcctattttcaggaggtgaatgtacagcgtaagtcccctccttttctgttgatatgactgtgttgattggtagtgccagccactttccatctgagcagttctaggtacatactcggttggtacgcaaaggaaaactattctgcatgccattaatgctggaataaaatgtgtttaggaagtgtggctgttttcccaggtcatgtttaattgaaggatttctgtcacatacttgttcttgttgatgtgttcctggggcctggagaaatgctgcccaccccgtcacttctctggagaatctcagggctgcatggatggtatgatgctgcccgggctgaccattctgaaaatactgctggctggtccctagcagcaggtcagcaccttggttacacggtgtttacagaggcatgcccaaaggagatacattgactattcctggttattttttgtcctgtaaatagagacattgttcaaagtcttttttcccctaacatttaaaacaacacgttaggccttttaagtgtttgccaaagaacctggagttttactggagtcttgactaacctgctgaacttttcaagctgaaaccctgagggttacagtataaaaatttagaacctacttagagcagcagtctcctcatgctgttactggtctccttaaagtcagaaacaagatctacagctgctgctgtcggtcacctgagagaccaggctgaggcagcccagcgacctcccaaggagccttttaattactaggttcaagtgtggtttgcagtgaacgtggcgaaggaggtgtgggctgctgtgcagtgaggcagaggcagagcactcagtgcgcatttgtgccctgcctgttcctcctggcaactccaggatgtcatcagccttgcagggagggggctcaccttcttagtgtgggaaactggccccagggcatacccccttgagcgtttcgtagttagaaacttgtgtgcagcttcccaagggaccttcctgtgtacagatgtccactctgtggaaaaggatacaatgggaagcttccagtgtcctgtgcagcttcttagattccatttgggattcacctggaaaaagcaatgccttaccccttgaagtttctccatttaaactccagttaggtaaaggggagaaaagtagaaatattcaccttttgtgttccccatcttttaattttttgttgtttcggttaataaaaataacatattcagcatgagaatttggaaaatgcagaaaagtagaagacaattaagcccccagccccccactcgatgctgtggtaacaagcattcttgctctgcggccaacctcataccctgtatgcagcttgtatcctgccttttccccttttagaaactcttggccaaataatcttaaccataagcatagtatttcatattaaaattttgttggttttcttttaaaacattgtttttaatatcttttgccaggtcagcttcaataagatataattgtacccaatgaaggtcatcactttcaggtatgcaatttgataagttttgacatctgtgtacagtcatataaccaccactatgatcaagatatagaactccatcactccagaaatttccctcatgcccctttggagttgatccttcccccaacccccacacagatcccagcagccattggtcttctttctgtccctgcgattttgtcttttccagaatgtcatatacctggaatcatgtgatagttagccttttgagccttccatttaacttctttcatttagcatgatgcatttgcgatttgtggtggtgcgtgtatcctcagttcactccgttttactgctaagtggtattccactgtatgcaggtatcactatttatccatcacccaggggaaggacatttaggttgttgccagtttttggcaatcaagaatcaagctgctataaatatttgtttacaggtttttgtatgaattaagttttcattttctttgggtaaatatccaggagtgggattgctgggttatatggtaactgtatatttaacttcataagaaattgatacactcttttccaaagtggcatcaccattttggattccccccagcagtatacaaggcttcagctcactctgcaccttcaccaatacttgatattgatacacaccccttttgcttgtttgttcagcagttctaatgggtatgtagtggtatctcattgtggctttggtttttatttccctaatgactaataagcatcttttcctgtgattttttgccatccggatttcttatttggcgaaatatcttttcattttttcccttttgtccagggttgtttattttctgactgcattttgagagttctttatagattctggatacaagtccttttaagcattttacaaatatattcttctagattggtttttcttttcattttgttgttggtggtggtggtggtttgttgttgttgttgttgtttttgagacagagtcttgctctgtcgcccaggctggagtgtagtggcacgatctcggctcactgcaacctccgcctcccgggttcaagcgattctcctgcctcagcctcctgagtagctgggattacaggcgcctgccaccatgcccagcttatttttgtacttttttagtagagatggggtttcaccatgttggccaggctggtctcgaacacctgacctcgtgatccactggcctcagcctcccaaagtgctgggattacaggcgtgagccactgcagccagcctcttttcattattttaacagtgtcttttgaagagtggaagttttaaattttgatgaagtccagtttatcagatttttccccttggattttacctttggtgtcatatctaaaaaatctttgcgtaactctaagttgcaaatattttcttctatgttttcttccagaagttttacagttttaggttttacaattaaaatgtacagttcaagttaatctttgtatataatgcaagctatggattaaggtccactgtagcaagcggcagatgttcttaagtatctccctccctccctccctctcttctttccttccctccctccttccttccctccctccctcttttttttttttgagacagtttcactctgtcacccacccaggctggaatgcagtagcactatcacagctcactgcagccttgatatcctgggctcaagtgatcctcccgcctcagcctcctaggtagctgggaccacaggtgtgtgccaccacacctgacaaatttttaaattttttgtagaggcagggtctccctgtgttgcccaggctggtctcaaactcctgggctcaagccttcccttatcagcctcctaaagtactggattacaggcatgagccaccacacacagccaagtgtctgtttaaaaagaaaagttgttcctaaatgattccttacactccagtaaaacagggctgtgaaaatgagttatgtggaaagctgaccgtagctgctgctttttaaaaaccataccttcttatccgcccgttttgagactggccctttgttgatctacagctctccttttctggaagatgctggaaagaacactgttagtggccttcatttcccctctggtctgggtctcctgtagatggcttctacgattctggcccctctgtacacatcattctcgctcagcagctgcacaggtagacagtgaaaactagcatctttttgattatagactgttggcttcctggggaacagccatgttccatgttgggtcagcttattgataaggggaagagacctagcattcattaaaaacttacccagcaactttgctgtgtcacagaagtcctatatagcataaaatagtactaggtccatcttagatgaagcagtgagatctgttcaaggtcatccagctagtaaaatggttcaacttgacttgccttactccagaactttttgcttatgccattatttcctgttagctcttcatggaaccacttcctgtgtgtctgatggctcactgtgcactcacacacacacaccaactaatggcaggtgcagattggcaggtgcagatgacaagtattgcagtgcagttgcttttagcaatttatcttcctttttcttctgagctggatttaatttactttagtttcccacatttggcattgtagcttttacctttagaatggctaattggctactgcaatatttctttcatatgtgaattataaaagtggccttaatggatgtttcttttcatccagttaggtgtttattgtatcagtgtgtgactgggaaggccaggctagctgcaggttatcacaggcctcttgcagtacttcactggaccccttgagtccttttcagtggatcatctcctgcccatcttcactactccggagtggtctcaccatctttactgggagtcccagaacgtgtctgttcagagcgatgagacccagggcagaaagattccggttaccctttcccggtctcctcatcctaactccttggatcttatcacagtaaatgatcagaagtggaaattctcatgttagctgaaattctcttcatgtttttttcttgtgtttagacctcgttatctttaggcatccctgttactgatgataaccactctgattccctagtttgtaagacactgcaccccctccatatttaaaagttatttgccattggaggtatcatcaaagactactctccctttctaaaatcttggtgttagcagctagaagagagactgccagtcttccccgccagccctactttatgacttaatgcatggcaccacttgtgcagctgatgcctggtcgggccacactttccattatgaacatgctctttcctgacttccctcacattcattgaagtccagtcccggctcagttgctggccgcggctgcttctattgtagaaagtggaatgaataaaaatgaagggcttctgacactggggtgaaactttgtcactgaagagatcttttcaatccaagaagaggaacccagccagcttcgccaaagctggaaaaagctgcaaccttcttttgcccctgttgagatattggaacccccactggttggcttccctctgccctacagctgcccacctgagatttctcacctgggcagagccacagcacagcacagagaaactcagtttccggggactttggcagggatcttggtgctgtgggaggattcaaaccccatctcagccacttgctagctctgtgcatctggtcatattaccccacttctcgcaatctgttcttgcatctgtaaaatggggtagtgttaccacctcggtgggcttttaatgaagattatatgagttaaatgcccactgtattgccagcaaagaatccagcatggtgctcagtgaggaataccgtgcatggctacagtttaactcctgtgaaataaatagatgctggaggcagggaggtgcttcctccgcccccccgtgatgtttctgtggtttcaccttcccatgctgggcactgccctccctagacaagacctgtctgtggactgtttccagtacagctgtttagccagacgctggccccgtctgcagccatcacaggccctctgtctctctgctggtcatgtcatgctctcctcaaggtgccgtcctgctgttcatattgtttcattctttcccaccaggaagcatctggacgaacagtcctgccacgctctttgaagttcccgacacatggtaaccaagacctgagggcagcaaaccgctggtgctgtctctgtgagcaagagccgggtggcacatttggaagccatactgtatttaacttaatcaaatgtggtatgggaggggttggaaaccaagttgtctcctggggggaagaaaagacaggttttatttttgtggctgtgtttttttccctttttaatctaactgcctgttgatgttgacactcatcagggttgtaggctgtcatgaatgtgtacgtgcttaaccagtgaattccatgttgctcgtgtgaggcctttcctgtcatgacccactgtgcttaagaacctgcctgatggggagtgtcggctgtgaaatctgcaaaaagagctgacgttccggctgccgtgatcatgaattgggggtgtactctcctgcctgtgcatcttctcgcgctgagattttgaggcggttgcagccctcggttagtctcccagtggagagaaatcagttgtgcctccctgcttcccaccatagctgcctgaaaacatgacgctcttacgcttgtccttccatcaggaaggtgtccactcacgcccacccatgagggggcttgccgtatgccctggcctttgggcatatttatgtagagttcctttctcctaagacgtgagtttctgatgggggatgtacgagtaaaaaggttaacttctgttcttatgcgtggcgctgtgttcactttccagagtctgtttggatggcggtctcggggtacggcagcgtgtgtgtgtatgtgtgtttgtgtgtgtgtgtgtgtgtgtgaaatcgtgcaaatctacatgtcccagcccattctctgttgaaacagatcacagcaacgacaaacactcatggcgccgcttcactccacccgcttcagatagatcattgttagatatttcacatttttgtatggtggaaataaaaatgaaaaatgtatttccaaaagatgaaaattaaagacattttcataggactctggttttctcctctctttttttaaataagtgaatgatgttttcactctctagtaatacacagataaatttcacactcttaaaaaatctgctaagccactaaggctgatgttcatggatttttttctttttctttttacccctaactgctgtacctgccacgatgggtcagctcctcagtgcagagctgagccctggtgttaagtggccttgtaggagggtgggaggaatgaggacccttagcactcacgctggaatcccaggacgttatgcagattccgatttgtaagacaatttccccaatcaagagcctctgtcacacctgtaagctgagatgggaggatcacttgagcccagaagttcaagaccagcatggacaacacagtgagaccctgtctctttaaaaaaaaaagaaaaagaaaaagaaagaaaaaaaatttcttttttttttttgttaagcatgttaacttctctttaagcatgtttaaaaaaaaaacaacttctctttttttaagcatgttaacttctggagttttgtagccacaaagttagaaacccaggcttggctggaaggactgcccacccctcctgtagtcagcacccacggctcagtggaaagtgtgaaggtgggatggagacagacagtaaaggagggtgtatgcaggagtgtgtagagagggctgccagactgccgagtcagcagcactcacagggagaaatgaggagagtctgacccttctttttgaaagaaaaagagggggcccagcacagtgtctcaggtctataatcccaacacatcgggaggccaagacaggaggatcacatgaacccaggagttcgagaccagcctgggcaacatagggaggtcccatctctacaaaaaatacaaaaattagccgggcatggtggcgcatgcctgtggtcccagctactcaggaccacaggagaatcgcttgaacctgggaggtggaggttgcagtgagctgagattgtgctgctgcactccagcctgggcaacagagcaagaatctgtctcaaaaataaaaggaaaataaacaacttcacagggtagttgtgaggattaaatgaaattacatacaatgcccaggacgcgcaagtacatagtaaattgtagttatatttaaaagtcatggttttgatctgaaacccttactgcatttgcttctatcagtgggagcagacatagtcactggaatgtggcttagaatgaaacacccagaggagctttcatacatgcccagaactttattttctctgctgcatcaaatgacttaaaacaagtgagctgtggctcacgcctgcaatcctgccactttgggaggtggaggcaggtggatcccttgagccaggagttcaagaccagcctgggcaacatgacaaaaccctgtctctacagaaaatttaaaaattggccgggtgtggtggtgttcgtctgttgtcccagctactcaggaggctgaagcaggaggattgcttgagcctaggaggttgaagctgcagtgaactgtgattgcaccactgtgcttccagcctgggtgtcagagcaagaccctgtcaaaaacaaaacaggtgagctgggctaacccacttcctcctccacacacacacaccgggctttcttgacatatcttttgggcataaaatcctaggatggtacttctggccttttgataccgaggcccaggggcatattatgacaacaaggctatggtctgggggcttcttgaatatggtagccagatctggaggcaggcgtcagagtgggaacttccgtgtttccctgcagatagttctgtagtcctttgattttggagctgggctggagaccaagcgctgtggctctgtccattttcataactgtgtatttctccagttttccccttgagattttattatgaagattttcaagcatacaccacctaggtcatcattaccattttgttatacagtcatgccttgccgtcaacaatggaggtcccactagatgatcttagagctgggaaattcctatcagctccagtgtatctgtgttttaagctaagtgtttttacaaaggggtcaaatagttgaaaaaaatttagaagtttattaagtaaagaagttacagtaagctaaggtcattttcttcttgaaaggaaaatttttttaaaattcagggtaaccgtgagtcccaggccttcacattcactctctatcactcaccagaacgccttccagccctgcaagctccattcacggtaagtgctctacacaaatgtatcatttttattttttatactgtatttttattatagtttttctatgtttagatacacaaataccattgggttacagttgcctacagtattccatacagtaacatgttgtaaaggtttgtagcccaggagcaataggctatactatctaggtttgggtaaggacactatgatgttcatacaatggtaacattgcaggctgggcatggtggcttacacctgtgatcccagtgttttgggaggccaatgcaggaggactgagttcaagtctgcagtgagctatgatcacaccactgcactccagcctggggacagagtgagatcctctctctaaaaataataaaataaaaatccttctatccacgtttgggaatattaaatttttttaaatcacctaatgacacatttctcagaaagtatccccatcattaagtgacatgtgactgtatttgctttattacatatccttccattcctcaatttatcttttctttctttctttctttctttttttttttttttgtttacagacagtctcactctgttgcccaggctggagtgcagtggcatgatcatagctcactgcagcctcgaactcctggccttgagcagtcctcccacatcagcctcccaaagtgctgggatgacaggcgtgagccacagtgcccagcctacataacgtttttgagattcatcaatgttttgtaggtatcagtacttccttcctctctatttctgagtatggctctactgctgcttatttattcaactgatgaacacctaggctatttccagtttggggccattatgaataaagctgctgtgaacagtcttgtacaagtctttgagaacaaaatcttcaatttgggggagtaaatgccaaggagtggaactgttgggtcatgggataggtggtctatttagaaactgccagatctttttccaaagtgatcatgtaatttatactgtcaccaacaatgtatgagagttctattatctcccttccttagcaacatttggtggtgtcagactttaattgagccattttgatgggcgtatagtatatctctttgcagttttcgttgtcatttatctgatgactcctaatgatgtacttactggccacaggtatatcttcctttgtgagttagctgttcaattatcttgcccatatttcatcagattgttggtcgcttcattaagttgtagaagttggccaggcatggtaggtcacgcctgtaatcccagcactttgggaggctgaggtgggaggatcacttgaggtcaggagttcgagactagcctgggcaacacgatgaaaccccgtttctactaaaaatacaaaaattagctgggcatggtggcaggcacctgagcctgtaatcccagctacttgggaggctgaggcaggaaaatcacttgaacctgggaggcggaggttgcagtgagctgagatcacgccactgcactccagccagagcaagactctctcaaaatcaaaccaaaaaaaaagttgtagcagtaagttgattacatattttggacatcagtcctttgtcagatagttgttttgcaaatatttagtcccaatgtatggcttgcttattttctttttttttttttttgagacggagtcttacactgtcaccccaaggtggagtgcagtgacgcgatctcggctcactgcaagctctccctcctgggttcacgccattcttctgcctcagtctcatgagtagctgggactacaggcgtctgccataacgcctggctaattttttgtatctttagtggagacagggtttcactgtgttagccaggatggtctcgatctcctgacctcgtgatccacccacctcggcctctcaaagtgctgggattacaggctggagccactgtgcccagctggcttgcttattttcttaacagtatcttttactgggcagaagtttttaattaggatgaagtctgttttatagactttttctatgtcctgcctaagaaacccccaagttatattcatccatgtttccttcgagctttctagttttagcatttatgtttaaatctatgatctatcttgaattaactttttatggatggtacgacactagagttgagattccctcattccatatggttgtctagttattccagaaccatctgtggagaagacctttttgtttaattgttgtgctgctttggtcaaaattctgtttacttaattataagcatggatcttgagggggtgtgtgtgtttcattttatttattttcattgacaaataataattgtacatgctcatggagtacatagtaatgtttctttttttttttttttttttttttggacagagtttcgctctgtcacccaggctggcgtgcagcgccccaatcttagctcactgcaacctctagctcccgggttcaagcaattctcctgcctcagcctcctgaatagctgggattacgggcatgcatgaccatgcccagctagttttttgaatttttagtagagacggggtttcgccatgttggccaggctggtctcgatctcctgggctcaagtgatcctcccacctcagcctcccaaaatgctgggattgcaggagtgacccactgcccttagccaatagtaatagtaattttttgtttgtttgttttttgagacagggtctcgctttgttgcccaggctggagtgcagtggcgtgatctaagttcactgcagccttgacctccaaggctaaagcaaccttccaacctcagcttccagagtagctgggaccacaggcatatgccaccacacctggctagtttcttgtgttttgttgttgtagaggtggggtttcaccatgttgctcaggctggtctcgaactcctgggctcaagtgatctgcccgcctcagcctccctccagaagtgcgggattataggcgtgagccaccacgcctggcctggatcatatgatgtgctatttgtagtgttttgaggagcctccatgctgttctccatagcggctatactagtttacattcgtgaatgtgagttttttatttatttatttattttgagacagagtcatattgtaattacatatataacgtaatgaggtgatggatatgctaattacccttatgtaatcattatacattatatgtgtggaaacattacatccgtggttcacccaggctggagtgtagtggcacaatctcagctcactgcagcctctgcctccgggctcaagtgatcctcccacttcatcctcccaagtagctggagttatagtcacatgccactacacccagctaatttttgttttgttttgttttgttttgttttttgagatgcagtctcgctctgttccctaggctggagtgcagtggcatgatctcagctcactgcaacctccacttcccgagttcaagcaattctcctgcctcaacctcccaaggagctgggattacaggtgtccgccaccatgcccagctaatttttgtactttttagtaaagacggggttttgctgtgttggccaggctggtctcgaactcctgacctcaagtgatccacccaccttggcctcccaaagtgctcggattacaggcgtgagccaccgcgcccagcccctgagtgtgtgtgtgtgtggttttgttttgttgttttttgtttgtttgtttgtttgtttttgagatggagtctcgctctgtcacccaggctggagtgcagtggcacaatctcagctcactgcaacctccacctcccaggttcaagtgatgcctgccttagactcctgagtagctgggattacaggcatgcgccaccacgcccggctaatttttgtattttcagtagagacagggtttcaccatattggccaggctggtctcgaactcctgacctcatgatccaccagccttggcctcccaaagtgctgggattacaggcgtgagccaccacgcctggccgagtgtgtgtgtttttaaagcgtgcatcattattactgaacagcagcaccaagagagtctcacagttcctgtgtgttcccacttggactattttgcaacactcctcttgacgttgaaaagaaaatgctatgacacttggttactgctgaggcgaggccaagccaccctctccagacctgggaaaccagtgagtattaaaaatagttcaatctttttcgctacttttttaaaaatctcatgagttcagctgaaatctttttccccaaaatgattcatggagtaaatcaatgcatctgatttttgctgaggaggggaaataggacacctgaaggccagttcatgtttcccctggttgtgagccatcctctcctccaagttgcctgatccctgcaaacagcagttctgtttgtcttcagctgcctgctttttctagtcgtgctgtgaacttgaacttgagaaagcttgatgctgactgggcctggtgaaaacgctacacgttcaagttgagggtctttttaaatggaaatcttttagactggctcatgtctgtaatctcagcactttgggaggccgaggcgggcagatctcttaaggtcaggagttcgagaccatcctggccaacatagcaaatccccgtctgtactaaaaacacaaaaattagccaggcgtggtggcgcatgcctgtaatcccagctacttgggaggctgaggcaggagaatcacttgaacccaggaggcggaggttgcagtgagccaagatcgcaccactgcattccagcctgggtgaccaaaaaaaaaaagaaaaaaaaaagttttccaaaaataaaggtttagacagatgattcttgtcaaaaaaggacaacaaagaagcacctttttttttctgttttagggggtgaggtggggaacttaagtatgtttcataaggaaagagtgaaccctcacggtgatattttttaagcttgaaaacataggaaaatgctaaatcagaaacttgaagccagggagccttgcctgtgtgtgcaagcgtggacttgagcaaagcgaagccttaggcacctgtgccaggcccgtgcaacttttccgtggacacgtcttcccatatttccaataacaaccagagaaccagttacccgccttttgctgccgtcctcttcctgcaggaggaagggtggggggacaggattcttccacccaagtgcccttgcaggtgtctaagcctgggcggtggattcttggttcctggcaggccttggtgggcaggcaacagccagaatgccaaaaaacacccagttagattgaatgtggttccctagttgcggctgtcggtagggaggaaacttaagtctccttacacatctcctctctgcgcgctgcggtctagtttgcgcagcctcttcttattcctaataacccaaaatctgagaatttagagtccttcttgttacttaggaaggactaatcttccccggcaggttgtcctgcatttgttgaatggggtaaaaattgcatagcatctcgagtgctgtgcctacaaattaccttgataaacgattgtgactcagcaaagcttaggcttttgccctagttttggaggctggggctaactaggaaaaaatggagggtctgttgggtgtttctgctgtttttacaaggcttcagaattccccactgtctgcgtgtgtgtgaatcagcaagtgcttcgcatcctgattgggtggtgtgatgggagcacccacctcgcagagcctcagagccctcattgtctcccttttccatttgctcattcctactttggctagtggcaccctgaaagagttttcatcagtaacagtgttgaggaaaccacgcattagaggcagcggggccacactaatcagcatctgggctgggtgattgctcagatctgagctcggagcttgctgtgctgctcaccagctgtgtgagcccgaggatgctgtcccggctcccagcctcggtttcctcagctgtgggactagacgggactaaaccagggggagaacggaaagcacccacgggtagtaagtgctcaccgaggcattttcccagattcctgccattgtttactgacactgggaagcacccacagcctcctcctggaaaacacacaccccctgctctcaagaactttccattttaaaacagacttgccctctggtgtgtcatccttgctttctgaaagtgagttttcttctctacgccactgtatgtttttttctgatagcagtagggaactgtgtattggagctcactctatgggaagcgttttgtactcttgacgtttaggcatgattatccccatttgaaggtaaacggaggctcaggcgggttcagtaacctgcactggaggtcagggtcagtggcagagctggaattcaagccccaggatgtctgactgcaacgcccatgtgcctaaccacgatttgataccgtcatccagatgaaggacatcacagggtagggagataaagatagaaggaggtggaggtgcccagcaactgagggtggctgggatcccttcataaacctggctcatctatgtagagcatggatccttctggagtcagtgcacctggatggggccagaatcccccctcttcccactctctctgtctgtagctctagaaatagagttatacacatacctgcaacttcccctttctgcatgccacaggcagacatcacactttgtccatctcttagattattcttaagagatagcttccaggaagggggattacagcaccaggaagcagaaacatttcaaaggctcttgatacatgtggccaaactgttttccaatttactcatcagccagaggactacagatcctgcagtgcagcatttaaaacacccacctcccaaaccagccaatcatttcttttttctttttttttttttgagatggattctcgctcttgtcacccaggctggagtgcaatggcgtaatcttggctcactgcaacctccgcctcccaggctcaagcgattctcctgcctcagcctccctagtagctgggattacagttgcatgccaccacacccagttaatttttgtatctttagtagagacaggatgttggccaggctaatctcaaacttgtgacctcaggtgatccacccacctcagcctcctgaagtactgggattacaggcgtgagccactgtgcccggcctttttttttttttttttttttttttttttttttttttaagagatgagatctcgctctgttacccaggctgcagtgcagtggcacaatcatagctcactgcagcctcgaactcccaggctccagcaatcctcccttctcaacctcccaaatatctgggaccacaggtgcatgccaccacgcccagctaattttttattttttatttttatttttattttttatttttgttttttttgagacagagtctccctctgtcccccaggctggagtgcagtggcacgatcttggctcattgcaagttccgcctcccagattcaagccattctcctgcctgagcctcccgagtggctaggattacaggtgcccaccaccccgcctgctaattttttgttatttttagtagagacggggtttcaccatcttggccaggctagtcttgaactcctgaccttgtgatccacccgcctcggcctcccaaagtgctgggattacaggtatgagccaccgcacccagcctaattttttaaattttcatagagacagggtcacgccatattgcccaggctggtcttaaactcctggccctgagtgatcctcccaccttggcctcccaaagtgttgagattacaggtgtgagccactgtgcatggtgaaatatgtttttatatattgggacaactgagaatattagaatgtggacaggctattagatgatactgaaatgtgttaattgtgcttaggagtgacatgtctaatgtctaacttatctttaacctcacagagtgagatgaaacaaatacagaaaataataattaccaaatctaggtagtgggtagataggtgggtttatggtacacctgggatgacaggtgtgagtcaccgcgcccggccttaaacatttcaattacaagggggatatgggggcccacagcgacaaggggtttcacctccaggaagaaacagacatggaacctgctggctgggctttgaaactccttgttctcagcatgtggccccagtggagcagcatcagcctcacctgagaccttgctagaaatgcgcattcttgagccccacttcagtcctactgagtcaggaactccagggccagggcccggctgtctgcaaacaagccctccaggtgattctagtgcctgtgcaagtttgggagctgctggtctgcagaaagctaggtcaactgaaagaggaaatgtaccacacttatttataaccaaatgtgtgccagctgggagcaagtccaagggaaacgtcacttccatctctcgttcacatgatgagttggcgcctcttaactcaatagtgtctttagtttggatgatttgaccacatggaaaatgtccctctgtccctcatgctaaggagcctagccctcacaaaccgttgttcttcataccgaggcctatgatggcctaggcacgttattattaatatccctgttgttccctcgggaggggatatgaaggcttagagcagtttattttttttaattttttttccaagacggagtcttgctctgttgcccaggctggagtgcagtggtgcgatcttggctcactgccatctctgcctcctgggttcaaacaattctgctgcttcagcctcccaagtagctgggattacaggtgcccaccaccacccctggctaaattttgtatttttagtagagacagggtttcacaatgttagccaggctggtctcaaactcctgaccttgtgatctgcccacctcagcctccaaaagtgctgggattacaggcgtgagccgccacacccagccctcagagaagtttagaaacaacccaatgtcccacagctattaagtggcagaactgaaactcaaacccagtccatctgccagagacggagctttaacggccacacaagctgagagagagaaagagagttgagacacttatataaggtgggagccctgcaaatgattgggtgtggtggtgttctggaatcttctgaagctctgtattgagtgctgtgaggcatggctttcccctgccccttctaaacttggaccctgacacatcaaagccagtcttgggcacatgtggctcttgcctggttgacagtccccatcaagctggtgaggtggtcttgtcttttttccccaacctgttgtaatttgactcttaggaattgtgccgtgagcactgagacttgtagacatcccattgtaggggtcttggttgtgtatcactgtgcccatggctcttagggtgacacacacccaactcccaaatcctgtcccgaatgacaggtgggatccagaggcacttgaaagcccagggagtctgagggacagggatgctgacagtgggcactggtggtttgtctgttttactgtttcaggggaatgagcccaccatgtggaattcagatgggccttctggctaccccaggggcctccggctcagcttcctgggcatgtcagagagccgtgccaggggccagagctgaggaatgaggctcggcttactgcccacccaggaggagtccctctggagagcctcagaaagtacctgcaatggcaatacaacagaagagcctctaaatatttccttttggggatacggcaggaaagccaaaggaaatgcgaagaggtgtctgaacgcccagaggaaatcagtgggcccttccagaagttctatttgtggtaagaaaccttggcacggggcccccagctctcctgcaaaaatagaccaatgtgctgagaagcagctcaattctgggagcaattcccctccatggggaagagagcttgcactgggacttagaaggatctgccccctctcttctgcttgcccctggactccagaaccaaaaacagggagaaaaaaaggtaaacattttttaaaaaagaaactcttggccaggtggagtggctcacacctgtagtcccaacactttgggaggctgaggcaggaggatcacttgaggccaggagtttgggagcagcctggacaacatggcgagaacctgtctgtatcaaaaaaatacaaaaattatctgggtgtggtggcacatgcctgtagtctcagctacttgggaggctgaggcaggaggattgcttgagcctgggaggtcgaggctgcagtgagctatgattgtgccagtgtactccagcctgagtgacagagtgagaaccccatctcttaagaaaacaaaaaaccagaacttatgaatgtatccatgacttaactcaaaaatgggccagtggaaacacagggcaaaggaaggtttcaaataagcacctggacacaaacagacccaggaggtgacacacggcattgaggacccactccccatcactaggtcctttggccccaaatgagtgagatgactaagaaaatagggtaccatgtgcagcagaagggagggtggctagacagaaaatgatggccttgactgtgatggtcatcacagacaggacccctaagaaaggtggccaagggggtctggggacccacttttagaataccaggctgacagcataacaggggtttgggacaccaccatgaaagaagacaatgaagccaggtgcagtggctcacgcctataatcccagcactttgggaagccaagacggaaagattgcttgagcccaggagtttgagaccagcctgagtgacatagcaagacccccatctctactaaaaatttaaaaattagccaagcatggctgggcacggtggctcacacctgtaatcccgacactttgggaagccgaggcgtgtggattacgaggtcaggaatttgagaccagcctgaccaacacggtgaaaccccgtctctactaaaaatacaaaaattagccaggtgtggtggcaggcacctgtaaccccagctactcagtaggctgaggcaggaaaatcacttgaacccaggaggttcagtaagccaagatcatgccattgcactccagcctgggtgacagagtgagactccgtctcaaaaaaaaaaaaaaaaaaaaagccaagcacagtggcatgtgcctgtagtaccagctacttgggaggctgagtgaggagggaggattgcttgagggcaggagttggagaccagcctgggcaacatagcgagaccttggcttggaagtaaggaaggaaagaagggagggaaggaaggatgaaggtagaaagaaatgggacaagatggactcctgaggccatcctaattctggaacacaatacaatggcctctgtatgttaggagggctcatttggcttctctctaagccagcggtccacatctttttggcaccaaggaccagttttgtagaagacaattttccatggatgggatggtgggggtgggtgtgggaggggatggtttcaggatgaaactgttccacctcagatcatcaggtgttagattctcataagaggtgcccaacctacatccgtcgcacctgcagtccacaatagggtttgtgctcctatgggaatgtaatgccacactgatctgacaggaggcggggctcaggtagtaatgctcactcacctgccgctcacctcctgctgtggggccggttcccaacaggccatggaatgcttactggtccacagccctggacttgggcacccctcttctaaggcacaaacttctactgtcttaggagcagcaccctggcctccacagcagggagagagcaggaatacccagccacagatattgatgaagatattgatcaacttcctaccgtcatggtggagccatgcctggaggcctctggatggtcatcaggtaaccccagcacattttcctgtcccagactcctggccacgctgaggttgctgtgaacagacacgatgtgcagggtcatggatgtgaagctagaactccttgacaagcaggagctttattttatggcccaagcagtttggaaacaaaatcataaagtgcttacccatccagtgtctccccagcctgcactgggaggtatcaaactgaccagatccgacagccccttccgcccgcagaagatgggtctgcgtttctctgtctttccctcttggtggccaagaactgtcaacatccagctgtggctctgcactcagccgccactcagcctgctcaggttgaaaggtcaaatgttgtctggaattggcagcccagcttactagcagctcttctgtcttcagagtgcagcgaggggagctgtcagagggctgaggcaaggaccagagaggcaactcctgcgacagagaaagctcatccctgggtatgttctggagggagaatagcagggtctgtcccaggaactttattagctagcggttaagatcctcatccccagaaaagccaataggaattagctgggtgatgtgtgcctatggtcccagccactcaggagggtgaggagggagaattgcttgagcccaggaggttgaggctgcagctagctatgattgtgtcactgcgctccagcctgggtgacaaagcaagatcctgactcaaaacaaaaaaaaaaggaagaaagaagaaagagagaacgaagaaagaaaggaaagaaagagaaacagagaaggaaggaaggaaggagaaaggaaagaaggaaggaagaaaaggaagaaagaatgacaaaaggaaggaaggaaagaaagatgaaaagaaaaggaaaggaaaagaaaagaaaaaagaaaggaaaaaagaaaagcagataggaaagtgaggggagagggccaggaagacagaagacaggatgggcaagaaggatgggaaggattcccacaccagattcaggagtggctctgcattgggaaatccttctacaactgctggggacttggttttgcaaacatgcacagagaaaccttcatccacctctgtgcaatgttggactgaagtagaaatgagctgctgttttctggaagcaccccatttctttgagctgatcttctctaataatgaattctggtgaagcctgccattcacagcaccccgccctcccgtctgtaggaggtgggcacaggacccaggccagctgatcagagagctcccttgccctgggatgagcacgtgacccagatggctcaatcacggggaagatcctcttgcctgttgtagccactatgctggaagaacaggatttgggcttgttggccgccatcttccagtccacactgggaacccatttgcaggaggagggaaggaggacaacccagtttgagggagcatatggacagcagctgtggaaggctccatatgtgcccaatactagatctaccccatcccttcctgttccataaatccatacatcttctcccacttttgcttaccctagtttgagttacatttctgacacctgccaccataaaagcccaaatgattacaaggaatatttggctgcagaaaagaccctgcagtctgtgaaaaaagaggctgctggtgcatagtcatcacagaccagtgcaaagagtgaaacagaaacatccagcttaatctgcaaaagcctttttggatctttgagaggcgttcattaacttacagcaaattgatgagctgatattcttctttcatccaggtgagtgcattaactaggttaattttcctgtctcaagggactgctgtaggttagggtgaatgaatgaaagaagcaagtttttaaacaggaaaaaagcttcagagaagttgaggtgacaagcatcgcttcacccccaatggaaggtgagcttgtctgttaggtcccagggactgaactggagttccgtggttaggggatgacccatctcaacaagaaacttccatcatcctcccgtggggatctgattaagatcttctccagaaggagatggcctcatgagttggggcttttcaatctccctgtccctcctctagaagggcattgctactggccttgccctgccaagtcttcagtctacaacagcactgacccgcttcagacacagcccagatccttcccagacacgctgttattccgactttttgccctttcagtccagccttccctatcacttatgctgaaattgggaacatttcccaaaccaacagtttcccagtccacaatgttcccttgctgagtgtccccacaggacaggcaggcagcctgataaataaaaccagtcataaaacctccctgccttagcaaagggactgctttgccaggctgctgtcacatagcactcctgtctcccgtttgacttcacatagtgaaaattgtctaaaagataaggcaggagctctggttgacaccaccacccccatagatctctctctagaagcattggaagaggccgtctcaaaaaagaaaaaaaaatagaagcattgcaggaaagacgtggtttgtagtgaaacaaattggaagtcaagctcagcctcaaccacttacttgcttctgaccttgggtaagtcctatgtacctaggaacctcggttttcttttctttcttttcctttttttttttttttttttgagatggagtcttgctctgtcacccagtctggagtgcaatggtgcaatctcagctcattgcaacctctgcctcctggattcaagcgattctcgtgcctcagcctctagagtagctgggactacaggcgtgtaccaccatgcccagctaatttttgtatttttagtagaaacagggttttgccatgttggtcaggctggtctcgaactcctgatctcaaatgatccacccgcctcagcctctcaaagtgctaggattacaggcacaagccaccgcgcctggctggaacttcgactttcttctgtacaatggaggggggacagtaatactgcaatatttacaattaggttcaactgagagtaacagaggtctgaatacagtagctgaaatggggtgggcagatcacttgaggccacaagttcaagaccagcctgggtaacatagtggcatactatctacaaaaaaataaaaattatccgggcgtggtggcacaggcctgtaattccagctacttgggaggctgtggtggaaggaacacttgagcccagaaggttgaggctgcagtgagctgtgattgcaccactacactccagcctcggtgacagagtgagaccccgtctctaaaaaaataataataaaaaaaaaatttggccatgcctatctgcaagaacatctgggaaaggtagctgcggtaggtagcctcaaaaatgcctccaatatcactgggtgcagtggctcacactttgggaggccaaggcaggaggattacttgagcctaggagttccagacaagcctgggcaacatagtgagaccctgtcactacaaaaaatttcaaaattagctgagcatggtggtgcatacctgtagtcccagatacttgggaggctgaggtgggaggatcacttgagtccaggagttcaaggctacagtaagctatgatcacgccactgcatgctagcctgggtgacagagtgagattctgtctcaagggaaaaaaaagccccttctccactccccaaaagtccccattaatccctttattccagcattttcccccttgtgaggaagaggggaaatttgtatttgtatttgtattcccacttgctttgagtgtggctggacccagtaactttcttctaaccaatagactatggctagaagaatagaatttagtcacataaccatgtctagctgcaataacatctgcattagtctattttcatgcggctgataaagacatacccgagactgggaataaaaagggattttattggacttacagttccatatggctggagaggcctcagaatcacggcgggaggcaaaaggcgcttctttcatggtggccccaagagaaaaatgaggaagaagcaaaagcggaaacccctgataaacccatcagatctcatgagacttattcactatcacaagaataacacgggaaagaccggcccccatgattcagttacctccccccaggtccctcccacaacatgggggaattctgagagatatcattcaagttgagatttgggtggggacacagccaaaccatatcaacatctgtggtaaaagtgatgggatgttccttctgagattaggtttcaaagagatgacagttctgtcttgggcatcctgtcttgctctgaggaaaaccagccaccaggtagtgaggtgctccctggaaaggcccacatggcaagaaactgatgcctctgccaggcaaagtgactcacgcctgtaatcccagcactttgggaggctgaggtgggtggatcacttgaggttaggagtttgagaccagcctggccaacatgatgaaaccccgtctctactaaaaatacaaaaattagccagtgtcgtggtgtgacagagaaggaatctgtctcaaaaaaaaaaaaaaaagaaaaaaaaagagaaactgatgcctctggtcaacagctagcaaggacctgaggcccttagtgcaacagtcttatcatgagtgagcttgggaagaagatccttccccagattaaccttcagatgatggcagcccttgcagaaatctcagtgcgatctcacaagagacctgagccagaggactcactgaaaacatgagatgccaaacttttttgttttgatttcaggagctaagtgttgtgcttatttgttacacagcaatagctaactaatacaatagttttccagctagacacatttctaggattctgttactaagaaggaagggaaggctggagacagggaagcaatgaatagtcactgtcaccaaaactgaggggttaatttgatcaggtctggctgccccgcttgctttggtcacttgcttgttttattaatttttcttttttctccttttttctttatcttctttctcttgctttctctctttctccttccttcctcccttccttctccttccttctttccttccttccttccttcccccttccctccctcccttcccttcctccttccttccttgcctgctgtgtcaattttttttattataatagagacaaggtctcactatgttacccaggctggtcttaaactgggcttaagcgatcctcccaccttggcctcccaaaaaactgggattacaggcatgagccaccatgcctgtcctttttcttcttttcctatgaagctgaagacagtcatagctgaaggctgtggtagctgaataccgtggcgttaaatgctgaaatgtacccttcactagcttctttagagatcacattcacaggtcactatggtaatgtttgcttccgttgtttttcaggaacttaggccagctcccatccagttcaatcaggttgggaccaccaattcttcaatgggcctgcccaaatgcccaagaagtggacttttgatgtcagagggccaaagatcccaccctcagatcatgctaatgccaccactttctgtacacatgtcctgtgaaatgccacaaaccctgactactacgcttgtgcagaacaaacctatcaattaatttttccctactgccaatcacctttccccatgccttacaccaccgtgtttccctaacgcataaatatccctaagccttatcttcaggaagcaggatgtgagagctgttctaccaccttgtttggtggccttgcaaataaatcctttctcttttgcaaaacccatgtcatagtcacagtgactgatttactgcacgcgggcaggacagacctgcacccggccaataacaccactcatacctactccaaagggccgttgtgaggatggaatgaggtaaatctgtaatgtacccatatccagtttgccagcacccaggaagtgactaacgagacatggttttttaattattattttattattattattattattgtatttttagtagagacggggtttccccatgttggtcaggctggtctcgaactcccaaccccaggtgatttgcctgcctcggcctcccaaagtgctgggattacaggtgtgagccaccactcctggccggagatgtggtttttagtgaagggccactatctagtgtctgcttcccaagcttttcgccaagctcctctaggagacaaggtgggctgtgtctaacattcaattttcctgacttctcccctttgacagttcagattccccatgccctccagccaattagtacaattactacttctttttcttctttttttctttttcttttttttttcttttgagacggagtcttgctctgttgcccaggcaagaatgcagtggcacgatctcggctcactacaaccgggttcaagtgattcttctgcctcagcctcccgagtagctggggttacaggtgcctgccaccatgcctggctaattttcgtgtttgtaggagagacggggtttcaccatgttggccaggctgatcttgaactcctgacctcacgtgatccgcccacctcagcctcccaaagtgctgggattacaggcgtgagccaccgcaccgggtgttacaatcactatttcttcaaaaataaagatccccaagcccagcaggagggttcacagaatggtaagatttcagagggaaaagggctagagcccttctaattcagttcccccactcaccattgtgaacccagacacttgcacaaagtcacaaagcaacaagcaggggtgggacttggcccctctggagagataacgtagctctgtgttcctccctctctccaaactgctaatgctcaggcagaggctggtgtatgcagcattttacaaagtttcctatacaagcactttgggaggctgaggcgggtggatcgcttgaggttaggagttcaagaccagcctggccaacatggcgaaaccctgtctactgaaaatacaaaaaaattagccgggcatggtggcacacacctgtaatcccagctactcccagctgaggtgggagaatggcttgaacctgggaggcagaggctgcagtgagctgagattgggccactgcactccagcctggactgcagagtgagaccccgtctcaaaaaaaaaaaaaaaaaaatgccataaagtttcctatagaaaaaaataaatgtgcactagttcaacccagttttttctccctgagaggagttgaggtcaggtttatgggacatgcggtgctttttgagtgaatgagcgtcataaagggaaaccttctggtttccctttaggctttagggggcccctgctcttgtgtctttggcttggcagggagctgaagtccttgcagtcacgagcctgtccctcgtggatataactgggagaaaagtctagaaagtgctccctggggtcccaggataatgtgtccacctaccgaaggcaagaatgcaatctatattattgcccttccccaagggtgcaggatttatgtcaccctggaagaatgcgaactcctgaatcagttcacatacaaagaaaccccagtttttcagaatagattgagaccaaagcctttcagtgaaaatgaatgttttgggcagaaaaaaaaattaatgaaagtcctaagatttttttaaagtattaatctaataatgggagatataatgtgccagtctccctgctgcttatttccgctagtgaactgggctatatgggaacttaataaaatattcacagaaggcggctgggcacagtggctcacttctgtcatcccaacactttgagaggccaaggtgggtggattgcctgaggttgggagttcgagaccagcctggccagcatggtgaaacccccatctctactaaaactacaaaaattagccgggcatggtggcaggcacctgtaatcccagctactcaggaagctgaggcatgagaatcacttgaacctgggaggcggaggttgcagtgagctgagatcatgccattgcacttcagcctgggcaacagagagagactctgtctcaaaaaaaaaaaaaaagaaaaaagaaaagaaaaagaaaacaaaacaaaacaaaaacattcacagaaggctcaactgcaatatttaaaatctttaccagtggccgggtacagtggctcacacctgtaatcccagcactttgggaggccaaggcgggtggatcacctgaggtcagaagttcgagaccagcctggccaacgtggagaaaccccgtctctaccaaacattagccgggtgtggtgctgcatgcctgtaatctcagctactcaggaggctgagaggggaggatgacttgaacccgggagatggaggttacagtaaactgagatggtgccactgcactccagcctgggcaacagagcaagacgctgtctcaaaaaaaaaaaatatttaccagtcatgtgtatttcataaacagcagcaatttcattaaaatcagtgcatatggggaaaagggatgcgtaggtactgtcctatcttcttgattaatgctgttaacatatttttgcacatttaaaaaattgacattgataaatttttagcatgaagttgcagaagttgacctgggtcctaactgtaaaatgcagaggaactctacccatgaggaagctttgtgaagttgattcattactaatgtccctgtgagtacctaacttaaaaagtccagtgtagccaggcatggtggcgcacacctgtaatcccagttgctcgggaggctgaggcaggaggatcacttgaggccagtagttcgaggctgtagagcatggtgattgtgcttgtgaatggccactgtactccaacctgggcaacatagggagatcctgtctctatctaaaaaaaaaagttcagcaagaactggagggctgtggaggactgagcattgagtttagaaaattgtcactacagggcgggcatggtcgctcatgcctgtaatcccagcactttgggaggctgaggtggggtgatcgtttgagcctaggagtttgagaccagcctggacaacatggcaagacctcatctctactaaaaattttaaaaattagccaggcacgtgggcatgtgcctgtagttccagctacttgggaggcccaggtgggaagattagttgagcccaggggttcgaggttgcagtgatctgagatcactccactgaattccagcctggaccacagaatgagaccctgcatccaaataaaaaaataaaaagtaaaagaaagttgtcacagcaaaatgaggcacacggagtttgaacacctctctttttgggagaacacactgagtagacaacaccgtgtgtgtgcgtgtgtatgtgagttcatctgtgagtgtgtggggggtgctttggatgtggaagagtgtgaaggaggccatgaatctttttattctgataaagagcaggaccaggcacagtggctaacacctgtaatcccagcactttgggaggccaaggcaggtggatcatttgaggtcaggagtttgagaccagcctggccaatgtggcaaaaccctgtctctattaaaattacaaacaaaaaaaaattagccaggtgtggtggcgcacacctgtaatcccagctattcgggaggttgaggcaggagaattgcttgaacccaggaggcagaggttgcggtgagccgagatcgtgccactgcactccagtctgggcgacagagcatgactccgtctcaaaaaaaaaaaaaaaaaaaaaaaaaaaaaaaaaaaaaaaacccgggagtatttttgaagcagccaggagctggatatgtgtccagcttgcatctttgtgataagcatttaataaccattgagcttagcaatagagttacggaactggtacttagatgtttttctttttctttttttttttgagattgtgtcctgctctgtcacccaggatagagtgccatggcgcgatcatggcttactgcagcttcaaccttctggactcaagctatcctcctgcctcagcctcccaagtagctgggaacacaggtgcacaccatcacacctagctaatttttaaatttttgtagagatgggggtcttgctatgttgcccaggctggtctcaaacttctggcctcaagcgcttctcccatctcggcctcccaaagggtggggattacaggtgtgagccaccgcacctggactgtgattgcttttcttaacatggtactctgccattatattctctattaggaatttgatatgctcagaagatatagtgagttgcctgtttactaacatcagggtcctttcaggtagtgtccaccacaggaaacattactatttgggtattgtgacccatggcaacgacccagcactcacctttccagacctcatctggtggccttgtaaccctggagctgaagctgcatgcgcacaagcaatcagtcgcagtgtatccacacagggtcccaacccactccaggattcatttcgggatggcttcccctccctcagccgggtctccagccccattgctctccaggcatgcccatctccatctccacggcgatcatgtgtttgcagggagacatcaatatcctcttctcttgcgctttctgaatgggagagtcaatgtcaaccggaagctagcagggacttgggtggacaggtgtctcacgctggatgggggaatccaggtgggaggggagggtgggcttgctctcatttgtgggtgggtaatgggatttgctatgaagctggagggaaaatctggacccctaaagaggggtcccttcccttcctaagggaaggcctcagcttcgagactgcaggaggagctgggtagccattggatatggctaaagcacatgaatcatgaccgtggtgcactgtttggacagcaagtcagtggcccaaggagagagaggttagtgatgggaagcgtcctgggactcaccgatgcatctttatatttttctctttaaacattaggaggaggccaggtgccgtggctcacacctgtagtgccagcgctttggaaggctaagatgggcagactgcttgaactcaggagtttgagaccagcctgggcaatatgtcgagacctcatctctacaagacattttaaaattagccaggcattgtggtaggtgtctgtggttccagctactcaggaggctgaagcaggaggactgcttgagcctgaaaagttgaggctatagggagctgtgatcttaccactgcactccagcctgggcaacagagtgagaccctgtctcaatcaatcaatcaagcaagcaatattaggagaagaatttgttgatgtctcttttctgtcataagctcggctctccaagagccttttcttcccaggaggacatgctggtgtttcatgaatctaggacttcttgcctgaagcttgtaaagtgctagatggaatgaaaacggcaatagtaagagcaggctcttatgccaccttgctacacacaaggcattgctctaagtgctttgcaggggttaagagatgcagttgagtagctgaggacagtctaggggtggggtttccagaggctgtcaggggagtggcccccagccttcctggtggaatccctgagcattaatcacacacataagtttcactccacaaacatgggttgtgaaaacattacaatctagccaggcgcagtggctcatgcctataataccagtattttggaaggccaaggcaggagggttgcttgaggagcccctgaccagcctgggcaacacagcaagaccccatctctaccaaaaaaaaaaaatggccgggtgtgttggtgtgcacatatagttccagctacttgggaggctgaggcaggaagattgattgagcctagaagttcaaggctgtggtgagctatgattacactactgcactccagcctgagcaacagaacaagactctgtttttttttttaaagccataatacattatttttttctaaattaaatggaatgtgttgtgaaccacaatcatttattttatttacttatttgtttatttttgagacggagtcttgttctggcgtccaggctggagtgcagtggcgtgatctcggctcactgcaacctctgcctcctgggttcaagcaattctcctgtctcagcctcctgagtagctgggattacagctgtgcaccaccacacctaatttttgtatttttagtagagatggagtttcatcacgttgtccaggctggtcttgaactcctggcctcaagcgatccacctgcctcagcctcccaaagtgctaggattacaggcatgagccaccatgcttggacctagccacaattatttaataccagggctccctgccgtcgctccccagagctgggagaaggtctcaggagcatattgggtcaggtatgtgtggaaaggccctccaggctcaaattcacactgggcctactctgtgccctgactccaagctccaggagccctcaaaggtggcagctccattgctcatgagccaagcttagggaccggggcccttcctagcagccagaaagagccttattcttagcattttttttttttatagagacagagtctggctgtgttgctcaggccagagtgcagtggttcaatctcatagctcactgcaacctcaaactcgtgggcacaagcaatcctcccacctcagcctcctgagtagctgggactacaagcgtgcaccatcacacctggctaatttttaaatttttaaatttttaattttctgtaaagacagggtcttgctatgttgcccaggctggtctcaaactcctggcctcaagcgattcttctgcctcagcctcccaaagtgctgggattacaggcatgagccaccttgcctggctctgttcttagtaccaagggccctcacaccccctgtcttttcttgggactctgccaagccccaggctccttctcaggcttggggacggtacccaaatcagcacatccacttccatctccccacctcaccccaaacccttctctccggcatctagagccacgccgaagtttctcttcttgagtctagccctcctgggtatgcttggggactgaaatgctcaaattggcctcacctcttgacactgtaattgttccttatcgcctattaaacaggaaccctgctttgtgtagttcagtgcctgctgccaagtcagagctgtgacctcaatgaaagtggcccagccacaccaaacctcagtttccgtaacagtcctgggatccaatgtggctttcacattacatatcacttcactctgttatctccgatggaaaaccaactcaaactggcttaagcaaaaagggtactcactgggccatgtaaccaaaaagtgtaagcataggtgtggcttcaggaacggctggatcaaggcacccacatgtggcatcgggagtccctctcctggctgttggtttcagttttctctgcaggggttacattcgagcattggttccctcctcatagtggcaaggtggctgcgcaggacaagaggcatatagccaagggctcagctacttaaggataagttccatcagaagcccaagttgaggctggccttggtggctcacacttgtaatcctagcagtttgggtggctgaggtgggtggatcacttgaggtcaggagttcgagaccagcctggccaacacagtgaaaccctgtctctacttaaaaaaaaaaaaacaaaaaaccatgaaaattagctgggcgtggtggcacatgcctgtaatcccagctacttgcaaggctgaggcagaagaatcacttgaacctggcaggcagaagttgcagtgagccgagatcaaaccactgcactcctgcctgggcaacagaacgagactccgttggcaatgactgggtcatctgtccagtcctgaactggtcactgtgtgaggtagaagcattgtttgattggccaggcctgggacacacggccatctccagacctaggaatggcatcatctctacccaaaccccgtgaaccaggaggtggggaggagcaaagcttcagaagaaactccgggccctgccatcaagcagaggaggaaaggaagccacacagactgagacatcaagtacccactgtgccctcaccaccagctcctgccctggtcagtgcactcctggaccatttctcctccccgtcttgttcacagtcaccctctcaccccagcagagatcaggccaggggactggtggcaagtgagtgaagggtttcagcctaccttccaggcacagtgtaagcggaccccccacacacaggggctctcctgggttacacagtgtcctcccaaaattcacatccacctggaacctgcaaatatgaccttatttggaaatggagtctttgcagatgttgtcaagataagatgaagtcatactgttttaggatcggccccatatgtggtacgactggggttcttatacgaagagggaccctggcacacggatgcatacagggagagcgctgtgtgatgagaaaggcagagattgcagtgatgctgccaccagccaaggagccaccatcaaccaggagacgggcatggatccgattctccctgcgaacctccagaaggagccaaccctgccaacaccttggttttggacttctgttccccacaactgtgagacaatacattctgtggttttaagctttatgataatttgttactgtagccctgggaaaggaatacaagggtagacagacactgatcaagtaagcaaacaaatgtgaaattgccctgtgacaagggaggtgcagggtgcctgtgttggggaagaattctctgagacttgaagtcagagaaagagttagctaatggggctgacaggggtctgcacatgcagctcacggcccagatctcgttggccgagtgtttttgcagggattaggaactaagaatggttttgcaagaagaacatcccaggccgaagggacggcatgagcaaaggccatgaagtgggaggcgccctctgtgaaaccaacaagctttcagccacgtgggtctctctgatgcgttgtctccgccacagagggctttaaaaagccccgaaactggacaggtgtcactgcctgtggcagtagcggccatttggcgcctgtggtttcaactccacccgtttcacatgtctatgttaccagactggcccctgaaggggatctgcgtgccaggccctgacctgccgggctttggaaacatccttgccagtgtcccctgacctgcgccccgccctgtggagtgaggcctggttgcccaagctggctgggccgggctgtttgctgcttccaacaaacataggagagaatgtattgctgcttttgattgccagtgagagctccgcgaggcctggcccgagatgtggctggcgtgaggggtcccggacctgctgtggtggggacgcacccagttctgtggcgcttggtccagcgaggactcgagcccactggggacggggcctcgggctgcaggggcggggccccagccgcctgggggtggggcctcaggttgtttgggggcggggcctcaagctgtctggggacggggcctcgggccggctgggggcggggcctcatgcttcaggggcggggcctcggactgcctgggtgtggggtctccagcttcagggtcggggagcctcgagccgcctggggaccgggggatctgttggggaggaggttctcgaactgctgaggaggatcacagtgcttttgcttcctctaggagaccagctgcacaggctgcaacatgccatctctgtgcctgttttcccgtcgataaatgcagagacattactctcatcatttcttcctctgtaacacaatattcatctatgtaaccccttggtaaagcagttgtaagaattaaacaagaggaattgcgctttcattcagcaaatattttttgagcagctactagatgccaggcactgttttagacgcaagtgatacttcaggaaacataatcagacagacaggcagacatgccctcctggaactggcattgtagaacaagggtctgcatcctgtggctcacaggccagatctggttgaccgtctatttttgcatggacgttaaactaacaatgatttttgcattttgatttttattttatgaaaaaacaattgggggttgggcgcggtggctcacgcctgtaatcccagcactttgggaggccaagggggggtggatcacctgacgtcaggagttcaagaccgccctggccaacatggggaaaccctgtctctactaaaaatacaaaaattagctgtcatggttgtgggcacctgtaatcccagctacttgggaggctgaggcaggagaatcgcttgaacccgggaggtggaggttgcagtaagccgagatcgcgccactgcactccagcctgggcaacaagagtgaaactctgtctcaaaaataataaaattaaaataaaataaaaaagagtggtctctggaccaatagctcagtatcacctggacatttgttagaaatccagacctactgaaccagaatctgtattttagcaagacccccaggtgatctgtgtgtacattaaagtgtgagatgtttttgtagcaacatgcatggaactggaggtcattatcttaagtgaaataagccagatacagaaagacaaatattgcatgttctcactcccaagtgggtgctaaaaaatgcatacacatggctccacagagagtggaataataaacaatggagattcaggagagtgaatgtaaattctggcagttcatccaccactgtgaaccatgagaaatagtttaatggctgccaggtgaggtggctcacacctgtaatcttagcactttgggaggccaaagcaggaggatcacttgagcccaggagttcaagaccagcctgggcaacatggcaagaccccatctctacaaaaaatgcaaaatattagctgggcatggtggcacgcacctgtagtccctgctactcaggaagctgagatgggaggatcgtttgagcctgggagatagagactgcagtgagccatgattgcaccactgtacttcatcctaggtgacaaaatgagaacctgtttaaaaaaacaaaaataggctgggcacggtggcccacgcctgtaatcccagcacttcgggaggctgaggcaggtggatcacctgaggtcaggagttcgagaccagcctggccaacatggcaaaaccccgtctctactaaaagtacaaaaattagccgggcgtggtggcgggcacctgtaatcccaactacgcaggaggctgaggcaggagaatagcttgaacccgggaggtggaggttgcagtcagccgagattgagcctgcactccagcctggtgacagagcgagactctgtctcaaaaaaacacagcagcaagcaacaacaactaaaagaaatcactgaatgggtacaatgtatgttatcgggatgatggagatcctaaaagccctgacctgactattacacaatctatgcatgtaatgaaattgtatttgtaccccataaatttatgtaaataaaacattttaaaaagtgtgagatgtgcaggtcgaaaatgatgcagaatgctcagcacagggcctgacacttagcaagagctccatgaatgttagctaatgcggtggatggactcatggtcccccaaagaggtccacatcctaatccccagaacctgtgaaagtggtaatttacattgtaaaaggggctttgcaggtgtgatcaaattaagtctcctgagacgaaggaattcacctggattatccccgaggggcccaatgatgcaatcacaagggtctttttttttttttttgagatagcgtctcactctgttgcccagactggagtgcaggctcgatctcggctcactgcaacctctgccttctgggttcaagcgattctcctgcctcagcctcctgagtagctggaattacaggtgtgcaccaccatgcccagctactttttgtatttttagtggagatgggggtttccccatgttgcccaggctggtctcgaactcctgacctcaggtggccttggcctctcaaagtgctgggattacaggcatgagtcaccacacctggccacaatggtccctataagagatggtgggcagggcaagaagaaatgtgagatgtgaggctggaagcagagggtggaatgcatgctttgaaggtggaggcacctgctctgcggcaggcctgtagaatcgggaaaagacaaggactcagattctccctcagaacgccctggaggaaacaagctctgctgacaccttgattttagacgtcggacctccagaacggtaagagaataaatgtatcttattttaagtcactaagtttgtggaagcttgttggagcagcaatacagaatgaatatagctgccattcttattgttatcctgtttgtcgtaggctggctctgccatcttcccattcagttgtttcaggcaagttattgagtctctctgaacttgagttttctgctctgtaaaatggagacaagaagttttcctacttctggtcaaatgagataatgcatgtaaagtgactccagctgtcatgattgttgttgctcttgtttaagtagaggcagtggccatggctggctctgtgtgacctggggcaagttatgagacttctctgaactttagtttccccgcctacaaagtgggggtcatgacagcatctacctcctgaggctgtcgtgaagctggaaggagaccctaagcataatttctgggcccatgcctcgcttgaggaggacgtaggtataattctggccgaattggagaacgtgatctctaaactgggtgggcccctctaagctgtcctgactccggtcctctgtgctggatcacagcctcagcctggctggcaggggagtagatcattcctattccctttgcctccccagctcttcccaagtggacaccacaaccccattgctttttttagagacggagtctccctctctcacccaggctggagtgcagtggtgtgatctcggttcactgcaacctccgcctcccgggtccaggtgattctcctgcctctgagtagctgggattacaggtgcatgccaccactgccggctaatttttgtacttttagtagagatggggtttcaccatgttggctaggctggtctcaaactcctgacctcaagtgatatgcccacctcaacctctaagtgctgggattacaggcgtgaaccactgcgcctggcccccattaccttttgttgtgactgcagcagactcactggggggcttctgtccccagagggcggggagctcaagttagttcattgaggaggggcaggggccatagggctggggcggggcctggacatcccaacacgagggtccttcctgtgctgaggttccagactgaggcgggagtcagtctgaggcctggccgtgcggcttggcgtctatccaggctggaatttgcaggatttgtgctgtggtgctggaatcggctccctcggagtgtgtgtctcactggattggatctgtctgtgtcttgggggtgttctttaaagggaagaacctgacagacttcacactgcagtgccccgtgcagggcctggcacacagaaaatatctattggaccagtgaatggatcatccaagggactgaacgtccccagtgcaaacaggaagggagtttgtgtcagtggggagtctcccaggccccagtaagactggttgaccaggtcctccctaagttctgggtgttgctgaagtggccttgctgctctgaaaacagctgtgtgcatctcagcctcgcctctcccggaggagggcctctcacttcctacgaaaccaggactgcagcctcagagaggtttgagggtgtgcccagggctacacacttagagtgagtttggggcgtgaggcaaggatttgtggggtggctgcccagctaagcacctggacactgttctgtaggaaaggagagccgttaaagaatttgtatctacctcttttttttcttggttttgttactttcccccaacattttattatgaaaattttgaaacagcaacatcaactcactaacattt

SEQ ID NO: 418 - DNA, 111650 bp, Homo sapiens
ttttgtttgggatggtgtgagatcagggaccacagatcacactcttctggctttttttacttattgctgttgaagattagaccttaagggaaatgaattttttttttttccgagacagtcttgctctattgcccaggctggagtgccgtggcgtgatttcggctcactgcaacctctgcctcctgggttcaaacaattctcctgcctcagcctcccgagtagctgggattacaggcgcctgccaccatgcctggctaatttatgtatttttagtagagacagggtttcaccacattggtcaggctgatcttgaactcctgacctcgtgatccgcccacctcgacctctcagtgctgggtttacagacgtgagccaccacacccggcctaagagaaatgaattctgaccctagctttgttgtgtgaataatgtcattggtacaatacaatataacttctcagatttcagagccacctaatcaagctgcaatatgtaccctttcacttcagaagtgagttaattatcagggaggaaatgtctgtaacaggtctgagatcctaacacaggcacaatgaagaatcgaatgccattttttcacattttgttaccacctgtgtcccacttagtaaccttcttctctgctatgaagcttggtaaggtttaggaccctgacctttctgccatcatttctacctactaatgtggaatgctgaatgtgaatacaggccgagtcatgccgtgacacgtagctccagggagggacgatagcagcttggcaggattgtcttttccttctggagcatgcctgatacactgggtaattttgaaaattagactacattagcctggaaattgggccgggcagagtggctcacgcctgtaatcccagcacttcgggaggctggggcgggcagatcacctgaggtcaggagtttgagaccagcctgaccaacatggagaaaccctgtctctactaaaaatacaaaaattagtgtggcacggtgacacgtgcctgtaatcccagctactcgggaggctgaggcaggagaatcgcttaaacccaggaggcagaggttgcagtaagccgagattgtgccactgcactccagcctggacaacaagagcaaaactccgtcttaaaaaaaaaaaaaaactacgttagcctggaaagctcttttgaatagaaacaactccagagtctagtggacatgggctactcaggtctagaatctgtgtcttgggctttgatagactactcgtgtcttttctagctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaagggtaagaagtcacattctcatttttgcttcttttttttttttttgtcctgggaattaataaaacatattttcaaatgcataggctagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacaaagtttgagataacagtaagtatttgggaaccaaaaagtaatagattaggaaactttacatatttattgaatgccttttgtttttcatcttcaaaactgattcctgactgggtgcagtgggtcatgcctgtattcccagcactttgggaggccaagggggcgtggatcacctgaggtcagagttccagaccagcctggccaagatggtgaaaccccgtttctactaaaaatacaaaaattaaggccaggagtggtggctcatgcctgtaatcccagcagtttgggaggccgagacgggtggatcacctgagatcaggagttcaagaccagcctggccaacatggcgaaaccgtctctaccaaaaatacaaaaaattaaccaggcatggtggcgggcacttgtaatcccagctactcgggaggcaggagaatcgcgtgaactcatgaggtggaggttgcagtgagctgagattgcgccactgcactcagcctgggcaacagagtgagactccatctcaaaaaaaaaaacaaaaaacaaaaacaaaacactgatttcttaagaattctggtatattttagtgtttcatctgtattgtaacatttttctgaaattttagctccttgtttcaggtttttaatttgctagagaggcctgtttatcataagaatcaatagctagcgttccctggagcttcttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcaggtgagatgagctgccgtcccgctctgctccctccaacatgttgattccttaggggtgctgtagcagaggctctcaggcgcttctccgggaaccataaatcccagagtctaagaatcattacatgaaatcaaagccagtttattagcagtcctaaacaaaagaaatcaccaggaggaaaagaaaaaaaagcccaccagattatgtaccctactgggagaagatgccttgtcttttttcttttttttttttttgagacagggtctcactttgttacccaggctggagtgcagtgatgcgatcatggatccctgcagcctggacctcctgggctcaagtgatcctcccacctcagctttccaggtagctgggaccacaggtacacgccaccacacccagccagtttttgtatattttgtagagatagggttttgccacattgcccaggctgatcttgaacacctgagctcaagcaatctgcccaccttggcctccaaagtgctgggattacaggtgtgagccactgtgcccagccgatgtcttaacgttagtaaatctgtataatttcttggcattaacaggaagccagaattttgttttgttgttaggtggtgtatcctagaatggtgctactggccttctgtgaaagctaagaaatcatttcctagtatttgcctcattgctttgaaaccaaataagatttgattgcttcctgatccttttgctgctacctggttttgattattttggggtctcacttttcagtttcttcatgatctctccaaccgaccagcaggtccactgttgggcctggcttaagaaacacatgccgaaagacagcaacctgctcctggaggacgtcacctggaagtacacaggtacgggggttcgggctctgccacgtcgaaaaggccagcagatgcagatgtgtccacgtttgccttctttacatttgactctcaaaaatgaacattagagttagcataaaagaggctctctggtcatagaaaattgatctctaggggatgcggtggctgacacctgtaatcccagcacttttggaggccgaggttggaggatcactaggtcaggagttcgagaccaacctggactatatggtgaaaccccgtctctactagaaatacaaaaattagctgggcgtggtggcacacacctgtaatcccagctacttgggaggctgaggcaggagaatcacttgaacccaggaggcagaggttgcagtgagccccagattgcaccactgcactccagcctaggcgagtgagactccatctcaaaaaaaaaaagaaaattgagggctggacacagtggcttacacctgtaatcccagcactttgggaggctgaggcgggcggatcatgaggtcaggaatttgagaccagcctggccaacatggtgaaaccccatctctactaaaaatacaaaaattagctggacatggtggtgcatgcctgtagtcccagctactcatgaggctgaagcaggagaatcgcttgaatctgggaggcagaggttgcagtgagccaagatcatgccattgcacctccacctcccgggttcaagcgattcttctgcctcagcctcccaagtagctgggattataggcgcccgccaccacgccgggctaatttctgtatttttagtagagatggggtttcaccatgttggccaggctggtcttgaactcttgacctcgtgatccacctgcttcggcctcccaaagtgctgggattacaggcatgagccaccacgcccagtcccagagagtacctaatttttaaggatgacttggttccctgattttctcactctcagcagtctcggcttaacccctcccaccttcccacctaactgatcttgccccttggccccaccagcgtttgctctcccaggctctcattctcaattccttgtagtagcaaatatgatatacgtcctgctcctggattgggatactacagaatgttactgaacaaaagtcatgttctagcctgtcttaggatggatgacatgtaattagcacaagctgatgtcacaaacactggtgtccagaataatgctttccttatctagtaagcattaggatatgtttgaagtggatttagcttctctgaatttaaagtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggtaagtgctgataaagttctgtttcttaaatgggcagagaatgtgtctttcatagcggtggcaggtacatattcttactatggtgttagcacccacaaagagtgtcttggctgggtgaggtggcacatgcctgtaatcctagcactttgggaggccgaggcaggtggatcacccaaagtcaggagtttgagaccagcctggccaacatggtgagaccctgtctctgttaaaaatacaaaaattagctgggtatggtctcacgcacctataatcccagctacttgggaggctgaggcacaggaatcgcttgaactctggaggcagaggtcgcagtgagccgagaacacgccactgcactccacctgggtgacagagtgagactctgtctcaaataaaagagtgtgctggccaggtgcagtggctcacgcctataatcccagcactttgggattacatcttatatttataaataaatataaaaatacaaaaattagccgggtgtggtggcgcatgcctgtggtcccagctactcgggaggctgaggcaggagaatgacttgaacctgggaggcagatgttgcagtgagccgagattgcgccattgcactccaggctggcaacagagcaagactgtctcaaaaaaaaaaaaaaaaatgtgctgcccttcattagcaaagaagtgactaagtatatttatttatttatttatttatttatttattttgagacagagtttcactcttgttgcacaggctggcgtgcaatggtgcgatctcggctcactgcaacctccacttcccgggttcaggcgattctcctgtttcagcctcccgagtagctgggattacaagcgcccgccaccatgcccagctaactttttgtatttttagtagagacagggtttcaccatgtttgccaggctggtcttgaactcctgacctcaggtgaaccacccacctcagcctcccaaagtgctgggattacaggtgtgagccactgcgcccggccttatttgtttattttttacactccaagcttgctttatttaataagcattaggatatctttgaagtggatttagcttctctaaatgtaaagtctttatgctttttggtttctgtagcactggattaaaatttgaagttacaggattatgacacacacaaaaatgcctttcgaagttaggtcccttctctccatgcagtgtggcctcttttctgtacacagagtaacttctgtgtctgtggcatcttcagggaagaaatggcgtaggtgaatctctgaacttcctacataattttctttcctataagtggcaaccacagctgagtgaaacaaactgtaaccgaatgaaagcaatgacaacggaatcctccccaggaagctgctgattagagagggccaaacggacagacatcttggccacctgtaacgagcaacttccaggtggttactgatggagactctttgaagttcacccaaagtgggatccacctacaaattgtttcacagttttccttcttctccgaggcaaagtgaaagcaacagaaaactctccactgttagctatcagtggacccctcccagcgtttgctctgctgcttggaggagtgacccatacgctcaacacctggcgagtgctgcatcctgtcagcctcctgtggaagcggttcacttcggtgctgtccaggactttccactttcctttataggaacggtgattgcgtcagtggccgctgttagggaactgagctgctatgtaacgtgttctgagaatcagaagcccatctttgaccccaggatagcagattaattatgtctgtgggcatcgggcatcatcttttgtatggcaggcggccagggtttgtctgctgattcccccagagaagacactcgccttgtcctcattgtgcctgctaccctcgactaacacaaggacctggcaaagaggaatattttgtgcttgtcaaggactttcctccactctctaccatcagcttggctaaaactcctgagatggtaacagtagcaagcagagatgtcacataggcagtgctccattctctgtgcctcaggacctggaagttaaccactttcgggatgaaattcttgccttgacgtctgtctccctcaacagtaaacagagggtgcagcactaatgaaaggtttccccaggcgtccctcccttgacaagtaatgtgagtgcccaggctgactgctgcctttgtccctgcaggagatgagtgtgggctatgcaaatgggatccgggtgatgagcatgacgcacacaggagagccaggattcatgctctacatccccatagaggtgagagggcacccttcccttcccttcccttcacttcccttcccttcccttcccttcccttcccacaaccactgtggggtgccagtgctcccagcagcgcgttcaccagcactggcaggtttggagagctgtatctgattgggccttgggagctgaggtaggctgcattgaagagatttgaccatttttaactaagttatataagtttttttgaataggtgatacatttaaaaagtatttggcgccgtctgatctgttctcaccaactgtcaccaataatattagtattacttttatatgtcatttcagatttgtatgcatattgcaagcaaattcataattaatttttttttttttttgagacagggtctcactcttttgcccagggtggagtgcaatggcatgaccgtggctcactgcagcctcgacctcttgggctcaagccaccctcccacctccgcctcccgagtagctgggactgtaggcatgtgccaccatgcctggctaatttttgtatttttttgtagagacaggttttgccatgtcgctcaagctggtctcaaactcctgacctcaggtgatacacccaccttgtcctcccaaagtgctgggattataggtgtgagccaccatacccagccaagccccctttttaaaaacagaaatggaagcatactgctattcttcatcctgtttttttttttttcacttcacaattttttttttaattgaggcagagtctcactctgtcacctagggtggaatgtagtggcataatctcagttcactgcaaccttcgcctcccaggttcaagtgattgtcctgcttcagcctcccgagtagctgggattacaggtgcacgccaccacgcctggctaatttttgtatttttagtacagacggggcttcaccatgttgcccaggcttgtttccaactcctgacctcaagtggtccacacacctcagcctcccaaagtgctgggattacaggcatgagctaccatgcccggcctcacttcacaatttctcttagagctctttctttgttggtacctaaagcaaaagagcttccttgttctttttttctttattttttaacagtggcgtagcattccattgtggtacatcattccgatactaatagacatttatgttatttctagtcttttgctgttataaaaaggtctgcaggctgagttcagtctaatcatatgcaaatagtaatagtttcttccttctccagaaccttttttttgagacggagtctcactctgtcgcccaggctggagtgcagtggcgcaatctcggctcactgcaagctccgcctcccgggttcacgccattctcctgcctcagcctcctgagtagctgggactacaggcgcctgccaccacgcccggctaattttttgtatttttcatagagacggggtttcaccgggttaaccagaatggtctcgatctcctacctcgtgatctgccagccttggcctcccaaagtgctgggattagaagcgtgagccaccgcacccggccggcttttttttttttttttcttttttttttttgagatgaagtctcacacttgtcccccaggctggagtgcgatgacatgatctaggctcaccgcaacctctgcctcccgggttcaagtgattctcctgcctcagcctcccgagtagctgggattacaggcgcctgccaccacacccgactaatttttgtatttttagtagagacaggatttcaccatgttggccagcttggtctcgaactcctgaccttaggtgatccacccacctcggcctcccaaagtgctggaattacaggcgtgagccaccgcacccgggcccatagtctttcttcctataatttccttcctttgttctattgtgacaggtagcaatcaatgattgtaggcatgcttgttttcttcttgatgttagtcatactacttgtagtgataggttttctcttaattttttttttttttgtgagacagggcattgctctgtcacccaggctggcttactgcagcttgacctccgaggctgaagtgatccccctgcctcagcctcctgaatagctgggactacaagcatgtgccaacatccccagctaattttttaattttatttttgtagaggcagggtcttgctatgttgcctaggctggtctcagactcctggactctagtgatcctctcacgtcagcctcccaaagtattgggattacatgtgtgagccactaccccgaccttatttattactattttttagtgcagtgggatgatcatagctcactgtagccttgaacttctgggcttaagcagtcatcccacttcagcttcctgagtagataggaccacagatgcccagctatcttttatttttttgtttttagacggagcctcccactgtcgcccaggctggagtgtagtggcatgatctcggctcactgcaagccccacctcctgggttcaagcgattctcctgcctcagcctcctgagtagctgggactacaggcacacgccaccacactcggctaattttttgtatttttcatagagacagggtttcaccgtgttggccaggatggtctcaatcgcctgacctcgtgagccgcctgcctcagcctcccaaagtgctgggattacaggcatgagccaccgcacccggcctatttttttattttttgtagctttgagagtctcaatatgttgcccaggctggactctaactccagcctcaaatgatcctctcatctcagcctcccaaagtgttgggattaccggcgtgagccactgtgtctggccctgttttaactatttgagccactgtgcccaaccctttttaaatgattaaagcacagataatatcagcgcatgaaatttcatctgcttttccacactcagaagtattacaacaatatgaagatgaagagattgttcaagacttgggaagaatttaaacagatgcagctgccatggttggcctgtgcaggcaggttgattctgaagtgccacccagtggttcaggtgttgtcacctgggtgcttgtggtcaaacctcatcaggaaggggaggctctgtggctctagcagcttcatccttgcttggaggccttggtttcagctttctgatttccctgggctgttcccattcttatgatttttcaagagtctaagagattatttgtgccacgcttgggttctttataagctggcttttgtccaggaagcttatgtttgtctctctgagaagaggtcttccaaaacatgggggcagatggcagattctcgttttgttcacactaaatctctggtattttgtgagaaaaacgagtaaatggtggggaactactctttgagtaaatggtggggacccactcttctctttgattttcccagcattagtcacgtagttggatctggcccaacactagtcacctggttacatcgttcttccttggtcatcctcttacctaaaggaccgggcattgagcttgaggtgggagagtaccacattccctggagatgccagctgtgtattctcctcgtcctgccgcattctgtgggtctcctgcacccaccttggctgattcaggtgtttcccttacacacataccacaggcgagtgttgcatgcaatagcttggattccttttttccacatttaaagttgtcttcccggcacggtggctcatgtctgtaatcccagcaatttgggaggccaaggtgagtgaatcatctgaggtcaggagttcgagagcagcctggtcaacatggcgaaacctcgtctctactaaaaatacaaaaattagctgggtgtggcggcagccacctatagtaccagctactcgggaggctgaggcaggagattcacttgaacccgggagtggagatggcagtgagccgagatcgcgccacttcactctagcctgggcaaaagagcaaaactctgtctcaaaaataaataagtaaataaagttgtcttgatcatagtggtctgtttggtagatgcctgttcagctacagtggtgcagttcatagaaacatactgtgctaggataaagaactgcagtaccactgaagctggttctttgctacgtcttgctttggatttcattttacagttttaaaagcaaacagtgtagtctcatttttgttggactttaaacttaacagcgtatgttcagacagggattgaatatttgctttcagtttggaaaaccttctgttcactgatctgataacgtacatgtttctgaaaccaagaaaagagcagcttgagagcctgaatgctgtgggacatgagcaggcgagccctgccttcctggctcccccgccgtcatccgatgtgtgcacacgtctcgagtaacgtgtgagagctgggcctcacagcttgggccagtacgtgagggagtaacagtggttgggaaattggagcaaaagaacaaagccagaatcagatgaagaccatggagggttggtgggctgttttagaaatgatgatgagattggccatttaccaaatggtgagagagcttctataaattattatttaagaattgctgtaagctagaatcaccacacaagacattttagagaggtgaaaagacatggatcctgttgtcatggagcttaagtccaggctggggtgaccccagctcatcactcctgggctgtgccctgagcgtgtcaaggatgagacatcctgggagttttatacgcctcctctcttgtccatgttaatagtgtgagccatcagcgcttccagacatgctccatgcttaattctgaaggtctgctgcttatgaactttctgtctcttcctatagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaaggtactgtgtttacccagactccactttcactcagcatcccgagtagtgaatctgcactagactaggaagaagaactgatgtgacaggaaaagggggaaaagattgaggccttgatgttagcatcaggtaaatgaggacaagagtgccctgagaatgaaaactttataggataaaatatcttcaaatgaaaacataataatggtggctcacgcctgaatcccagcactttgggaggctgaggcgggtggatcacctgaggtcaggagttcgagaccagcctggccaacatggcaaaacccgtctctactaaaaatacaaaaagtaggccgggcacggtggctcacacctgtaatcccaacactttgggaggccaaggcgggcggatcacaagttcaggagatcgagatcatcctagctaacacagtgaaaccccgtctctactaaaaatacaaaaaattagccgggtgtggttgcgggcgcctatagtcaggagaatggcgtgaacccaggaggcagaggttgcagtgagccgagatcacgccactgcactccagcctgggcgacagagcgagactccgtctcaaaaaaaaaaaaatttacaaaaagtagctgggcgtggtggccagcacctgtagttccagctactcgggaggctgaggcaggagaatcacttgaacctaacaggcagaggttgcagtgagccaaaatcgcaccactgcactccagcctgtgtgacagggcaagactccgtctcagaaaaaagaaaacatagtaaatagatgacacttggtcaggtgcggtggctcacaactgtaatcctagcactttgggaggccaaggcaggaggatcacttgagctcagcctgggcaatacagcaagaccttgtctctgaattacaattgaaaaacaaacaaaaaaacccacttatttctagtgttctgctgtctaaaagactgagtgctttctgggaagctattctgagttaattatggtgatgcattaacatgccacgaatatttgtacaaactagtcgtcctatagtcagctgcctaatttttgtggtttttttcttttgtttttgattttgaggtggggtctcattctgtcacccaggttggagtgcagtggcgcgatgttggctcactgcaatgccctctcatgctcaagtgatcctcccacttcagcctcccaagtggctgggaccacagatgcacaaccatgcccagctaatttttttgtattttggtaaagacagagtttcaccacattggccagggtggtctcgaactcctgagctcaggtgatccgccctcctcggcctcccagagtgctgggattacaggcgtgagacagcacacccggcctaatttttttggtttttttgttttgggcggatcacctgagttcacaagttcgagaccagcccggccaacatggtgaaaccccgtatctgctaaaaatataaaaattagctgggcatggtggcaggcacctgtaatcccagctactcggtaggctgaggcaggagaattgcctgaacctgggaggcagaggttgcagtgagccgagatcataccattgtactcccacctgggtgacagagcaaggctccatctccaaaaaaaaaaaaggtaataacccattttggaaaatataaagaaggaaattaaaatcacccatattttgtctatttaatggtagtaactattttttttttctttcttgagacggagtttcgttcttgttgtccaggctggagtgcagtggcgcgatctcagctcactgcaatctctgcctcctggcttcaagcgattctcctgcctcagtctcccgagtagctgtaagccatccagctaattttgtattttttgtctttaccaaaatacaaaaaattaggtgggtgtggtggcgcatctgtgggcccagctacttgggaggctgaagtgggagaatcacttgagcatgagaaggcatttttgtattttttctttttttagtagagatggggtttctccaggttggtcaggctggtctcgaactcctgacctcaggagatccccccgccttagcctcccaaagtgctgggattacaggcgtgagccaccgtgcctggccataatcaccgttaatagtttattctagtcttatttgttgtacatatgtgtatatatgtgtgtatgcattgaatatagatgtgcatggtcttgttgggattatataaaaaagtctttttttttttttttttgagacagagttttgctgtgtcaaccgaggctggactgcagtggtgcaatcttggctcactgcagcctctgccacccaggttcaaacgattttcctgtctcagtctccctagaattataggcacactccaccagaatcttggctcactgcagcctctgcctcccaggttcaagtgattttcctgtctcagcctcccaagtagctagaactataggcacactccaccacacccagcttatttttgtatttttagtagagatgaggtttgcctcatctctgttcaaggcgtgagccaccacgactggccaatataaaaacatttttctaaagtactggactgataaggtattttattaagtgagtgagttttcttcctaaacgtttttgttctatctggtcttgtgactttatgtttataaaataggaaacaaaatgcgtacctctgttgttacaaaaattaccgcggcgtcttttatatttcacatgcagtttttcacatggtagaaatcgcacagtttcccaaaagctggcagggttgtgggaggaggcggctgtgccccattgcagtgacaccaggggacccttcccacggtgctgctctctgtgccgagggtctgagtgtcgctggatgactcggcgtttcctttctttcttagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcaatttgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactactcttgcacggctgcttgtgaaatgttcttcatctgtagtgacttaaatgtgtttgccaccacaaagcataaacagcgtgcagaggagagtgtgtacctccctgtgtgtaccagtgtgagggaggatttggggacgggggtagagaagatgtaggtgtttatcttaccctccctgcagcgctggagtggctgggggtaaaagcttcccgcctcctgaaattccgaccggccttctgcctacagctgacctcaggaggaacctgccacctgatgttccacacgggcacgtgtgcactcaggtttgtgtggaaagcaaggggggtcgtgttctcaccctgtggaaacaaccctgagagaaacaaccagtgctctttttctacaccagcttccatccacaagttggtccctggacttgacctgttcactaatttttttttttgaggcagagtcttgctcttttgcccaggctggagtacagtggtgtgatcttggcttactgcaacctccactcccaggttcaagtgatttcctgccttagcctccagagtagctgggattacaggcacgcgccaccatgcccagctaatttttgtattttcgtagagacggggtttcgccaggttggccaggctggtctcaaacccccaacctcaagtgatccacccaccttggcctcccaaagtgctgggattacaggcgtgagccactgtgcctggcccaaagtaatttttgagtagtttttttttttttaagtatttgtacttttgagaatctcataggttaacatgtttacaacaatctcttcatcttgtcttctaaatcagccccttctattccagttccaggaatagtcaaccacgccagaaacctgggactcacctggtctccccactcgcctctccctacacctcccgctcattacccagcctcacagggctgtctcctcagtgcctctcctctgttcggacctcactgtccccaccactgctgctgtggcagagagggttgtcagccctgacttcgagaacaatctcttactgattttcctgcttctcatgtcatcccccctccctctgcagggttgtctttgtaaaacaggggaggtcaatttactcactgccttgaaaccctcaagggactcccctttgtcgtgagacaaagctctcagtccttagcctggccagccagggtctccagggtgtggcaggccacgctgccccagggctccggcctgcgctgcgtgtgatgtgggtcctgcagccgagtgcgtgctcgccatccacagctggatctcacctcgaatcctgctttccagtcacactgagaggtctcccactcccatatttgctcactaaaatgcctcctggcagccctcccctgtgcttgtggaaagtcgcaaattgaggatcacatggacccccactcccccaagttgtcctgacagagacctcctgtctttcatttgattgattgattgagacggagttttgttcttcttgcttaggctgctggagtgcagtggcgagatctcggctcaccacaacctccgcctcccaggttcaagcaattctgcctcagcctcctgagtagctgggataacaggcatgcgccaccatgcctggctaattttgtatttttagtagagacgaggtttcactatggtggtcattggtcaggctggtctcgaactcctgacctcaggtgatcaacccacctcagcctcccaaagtgctgggattacaggtgtgagccacagtgcctggcccctcctgtctttcaaaagctctgcccaagaccaccatcatcccacagtggagcctttccttccccaagagaatggcccctttggggtcctcacacacccgtttctgatgtgtctttatttggttatctgccctgctccttctgtaagtccctcggagaaagactcgaattctcccaaactccaacacctcacatggtgtttggtgtttaacagatgattaaatgaatgggcaaaaagtggagggcaaaatctttaaaatgtcttttaagatttaaggattttaggccaggtgcggtggctcacacctgtaatcccagcactttggaatgccgaggcgggcggatcacctgaggttgggaattcgagaccagcctgaccaacatggagaaaccttgtctctactaaaaatacaaaattaggcgtggtagcgcatgcctataatcccagcttcgcgggaggctgaggcaggacaatcgcttgaactcaggaggtggaggttgcagtgagccgagatcacgccattgcactccagcctgggcaacaagagcgaaactctgtctcaaaaagaaaaaaagatttaaggattttaaatgtttgatttttttttcttgttgagatagagtcttgctttgtcgccaggctggagtgtagtggcgtgatctcggctcactgcaacctctgactccctggttcaagggattctcccacctcagcctcccgagtagctgggattacaggcacacgccaccacgcccagctaattttttgtatttttagtagataccgggtttcaccatgttgaccagcatggtctcgatctcctgaccttatgatctgcccacctcagcctcccaaagtgctgggattacaggcgtgagccaccgcgcccggcctgaaaatttttaaatgattgtttgccgactttacaacaggacgatgttgttgttcgcaggccagtaggtggcgctgtggcacgtgatctgagcctcctggattcacacaactgttcatgtggagaacccagtgccgggacccattagcaccccagtcaggctatgcgtctccctcccaagggtgctcacctggtgtggccttcatggcacagggggagtgagatgaggctcctttagtacaccctcccctgagaagagcgacgtgtgcttaccctccagtggcttgttctcatgaaaggctccacagttagggaccttcagatgcttagatctggggtgtcacctgactcaagcagctcagaatcccagattgttgtggtgggtcaagggcatggggctttgggtttactggcctgggtctgaatgccagcattgcctcttccttggtgtataggaccttgggtggttacttttcctaggcctctgtttacttgttttaaaatggacagtgatgcctactttatagggttgttatgaaactcaactaatgaatataaaatactcgacccagactggcatggtggttcacgcctgtaatcccaacactgggaggccaaggtgggaggatctcttgagcccaggagttcaagaccagcctgggcaacttagggagaccccgtctctaccaaaaataaaaaaattagccaggtatagtggtgtgtgcctgtagtactagctacccgggaggcagaggtgaaaggatcgcttcagcccagaagttcaagactgcaatgagccgtgatcatgccaccgcactccagcctgggtgacagatcaaggccctgtctcaaaaaataaattaacaggtcgggcgcagtggctcacgcctgtaatcccagcactttgggaggctgaggcaggaggatcgcttgagcccaggagttcaagacaagcctgggcaacttagggagaccccgtctctaccaaaaataaaaaaattagccaggtagagtggtacgtgcctatagttccagttacccgggaggctgaggtgaaaggatcgcttcagcccagaagttcaagactgcaatgagccctgatcgcgccactgcactccagcctgggtgacagatcaaggccctgtctcaaaaaataattaattaaatacttgacccattgcacgatctttccatgcacgacagctgctcttctattattcttccaggatgagctgcacagcctgcccccttgggtttccaggttgtgggagatgagcaaaactgaatgacctcagtaggccaagagcaaaggatgtgggtccggacctggtggccagttgcttgtgacaggagctgggctggagtccccaagtgccactagtgctgacatcttttaactgtgttcattgtgacttgtttatttctaaaagtaaccactggcgccttggtgcagatggaactccaggtgcatgcggtgagttaaccatggtctggggagctttgtttccacgcctaggacatgcatctgtgtgcatgatatgtgagctgatatagccatgcctctggtgatttgaacgcctgcgcttcccagctgcttcagggccctgaacatcgctggatgtttgtacttcattccctcctcagcccagctggtcccactccgcagctgtgctctaggcatttcatctcaactgggtgatatatttgaatacagcaattataagaacagcaacctcagaagaacatctggcatccagacctccccagcctagttccacaaggtaccaacttccgtaagccttgaagagctaagtaagacatccgggccgggtgcggtggctaatgcctgtaatcccagcactttggaaggccaaggcgggcagatcacttgaggtcaggagttcaaaaccagtctggccaacatggtgaaacgccatctctactaaaaatacaaaaattagccgggtgtggtagtgcatatctataatcccagctacttgagaggctgaaggaggagaatctcttgaacccgggaggcagaggttgcagtgagccaaggccacaccactgcactccagcctgggcaacagatcccttggtatagatacggggagcttgggtggtctcatcacagcagaacctcagctcttggcatgttctttcctttgctaccagcttttgaaactgaagtgtagcagagtcatgaaccagactttgaaacatgaaccagacagagaaacattttaagaagtagcggctgaccaggagttggagattgcagtgcactatgattgcacctatgaatagccactgcactccagcctgggcaacatagtgagacccctatctaaaaaaaaagaaaaagaagggccaggcacggtggctcatgattgtaatcccagcactttgggaggccaaggcaggtggatcacaaggtcagatcaagaccatcctggctcacacagtgaaaccccttctctactaaagatacaaaaaattagcctggtgtggtggtgggcgcctgtagtcccggctactcgggaagctgaggcaggagaatggtgtaaacccgggaggcggagccgggcgcggtggctcacaactgtaatgccagcgctttgggaggccaaggcaggaggatcgcttgagcccaggagttttagaccagcctagacaacatggcaagaccccgtctctaccaaaaatacaaaaaattagccgggcatggtggtgcatgcccatagtcccaactacctgggacgctgaggtgggaggatcacctgaaccccggagccgtgagcacaccactgtactccagcctgggtgacagagtgagaccctgtctggaaaaaaaaaaaaagtagctgggtatggtggcacgtgcctatcgtcctacctgctcaggaggctgaggcatgaggatggcttgagcccaggaattcgaggctactcagcaattatggtaccactgcactccagcctgggtgacaaagtgagaccctcaaataaaacaaaataaattggccataaatgtaagagttttttcctgtattgttcattctgttccttgatctatatgtcttgtcctttttccatatcttatagatgtgattactagaagtttcatagcaagttttgaaatcaggtagtatacattctccagttttattctttttcaaatgtgttttggttattctaattcctttgcgtttccatgcaaattttaagatccagttttcaaattttttttgagatggatcttgctatattgcccaggctggtctcaaactccagggctcaagggatcctcttgcctcagtctcccaaatagctgggattacaggcacatgccaccaaacctggcctctcaattgctttaaaatacaacaacaacaaaaatcttttggaagtttgatgggcattgcattgaattaatagacaaatttggggagaattaccatctatcttaacaatattgagtcttcccctggccaacatggtgaaatctgtctctactaaaaatacaaaaactggccaggtgcagtggctcatgcctgtaatttcagcactttgggaggccaaggtgggtggctcacttgaggtcaggagttcaagacctgcctggccaacatggtgaaaccatgtctctactaaaaatacaaaaattagccgggtgtggtggcgggcgcctgtgatccaagctacttgggaggctgaggcaggagaatcacttaaaccgaaggggtggaagttgcagtgagcccagatcgcgccactgaactccagcctcagtgacagagtgagactctgtctcaaaaaaaaaaaaaaaaaaagaaaagaaaaaaaaagaaattagctggacatggtggcaggtgcttgtaatctcagctacatgggaggctgaggcaggagaatcacttgaacccaggaggcggaggttgcagtaggaagagatcacgccactgcactccagcctggacgacagagcaagactcagtctcaaaaaacaaacaataaaacaatattgagtcttctattccatgaaggtgaaatgtctatgcatttttttagatctttagtttctctcagcaatgttgttttacagttttatgtgtatggattttcttttttttttttttttttttgagaatgagtcactctgtcgcctagtctggagtgcagtggctcaatctcggctcactgtaacctccgcctcccgggttcaagcaattctcctgcctcagcctcctgagtagagtagctgggattacagttgcccaccaccacgcctggctaattttttgtatttttagtagagatgaggtttcaccatgttggccaggctggtcttgaactcctgacctcaagcaatccatctgcctcggtctcggaaagtgctgggattacagatgtcagccactgtgcctggccatgtgtggaactgtttcctcaatttcattttcagattgtttattgccaatgtgtagaaatgcagtggattttggtatgttaattttgtattctgagacctttattctagtagggtttttttttttttatacattcctttggattttctacagtagaattatgtcatctgcaaatgaagatagttttacttctttcttttcagtgtggatgcctttaatgtctttttcttaacttattgcacaaattgcgcattcaatagtacaatgtttagtgggaccggtgagaaaagacatccttgccttgttttgatcttagggaggaaagtctttggtctcactgttaagtgtgatattagctgtacgttttgcgtaagggctgtattcgtttgctaggactgccatacaaggtaccacacactgggtggcttaaaaaacagaatgtattttctcagagttctggaggcataaaggccaggatcaaggtgccggggggttggttccctctgaggacctctctccttggcttgtctacagccgccttctccctatgtcttcacaggatcttccctctgtgtgtctcttcttataatgaggccagtcagactggatcaggacccaccccagtgacctcatttaactttaattacctctttaaagaccctatctctaaatacagtgacacggaggtaatggaggtaggacttcaacatactaatttggggctggttgtggtggctcacgcctataatcccagcagatgacttgagctttgagaccagcctgggcaacatggggaaggcccatctctactaaaaatacaaaaattacctggcatggtggcgcacacccacagtccagctactcaggagcttgaggtaggaggatggcttgagcctgggatgtggaggtcaaagccccaggagcagaggtcacagtgaaccaaaattgtgccactgcattccagctgggcaacagagccagacttcgtctcaagaaaaatttaaaaatcaaatagacatgatttttttttagacagagtctcattctgttgcccagcctggagtgcagtggtgtgatctcagctcactgcaacctctgtctcctgggctcaagtgattctcatgcctcagcctcccaagtagctgggattacaggtgtgtgccaccatacccagctaatttttgtatttttagtagagacgggattttgccatgttggccaggctggtctcaaactcctgacctcaggtgatccgcccacctcagcctcccaaagtgctggtactacaggcatgagccactgcacctggcctaatttttttttttttcttgagacagaatcttggtctgttacccaggctggtgtgtagtggcacgattacagctcactgcagccttgacctccctggctcaggctatcctcccacctcagcctcccaggtaggtgggactatggacacgtgctaccacgcccagctaattttttgtattttttttagagacggggtttcaccatgctgcccaggcaggtctcaaactcctgagatcaagcagtccacccagcttggcctcccaaagtgctgggattataggtgtgagtgagctactacgcctggcctggacatgtaatttttaaaagaaaatgtggccacaactctcctagagttaaatgttttttttgtttgtttgtttgtttgttttttgagaccatcaacaagatttcaaggctttaaagaaaggagctgcttcaggaagagataaaatgactcaaacgctataaccttcaaatgtagactgggagaagaggtatcagctatgcatgagctggagaggggtgggatagatagagacacaggtgataaagaaaatatagcaaaatgtgaatcctacaatctgggtggtggatgtaaaccctgtagtagcctcacctggggaaagctgccttgcaacaatgaggctgcccattctccaaacccaccccagccaccgagcaggctccactaaaaagtctgaacccaggagggagtaccatggaaaccaagttgcaatgccctggttaggggcccagcagaggggtcatcccagctctacgccattggatactgagtttcaggagtgggagtgccatcctcagggtcacacagcgtgtcggttccagcctaggtcttccagtgtctcattaatcttttatccactcagcttctcttctggcccatgaaccttgctctcctgggactcttttttttttttttgaggggtcgggggtgggacagagtctcgctctgttgcccaggatggagtgcagtggtgccatcttgcttcactgcaacctccgcctcccagattcaagcaattctcctgcctcagcctaccgagtagctgggactacaggcacccaccaccctgcccagataatttttgtatttttagtagagacaggatttcaccatgttggccaggctggtctcgagctcctgacctcaagtgatccgcctgccttggcctcccaaagttctgggattacaggcgtgagccatcacacccggcctgggactcttcttgcagtgagccagggccatgggacccttcaaaagttgctccaccctaatccccaaaatatctttttctcccgcctgtcccaagtgcctggcatcatactatatgggtcaactggccatgtttgccatggaagcccaattgtaggaagtgggtcttttatcacccggcatagcagagctgtggaaactgcactgggaaagatcaggatgtgaattaaagcgttgggaatgggaaggcagagaccttggattagctgggatgctccatgcactcgctgagtgaccttggacaagccccttagacacactaagcccgtttcctcatctacacgacgggcatcccatctgctactgcaccaggttcttgtggcaataacttgaactcacacatgcaaacaggctttgtgagctccataaacacaggtggctcggccaggtgtggtggctcatgcctgcaaccccagcactttgggaggccaaggtgggaagatcccttgagcccaggagttggagaccagcctgggcaagacgatgaaatcctgtctctaccaaaaaaaataataataattagccaggcatggtggcacacacctggtcccagctccttgggaggctgaggtgggaggatcacttgggcccaagaggtcaaggctgcagtgagctgagattataacactccaacctgagtggcagagtgaaactgtctaaaaaataaaaataaaaatacatcaaaaaacaggtagctattaagcattgctaggacccacacgcagtgaccctgagggtgctgggtttctgtttgagggagaagaaactcctgagcccctaggtattgtgggggacatgcagttccagaccgccttcatggcctgtatgcctggcctcatccccatccctggcacccatgacgatagccacattccactggtgtttccccaggaaagccaaccctacctgcatctcagcagagcttccacggagttggaaccccgctccgagagggtgtgggctcaggggccaggggtcacacaaactccagaaggaggacgtagttggtttgcaaggctgtcctttgccctggttgaataacctttggtcttccccgagaggaacgtgggcattaggctgcagcccacaggaagctatgtattttctgagaaacttggcccatggtgcagatctgctccagctcactctggtgggatcacgccagccacggccgggccacggcacatcatggcaacgtgctgcccacctgctacgccacctgtttttctagaggcggacgtgatcccagcaggactggagtcagcccagggcatcacgtgctctggtccccgcctgctttgactcctcctgcctcactccccccctggcctgtagtcacgttggtgagggtggtgggcaccggggctgggcccagcccccgaccctgcccagacagactttcctaaggcacccttttcctcgtgcaggtgcggcctcagcccacccccctttgagcccacagattgcacccctctggtgtgcggttacctcttgcctatgtttaattcatggctggggggttgggacgagcttcccaagaaaggaaagaactcccctggggtcttgcccagtttctgctcaccagaaggaccatagccgaggtcctcctcccagggcccggggctggggagcggaagccatcagtgggctcggaggacactgtcccagccaggacacggccatcggtcactaatctgcagcactggaatgtccgcaggccaatcagcggggtctctgggggctccccaagggtgctaataatcccacaatgattagcaggggccgcgggtcagtgcacgccactctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggaggtaagggacacctggtgaggaggtaggtggaggcaccattatgagctctgaggagtgggtgctaggagacttctggaagcccggtcccaggcctgagccccaggccgtgcgggtggtttaatgaggaagccctgggacagcccgggggcggtgaggggtggatgctggactggggaggaaggaggaggaaggaggaccagggctggggtcaaggaggaacgccgaggagcgctgtggctggggcctggagaaatccgtggcccggaggagccccagacaggggcctgcgggagccagggctggcccctacacccagcccgcaccgctgttccctcccgccaccccaaccccagcactcagcccacgcctgctgtacctggtctctctctcagcctcgctccattgctatgccccacgtcccctgcacccaccacactcctctcccatcttgttttccaagggcagggacacatgcttattctgccgtgtgttgggttcaggtccccccatcctcgggctgcctgaccttctctctccaccccagccctgaacaggaaggagagtttcttgctcctctccctgcacaaccgcctgcgcagctgggtccagccccctgcggctgacatgcggaggctggtgagtacccgacccagctgggctctgccaggggggtggccggaggcgcggaccccagagggcggctcaggaggccacgcctgtccaggtgcccttccacttgaccagggtgggcaggcacagccagccaccttgcccctgagggacggaggccctggttgctgggggtctctgcagtttcttaaccccccaccctcagttcaggaggtcgggccccttggctcccactcgcctgaagggcaggaccttgggccttccctggcatcttgttgccacagagaccaggagccacaggaggagccggatcccctcctccagggaaggggagcttcacgaggagccctgcaggatgggcggccgggccagggagggagaaggtcgtgctgggctggggaggggcttctgtgcggcaaggacccagcgcctcctcctgagcttatctgagccacgaggacgggccttgcccatgttctctgctcactcactcgtccacattttccacattttcagcaggggccgggggtcgggggtatagagttccccaccagcccggctggggctgcggggttgggactgtcatctggaggctcagaaacgctgccctccattgtctgggaccccagcagccccagcccatgttagcaggccagggagccagggcagggtggtgggggcgggagggttccccatggctgcttcccatgaactcctccaaggcaggtggccacagtggcgaccttgagcactctagggtcagtttcccaggaggtgggggtggggtggctaaatgcggggggtcgcttctcccccattcccagccctgagtggctctgcctctcctcaggctcagaccctgggcaaccaggggtgctcccagctgtgacctccgtggttgggtactcctgcctgggaccccaggaggggctgcggtggtcgttggctggcagctggcaccctttccagggcccttttgtcaaagtcttagaaaacttcatttccataaaggtgcaaatggagctccatggctcagcctccctcgtggcccggccccgagcaccctccgggcctctagggctccagggcaccccttctttggacacagtggagactgaaggtcttgtgggggtggagggctgctgagggaccccggggagcccccagctcctggccccagccttcatcagaggtaaaaccccgatggacattagtgcaggatgaagttggcttggggtgcagccccgaggggcccccctccctgcatccactcagtgcttgtgagtcctatcctgcaggcacctccctgctccgtttacagatgagctcagggagtctcgggagatcaggggactgcaccaagtcacccaggggtggtgattgccaggcccacttgtttaagaagagggagggggctgggcacggtggctcacacctgtaatcccagcactctgggaggctgacacaagcagatcacctaaggtcagcagtttgagaccagcaatggccaacatggtgaaaccccgtctctactaaaaatacaaaaattagccaggtgtggtgtcacatggctgtaatcccagctgcttgggaggctgaggcaggagaattgcttgaacctgggaggcggaggttgcagtaagccgggatttctccactgcactccagcctgggcgacagggtgagactctgtctcaaaaaaaaaaagaagagggagggggcggggtcagctgtgcgtggtggggagcatatgaggccaggctcctgggggcaggagactagggcagagaggcgtggctgtagggctttttgcatcacaggagggcagcatggccgggtgggagcagtggagcctttctgacaatggccagggcccaaacacagaaccagtctgcaacgcgtgggcactgctcacatgaccagatgggagaaagacagcaggagcgggtcccactgcctgggcagggccgaaggatgcccacgacaggatttggagatggaggctcagtcgtgagaggagctgggctcctcctggagggacatcagacaacaccagtgcttcctccagcaggactcctcatccagtgctctctttgccacctgacctggcacccggtggatgctcagagatggcaggggagttgaatctttgaggcctggcccagcagtcaaaggcctcccacagatgtctgtttgtgctgcccccaggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcaggtgagtgtgctgcaggtgaggccagcgtgccagctcccagatacagacttccactggtccatctcagaagaggctacagtttgtcctaaatgttgggattccttttcctccaattggtttagttttactttttttttttttgatacggagtcttgctgtgttgcgcaggctagagtgcagtggcgtgatctcggctcactgcaacctccgcctcctggactcaagtgattcttgtacttcagcctcctgactagctgggactacaggcatgtgccaccaggcctggctaatggctttatacttttagtagagatagggttttaccatgttggccaggttggtcttgaactcctggcctcaagtgatccacccacctcagcctcccaaagtgctgggattacaggcgtgagccactgtgccccgccacattttttctttttttggagacatggtctcagtctgtcaccccaggctggagtgcagtggcgtgatctcagcttactgcaacctccgtctcctagattcaagcgattcttgtgcctcagcctcacaagtagctgggattacaggtgtgcgcctctacacccagctcatttttttgtatttttagtagagacagggtttcaccatgttggccaggctggtctcgaactcctgacctcaaatgatctgcctgcctcagcctcccaaagtgctggggttacaggcgtgagccaccatgcctggcctaagccactttttttcaatctgaaatataaataatttcaaacataaacgtatttatttatttatttgagacgaagtcttgttctgtcacccaggatggagtgcaatggcttgatctcggttcactagaacctctgcctcccagattcaggtgactgtcctgcctcagcctcccaagtagctaggactacaggcacgagccaccacaccccactaatttttgtatttttagtagagatagggtttcaccatgttggccaggctgggtctcaaactcctgacctcaagtgatccacctgcgtgggcctcccaaagtgctgggattacacgtgtgagacaccgcacccagcctcaaacgtaaatttaaaacggccccactcttacccactacctaggtttagaagatgctactaaactaaagccctgctcctccccttttcccgctgtccctccctggagggaatcttcccaaagttcaggagcatcactgccaagcaagtttccattttttctcttcattcaacaaatatttgttgagggtcttctacacacacctggtgctcttcagatgcactgaaaaacacaagcaaaatcccaggaaatatttaatacctccactacctgtgcaagtgggttgtgcatgtttaaatattacacaaggctgggtgcggtggctcacgcccgtaatcccagcactttgggaggccaaggtggcaggattgcctgagcccgggagttcgagaccagcctgggccacatggaaaaaacctgcctctacaaaaaaatacataaattacccaggtgtgatggtgtgcgcctgtagttccagctacttgggaggctgaggtaggagaattgctggagcctgggaggtgaagattgcagtgagctgagactgcgccattgcactccagcctgggcagcaggagtaaaaccctggcttagtaaaaagaagaacatgtgcccctacaactaggtgctgccaaagtgcttacgccaactgtgcagaccagcaaaccagttcccacttcccgaagatcttctggctccttaatttttttttttttttttgagacggagtcttgctctgtcgcgcaggctactgtgcagtggcgcgatctcggctcactgcaagctccgcctcctgggttcacaccattctcctgcctcagcctccctagtagctgggactgcaggcacacgccaccacacccggttatttttttgtattttgtttagtagagacagggtttcaccgtattagccagggtggtcttgatctcctgacctcatgatccgcctgcctcggcctcccagagtgctgggattacaggtgtgagccactgtgcccagccttggctccttaagttttgtcagactcaaaggtgtgaaaaacctaactctgttttgttgttggtggttgttttttgtttgttttgtttttgtttttgttttttcgattcagagtcttgctctgttgcccaggccagagtgcagtggtgcgatcacagctcactacaacctccgcctccccagttcaagagattctcctgcgtcagcctcctgagtagctgggattacaggcgcctgccaccacacctggctaatttttgtatttttagtactcctgacgtcaggtaatccacctgcctcggcctcccaaactgttgggattacaggcttgagccaccacgcccagcctctattattgtttctaattttcttgatgtgaatgtttagatcattaattttaaatcattttttgtttctactatatacatttaaagctataaatttccctttaaacgatttcagctgcatccaataagttttgatgttttttctatttccaatcatgatgttgtttttgtttgttttgagacatggtctggctctgtcgcccaggctggagtgcagtggtgcaatctcagctcactgcagcctcaatttcctgggctcaggtgatcttctcacctcaggtccggagtagctgggactacaggtgtgtgccaccatgcctggctaattttttgtatttgtaatagagatggggttttgccatgttggccaggctgatcttgaacttctgaactcacatgatccacccaactcagcctcccaaagtgctgggattacagatgtgaaccaccacacctggccatgatgttgttttagattttgaagtgtatctttaagtttctaaactatgttatcttctctatttacttgtaaattatttactttaaatttcattgcattgaattcatagaatgtgggctgtaggatgtgctgattctttgctatttgttgaaacttgcttagtggtctaatgtatggtcctcctttctggtttgcaaaagtcccatgcattcctaaaaacgatacatattctttaagtgttggatacatgtatatgatcacatgttcacatctgcctgctacaagccagtcttgtacatgtcatttttagtctctactggagagtttgtttcactcttcttatatattgcccatttgtgctatttccaagctgttgctgattctaagactttaaactggtttgcagacctgtatccattaggttttattgcatgacatactaccccaaaatttagcagcttacgattctgcaggtcagccacttgggttgggctcagcagggaggttttctggtcttggctgggcccactcatacacctgcaatcaactagggggccggctgggagctggctgtgcaaaaaggcctctaatggttcatctctgttccatgaggccttccaaactcctatactgagtttgttcatgtggtgactgagcatggttctatgagaatgagtggaaatggcaaggtctcttaaggcctaggttcaaaatcggctcagtatcacttctgtggcattctggtggccaaaccagttacagagccagccagattcaaggagcaaggaaagagacacctctctttgctgcaaaaagctgcagagtcacatttaaaggagtggcctggtgcaagaaatgaatggttgtggtcaccatgcagtcacaaggcccttgatgttccagtctttttttggctactcccctccacccatcaacaatctcccctcatttcaggtacctcccctctccatccccctctcaactaagaaagccttcctaggccgggcacggtggctcacacctataatcccagcactttgggaggccgaggcaagcagttcacctgaggttgggagttcaagaccagcctgaccaacatggagaagccctgtcgctactaaaaatacaaaaaaattaaccgggcctgtaatcctagctactcgggaggctgaggcaggagaatcacatgaacccaggaggtagaggttgtggtgagccaagatcaggccattgcactccagcctgggcaacaagagcaaaactccatctcaaaaataaataaataaataaataaataaataaataaataagccttcctgaactattcccacccatgcttctacccctgcccaggacagctgctgctcctgagccctcgaggaggtaagggagccctctgttcacctggatgatagcgaaagctgtgtccccctccccaggggtggttcacaatagggtttctgatcccctgtgtctcctgtagctcgtgtgggccacctcaagccagctgggctgtgggcggcacctgtgctctgcaggccaggcagcgatagaagcctttgtctgtgcctactcccccaggtaagccctgctacaccctctgctgggatgtctgggagacagggaggggtgctttcaccgagggtgagattcccacacatccacccgaaagtagagtccctgatgccttgctctgcacccttggtgggagaggggaggagaggaaaggcagagggtgctaaagattctggccacgcagaaggtgctgctctgcggatgtcccttcctggatactggtcctggtatcagggagtttgtccaggattggtttggaggccatctcttctctcccagggaatctccctatctcacccagctccctgactccctggcctggccgcaggagctgaaggggccaggggggcaggcagcagggccctgcctctgccttgcccaaggccaggccctcccacaccctgtggtgcctgctcgtcctcacagaggcaactgggaggtcaacgggaagacaatcgtcccctataagaagggtgcctggtgttcgctctgcacagccagtgtctcaggctgcttcaaagcctgggaccatgcaggggggctctgtggtgagtgcatgagggctcagtctggtgaccctggggtgggggtggtagcatcctactgggctgtcccagaagccctggcccttagcacccagggaggctcctgcccggcctgctgggaggagacccttttctcagagtcccctcctcctctgaccagaggtccccaggaatccttgtcgcatgagctgccagaaccatggacgtctcaacatcagcacctgccactgccactgtccccctggctacacgggcagatactgccaaggtgagggcactggagcctgggtgtgcccagccctgctctcgtggcaggtcctagggctgctacacttcctgagagtctcaagggtgtcagaggtgctgactgtgtactccctgagtctgcccactgcatacattctttcaacaagcattcactgagcactagctgtttgccagaccctgagctgtgcaggagattcaaagtgaaatcaggttcagccccttaggctctgggaggaggacagaattaggacccagaagtggattcttgccctactgcccctctaccctaacccactctgtgaccatgggcaggtcacctcccaaactccaatatgcctcactctgcaatggggaccaaaccaaagacaccaggcgtgccagcaatcggaagccttggtgggttctgtctatgggaggggtattcttgctgtggttggcattccctggatgttcgaggcctctggggggcagcgtggggtccagaaggctgggggctgagcctctgccccactgccctgccctggcagtgaggtgcagcctgcagtgtgtgcacggccggttccgggaggaggagtgctcgtgcgtctgtgacatcggctacgggggagcccagtgtgccagtgagtcctgccccagggcccccaaagagccagctcctctcaagaccccccttcaatggggcatcagctcccaggagcccgctgtgtgcctctctttccaactcattcagtgacaacacgttgagatcttgaaactggccacagcatggatatttacaccaaagaaattggcaaatgctataaaccatggatttttttttttcttttgagagagagcaagctcaatattccaacttaccagctcgctcctgaccctcaccacccactcttttggagcaggtggccagaggaaggggcaccctgagcttagctccccggcagggcaggaaagggcagggattctgaagtccacacacaaactcaggctcccctaccccagccaaggtgcattttcccttccacacctgtgacctgaggatcgacggagactgcttcatggtgtcttcagaggcagacacctattacagagccaggatgaaatgtcaggtgacagtcacccctagcttcctaggaaccccctagggcctcaagtgagggtcttaatgcagggaccctggagtgagaggtggttccttccacgtctctgacctcaccctattcatcagcataaagcaggggtcgtggactccaaggctcatagaagccaggaggtcacttattgacctgaggggccaaggtcaagaccaacctccatctaagggagttccagccactggttgccttgcaggaatgcaaggtcagggtggccagagctcggggttgttcaagaaaaccagcaacccagacttccactggcaactctcgaaaccacaattaattactggggttggcaatcaacttggatatatttaagacactgtgcaggtgaaacagaacctcctcaggggccagaccttgcctgggcttgtgggctgctggtcgcgcccccgtgcacagggagaagagaagcagacgggagcagaagggacccctgctcttggaagggaggctgtgcgggctgggggtgatgatagcccggccagcacacacacgtggcatcttaggccatgggcaggggtggcaggaaggggcagcctgggctctgggagccttgcctgtgtgacccagggtggggttacagaggaaaggcggggtgctggcccagatcaagagccagaaagtgcaggacatcctcgccttctatctgggccgcctggagaccaccaacgaggtgattgacagtgacttcgagaccaggaacttctggatcggtgagtgcccagctgattgggggtatggcgagtaaggggttgtgatgccccaccctgctgcaggaaccctgggccatggcggctgccagcagatggcaagggtgtgttgagggcctggagcccagagcggggccagctgctcaccccctttcccgggaagggcccaggtagggagcacatgggggctgccagcgctgggaagaggggccagaaaggcagctggcagcagactccagggtctgagtgggccaaccttgactaccccggcccagggctcacctacaagaccgccaaggactccttccgctgggccacaggggagcaccaggccttcaccagttttgcctttgggcagcctgacaaccacgggtaagtgtggggtgcctccctcccctgggcctccttctcacttgggcctgcctggtggagccccccatcccgctgcctggctgggccctttgagggtctgatccttccctggtgcctgcccaggtgccagagagttgtgggcacagctggtgtgggccggtggtggggtgagggagatgcaagccggaaggcacgtcacgtgggggagagagggacccaggaagcctccatccatctgtccatccccagtgtcccctggtgtgactccatccctccaattctcatccactcacccctccgtctgcatgccctctgcctgcatcagttacactgatgccagcattccttagctgtcacccacctgcactcattcacaatacaaccctgcacctgcagacccaccagccatcctgtagcaagaaccctctggtcacgtggccccaccctgctcttcaaagcccagcaatgcccagggccagggtggaggtggtccggctgcgaggccaccaagggctccagcgatttcagccagccctccttgccaacagccggcctgtgcccctggcctcttgcctggaggaagtctgggccttgttgggttcccaggtgtacctctcaagtgggctgtctattccagtccccaccatccccacaggctggtgtggctgagtgctgccatggggtaggcagagctgttaccccaggaaggggcttccctgagaagtggagcagggctgggggcttggggacgggcctggctcccggcagccccgtcggcaggtgggggcactggagcccctgagatgcagggtcctgatgggtggagggcttaggcctctcccggatccctgacttcactcttgcctcctgaccaccacaccatggcctgcaggtttggcaactgcgtggagctgcaggcttcagctgccttcaactggaacaaccagcgctgcaaaacccgaaaccgttacatctgccagtttggtgagggacttcctgaggctccccttctctgatctctgaccctgggggtgctgctgacccggtccagcctgcaagggtatctaggtggcaggttcagagtgggtctgggcacacggggccatagaggatgccctgttgatggccttgtacctgtgggctcctgagcccagaggggcaacgacgggcccagcttcatacagcaaggccacgcaggaaggactagagctacagctctgcaggggatttctccaaggaccctctcctgtcatgaaagctgctgcctgggaacctgttgggttccttggtgttcccgggagccccatgaactgtggtggaggcggaggtgaaacctagcatggcaccagctcccagcagcctctgctaggaaggcctggagcgccacagggaccacggccatgggcacttccagaccgagtgcaacagggctgccatcttgggactgcctgggctgccatcgagccctgctctcttctgcttccttccagcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcagacatcacccacaaggggttatcactgtcccagtttacagcggaagaaatgaaggcagagagattgagtaacttgcataagatcatacagctgggagtcaaacccagtgagtctggctgtcatttatttattttttttcttttcttttcttttttttttttttttttttttttttgagacggagtctcgctctgtcgcccaggctggagtgcagtggcacgatctccgctcactgcaaactccgcctcccaggttcacgccattgtcctgcctcagcctcccgagtagctgggactacagacgcccgccaccacgcccggctaatttgttttttgtatttttagtagagacggggtttcaccgtgttacccaggatggtatcgatctcccgacctcgtgatccacccgcctcggcctcccaaagtgctgggatgacaggcgtgagccaccgctcccggccctatttttttcttttttgagacagagtctcgctttgtcgtacaggctggagtgcaggggtgcaattggggttcactgcagcctcgaactcccaggctcaagcgatcctcctgcctcagccacccaagtagctggaaccacaggtccgcaccaccacgccccgctattttttgtgttttttgtagggacggggttgcaccatgttgctcaggctggtctcgaactcccgtgctcaagcgatccgccatcctgggcctcccaaagtgctggggttacaggcatgcggcccggcgccggcccagtctttccctctcccactgcttcccagggcttcgcctgtctaaccgggcgcgggcagttgtcctgtgtcctggctcagcgcggacctacgcggggtggtcacacagatgcccccagctctctctacctcccgcgaaggcgctgagccccctgatccctgcccgggcactggcgcaaggtcgcctgcgagcgccaggccttcctgcccggtgggagacgggagggcccgctctccggctcggtctggttcccgggtcagccagcagccgcgcctcttcctcccagacccgggacccgccccttggccggggccgcggccgcagcgcccggaggggccgccctgcgcatgcccgcgggaggtgggtgacccgggagcgcgctgcccgaggccggggggcggtggggacagcacaggcggggcggccgaaccgagaccttcccaccccgccccacgcctggttggggacctgacgcgccgtcgtgagtggggcgggtgcaggtgtccctgggggccgggggcagacactggtgcgggacgacctgctcccgagggggtccgcaggccacacccagagaaactggggcgcctccagtcaccgccgcggtccgccccgccggaggctttgaccccctgaatcagcgtcggggcagggatccgcgtggggtggaagaggctgggaaacttgggagtcccgggcctcctctggagccgcccgcccttggctggctggtccttctcttcctcggctcccgccgggctgggccctgggccgccctcactccctcccctctgcagcctcccttgcgtttgtcattcactctgccaggctctccttctgcctccgcatgcccaacgatccggagaaaaacacggaccatgacatcaaaaggccttggccaaggaatcgtgattattgtgatacaagattctgcacctcaaaggggatccctgtagtgagttttggaaaacgtacaaagcctgacttacaatatgcctgttatctgtggcgtttcatctggggaacttacttttccttgatagggtaaactattctcatccagagtatgtccctcagtctgtaaaagtccatggtgccctacatctattaggggagtgaggaagggcagtgggcattggatctgcttctttgaaagcccccacctgtgtttagcttctgttagaggcctttgaaccagagcaactccatcttgagtaggcgctgggtaaaatgaggctgagacctactgggctgtgttcccaggtggtggaggcattctaagtcacaggatgagatgagaggccggcacaagcagtaaagaagccgcggccaaaacccaccaaaaccaagatggtgatgcgaatgacctctggtcgtcctcactgctacactcccaccagcgccaagacagcttacaaatgccatggcaacgccagaatgttaccctatatggtctaaaaaggggaggcatgaataatccaccccttctttagcatataatcaataaataaccataaaaatgagcaaccagcagccctcggggctgctctatggagtagccattgttttatttctttactttttttttttttttgagagggagtcttgctcttgctcaggctggagtgcagtggcgtgatctcggctcactgcaatctccgtctcctgggttcaagcgattctcctgcctcagctttcgagtggctgggactacaggtgcccaccaccatgccggctttttttttttttgtacttttaatagagacggggtttcaccacgatggccagggtggtctcgaactcctgtcctcagatgatctgcctgccttggcctcccaaagtgctgggattatatgcgtgagccaccgcgcccagccctattcctttactttttttttttgaggtggagtctcacacctggcctccaatatgtttattcatattgctgaggcaggggattgcttgagcccaagagtttgaggttgcagtgaaccatgatcataagctgtatttcagcgtgagtgagagattgagaccttgtctcacaaaataaaagttaaaaagcccttatctggaggtgagaaagccaaatacaaaggtcttctcagttggttcccagtcttcccagtccagcagcctcagcatcaccagggagctggttaggcaaattctcggcggccccaacctactgaattggagaccctgaagatggggctatctgaattttaacaaggcctccaggtttgcatgctcaagattgagaaccactggcaaaagcaaacaatttgaatctgaagtcagcccacctgcatttgaatacaggccctgccacttaataactgtgatttagagcaagttagttacttaacagctaggttgaccaattgtccgagtttgcctggcactatcctgatttcagcactgaaagtactacattatcgctgtggctcacgcctataatcccagcttctcaagctgtccctgtggaatcctcaatatcggtacattcatccctatctagcatccccttcctccctcacccatcctgcaccctcagaattcattctcagatcagcttcccagatttttgccaatatcaattaaaaaaattttttagccaaccatgtactgtgagtaagccaatatcaattagcaaaatctttaagtttcttttggtgattcagtatcttccccctggagttttttgatgattcagtaccctcctagatttggcccctggggcctgcggggatgtgacttgtcatttaattctggagaaaatgaggggtagggcttataaggagactccttcggggcagggtcattacagggtgtgttacatagggaaatgctagctgctggctagctctcgctcttgaaaggctcttcctccctcaactgaaatggggaagggggaaccccggccgactgaggtcctgacatctttagcacatggcttcttaggtcacccagggcatccaggttaccagcttgggaaacaggagatgtaggttggaggaagaggctacagcccaccctggaaataactgccatccgtcccacccatatggttaggctttgtgtccccacccagatctcatctcgaattacaatccccacgggttgagggatggaccaggtggaggtacttgcatcctgggggcagtttcccccatgctgtgctcgtgacagtgagtgagttctcacgagatctgatggttttaaagcgtggcagttcctctttctcgtgcttacatcctcgtaactatcctgtggagaaggtgtctgctttcccctacctccatggttgtaagtttcctgaagcctccccagccgtgtggaactgtgagtcaattaaacttctttataagttacccagtctcggtgtttgcttttttgagatggagatttgctcttgttgcccaggttggagtgcaatggcgtgatctcggctctttgcaacctctgcctctcgggttgaagctattctcctgcctcagcctcccaagtagctgggattacaggcgtgaaccaccacacccagctagttttgtatttttagtagagagggggtttcattatgttggtcaggctggtctcgtgctccaagcctcaggtgatccgcccacctcggcctcccaaagtgctgggattacaggcatgagccaccgcacccaaccttggatgtttctttatagcagtgtagaaacagactcagccgtcgctgcaggccatacctcagctacatagaacacctaactgcccgcaagggagttcctgctactaggatcttcagagtgacaaagaggaagctttggctggcaagggtggtggggaggggaggggctaggtacctaaggcttccctatctttccacacagcctaattttcatagcctctggtctccacatttcactctttcccaaataaagaccttttaaggtgtgggtccccttggtcattctgtaaccattggatcaagttttcagttttttctgctctctcagctgcaaaataacacattcgagttttggtttttttttttttggagacaaagtctcactctgtcgcccaggctggagtgcagtggtgtgatctcagctcactgtaacctctgcctcctggatataagcgattctcctgcctcagcctcccaagtacctgggattacaggcacccgccaccacacctggctaatttctgtatttttagtagagacggggttttgccattttggccaggcacactcgggttttctaaccataccttgagccaagaatttggattctgagcttgtcttttcatttaagctatgtggcgctgttagcatgaccgccctgcccagcagatcttgacttcagtgtaatctttattctcttctatggcaggagccattaggtcccccaaagccttgcctttgatgggtactttgttcccggggacaatgggattagctgtcttgccagggcgtgccatggggctgctggtgtcctgtcccttaataccagctggattttcactgtcctctgaccactttccagccttcaattgctcctgtttcctttggggcttcttgctctgtccagtcctggtcctatttttgtgagaatcaaggttcttagttttaaccaacagaaactaattctggcaactctaaacagaaagggacttggtcagaggtcctggctagttcccaggagctcaaaagggtcagaaaatcaaatcaggaagaggacattgggcaaagctggccaggtgaagaccccacagcctctgctggcacagaagctacaattggcaccaccgaagtgggacagaagctgccacctgtgcaagctagatgtagtcgctgccgctgtcaccatcaatttttgagatgatgcttcttcctgcctgccactttaattcaaagcgaaggccaggtgcagtggctcatgcctgtaatgccagcactttgggaggccaaggcaagaggatcgcttgaggacgggagtttgagatcagcctgggcaacagggtgagaccccgtctagccaaaaaatacaaaaaaaaagagctgggcagaaagaaaatggctcatgcctgtaatcccagcacttcaggaggccgaggcgggtggatcacctgaggtcagaagtttgagattagcctggccaacacggtgaaacactgtctctactaaaaatacaaaaaattagtcaggttgggtggcgcacgcctgtaatcccagctactcaggagactgaggtaggagaatcgcttgaacccgggaggtggaggttgtagtgagctgagatctcaccattgcactccccgctgggtgacagagcaagactagtctcaaaaaaaaaaaaggggccacgtcgatggaaggacaagaataaagaaactgaggccgggtatggtggctcacgcctgtaattccagcactttgggagtccgaggtgggcggatcacctgaggtcgggagttcgagaccagcctgaccaacatggagaaaccctgtctctactaaagatacaaaaattagccaggcatggttgcgcatgcctgtaatcccagctattggcgaggctgaggcatgagaatcacttaaacctgggaggcggaggttgtggtgagccgagatcgtgccattgcactctagcctgggcaacaagagcggaactgtggctcaaaaaataaataaataaaaaatagagacattgggccaggcacagtggctcgtgcctgtaatcccagctctttggaagaatgaggtaggaggattgcttgagcccaggagttcgagggtgcagtgatcacgtcattaaactcccacttgggtgacagagtgaggagctgtctccccacccccatcccccaaaaaaagaaggtaactgggcaaagaagttatttttagtagagactggctttcatcatattggccaggctggtcttgaattcctgacctcaggtgatccacccacctcggccccccaaagcgctgggattacaggtgtgagccacggtgcccaacctcctcttctcatttaatcctcaaaatcatctcacaaagcaggtgctattaatacccgcgtcttacagaacggttaacagatgtgtccagggccgcatggagaacaccttgagagagcaatgagatctcgctctcctgcctcatgaccgatacacggtttcaagaagttagatgacatcacagatactcagggcacccagctccaggccttactgccttcgcacaaggccgctctctactagcttcaccccgcatggaatgcaatggtcaatgaggccctggtcagaacatgggactgacaaagccagcacttgtaggctgagtctcagatcacgtggcttgtttgttttgtttgtttgtttttgggagatggagtttcactcgtgttgcccaggctggagtgcaatagcaccgtctcagctcactgcaacctccgcctccttgttcaagtgattctcctgtctcagcctcccgggtagctgggactacaggtgcatgccaccatgcctggctagtttttgtatttttagtagagatggggtttcatcacattggtcgggctggtttcgacctcctgacctcaggtgatccacccaccttggcctcccaaagtgctgggattacaggcgtgagccactgtgcccggctggcttttttttttttttgaggagtcgcactctgaaatccaagctggagtgcaatgatgtgatctcccaccatgctagttgtgtttgttgttgttgttttttctttagtagagatggagtttctccatgttggtgaggctggtcttgaactcctgacctcaggtgatccaccccccacctcggcctcccaaagtgctaggattacaggcgtgagtcaccatgcctggcctcaatttcttgaaagacaaagaaaaaagacagaaagagagaaagaaagaaaaagaaaaaaaagagaaagagaaagagaacaagaaaaagagaaggaaagctccatgggtttaaatgcaagagtcagcttcaaggagggctgggaagtcaggtgacgccacccttgtgcttcccgcagccagatcacctggtggaggtaccgttggttttgggcccctctctcagcacttgctaccagagaggacagctctacaccagagagtgagggtgggaacctgctcactgctgtctgctcagggctgggcatgaggcaggtgctcagtaggggtctggagaataaatgaatgaaccatcacggggccaagcacctggaagcgggctggagatgcttgctctggactcctggctcaggagtggactccccaggtggacttcctcctgcatcaccacagctgagtgcatggagcacaggtagggcagctaatgagcagggtcatcatgaatgacagcagatgacaccaggacaggggaggtcagtagccagatgggaagaaagcagaatgaaacaggtcacccgggtgcagtggctcatgcctgtaatcccagcatttcgggaggccgaggtaggcagatcatgaggtcaggagatcgagaccatcctggctaacacggtgaaaccctgtctctgctaaaaatacaaaaaattagccggacgtggaggcgggtgcctgtagtcccagctactcgggaggctgaggcaggagaatggcgtgaatctgggaggtggagctagcagtgagccgagatcgcaccactacactccagcctgggcgacagagcgagacagtctcaaaaaaaaaaaaaaaaaagttctggcggagagtgtgggtgagcactagggtactggaaagattccatgcctgggaatcgtgcgtggattgattacatccccacttctggcaaaatgcttcatggccttgtgcaagttaactttgtctccctgggcctctgtttactcatctgagaaacggggtaaagacatttgctcttcttaggtcacagggctcctgtacacgatgtgaaaggactttggaaagtatcctccggtgtgcaaatttctctgagaagtgctgtggctgtttatccttagactggaatgagaagggggagatgtgacttttgtgactttcagggtgggccaggtgttgtaggtgacaggacaatctcaggctggtagcagtggctcatgcctgtaatcccagcactttgggaggctgaggtgggtggatcacttgaggtcaggagtttgagaccagcctggataacatggttaaactccatctctactaaaaatacaaaaattagccaggttggggtggtgtgtgcccggagtcccagctactcaggaaggtgaggcaggagaatccttgaacccgggaggcggaggctgcagtgagccaagattgctccgctgcactccagcctcagcaacagagtgaaactccatctcaaaaaaacaaagacaatctcagatgtgcagttcacaccctggggctctccgtgggatcaggctgagggtcgcatttaactgaaatcttcaggagttcagcgtcggggtagatattccctgagaagcagctgagaggtaaagcttcctccgggaagtactcacttgctccttgttgatttcatggggtctcaggtttcaggaggaaagtaaagatgaaaagcccttgctctggcatcttggaggacttctgggtgagagccaggaaggggaaggcgtttggactcattgccctcccaggcctggagtctgattttcctgctctgtctggttttggaggtggaggctgcgaagccgaagcagtgctggtcctgccagctcctcccagctcctcccctgccctctgcttccctggccttgcacagggacaaggagctccaaagagcggctctgtcctgtctcagcctgggagggaagagggaggtggcatagatggttccacaaacagttcagtacgtgccaaaggagggcctgggaagccccaggtcaggagagggtgcctgcccttcccgtgaaggccagggctgagctgcttcctgccagcatccagttttgctcagagcacccagaacgccgtcttggaggaacgggggcaggcgctgccgcagaaccctggagctgtgtctcctgcctccagggctggccgtagctgcaaagaccagctggcaggtggaggactcaggaagactctccctgtgttggccctgcagccccatgtccccttctctgcttcttgggaacaggaggcctgtgtctgcctgtcctgagcatctcaaaaggaaaagctattctagggatgatgagagggaatcagggcctgaggcacttggaggaacatttgctgagctccctgtgcaacagcccattccaaggccaaggttgcaaaggtggcttagatgctgtccctaaatggccatcgaggttccaagcctggcaggaagggctcgagtggtggggccacagcggagacaaggccaagcagcctgattcttgggagtggaggttaatgagcagcgtttgcacttggctttctatagggtcaggctgtagtgcaacatcctgaggtgcgtggctgcccacaggtgctcagccagcccagcctctgccaaggcagacagagcctgggctgggaagcgggggatcccactgcttggggagtccccttttcttctgcatagtggggatgccaggagcagtgaacaagctcagcaaagagttctccagcccgacccgaggtttccttcctcctgactttgtcacctcactgggagaatatacagctctgtctgaaacaagtttcctgcggggcaccctgtgcaggggaagctcgggcagcccaacctaccagatggaagggaaagatagaggctgtgaggttcttctgggcctgtctacagcctcttctacctggctgccctttgttcagagtaaaggatgcagttcccaagacataagcaccgcgggcttcagagtatgaaggatccttccaggtcagccactttgggcaactggtgagcaaggcgggtgtgcagggccggctacatcatttgtggggcctggtacagaatgaaaatgtggggcccttattcagaagttactaagaatttttttttttttagatggaatctcactctgttaccccggcgggagtgcagtggcacgatcttggctcactgcaacctctgcctcccgggttcaagtgattctcctgcctcagcctcccgagtaggtgggattccaggtgcccgccaccacgtctgggtaatttttgtatttttagtagagacagggtttctccacctggctggtctcgaactcctgacctcaggcgatctacctgccttggcctcccaaagtggtaggattacaggcatgtgctaaaaatttcaagatgaggacagcagagcataagtgaagcgcaggacccttgcaagtgggtccgtctgggtgtgactgcatttggggagaaggggatggggtcctgcctgtccctgcagtcacagcataccacgagtcctggggcagaggagcctggattcaggcccttggtgctcagcggtcctggctcacggacacccctcgttcagcagccagggggttcctcactgtgtcccagatgtcactctaaagattgcttcagaggctccctccccgaatcgttggagggactctgccagttccaatgaccagccagctgccttcaggtcacaaaagaatctggggctggtctgagaccaggtgtacccccagaccccatctctgtccagatcatgagagggggtccagggtcccccgcctcccacagttgggcttcactgcacagctggaactcagccaggcctgttccgggaagcagggctgtgagtgtgagcagtccaggaccttggcattttgaacaaagaattgaacaaaacccacaaagtaacatagcaatgaaacatgggaaggaagcagtgaaagcaggaatttatgaaacagataaagcactctgcagggctggagtgggcctaagcaagcggctcaagagcctggttacaaagtttcctaggtgttttgttagtttgtttttgtattttattttttttattattattatttttgagaagtctcttacccaggctggagcgcagtggcatgatcttggctcactgcaatctccgcctcctgagttcaagtgattctctggcctcagcctcccaagtagctgggattacaggtaagtacccaccacgcccggctaattttcatattttttgtagagatggggtttcaccatgttggacaggctggtcttgaactcctgacctcgttaatcggcccacctcggcctcccaaagtgctgggattacaggcacgagccatggcacccagcctcctgggttttaagtactgcttttgaggttctattggctaccccttatctggatgaaggatttggtctgtggctcataaaaggctaatgtgaactggcgccctgtgcagatgaagggatgacccatgcttcgcctgcggctaatccaggacactctcccttcccatctaagatgtggtggagacaggagggtgatagggtgtctctatattaaaaacacacacacacacacacacacacacacacacacacacacacacacacacacacaaaggcagccagactatgcactaggaactgccctgggaatcccgttgcgttctcacaacaatcccacttcacagataaagaaaccaaggcacagaaatattcagtaacgtgtccagatgcggtggctcatgcctgtaattccagtattttgggaggctgaggcaggcagatcacgaggtcaggagttcgagaccatcctggccaacatggtgaaaccccgtctctactaaaaatacaaaaattagctgggtgtggtggcaggtgcctgtaattctagctactcaggaagctgaggcaggagaactgcttgaacccgggaggcggaggttgcagtgagccgagatcacactactgcactccagcctgggtgacagagcaaaactctgtctggaaaaaaaaaaaagaaaaaagaaatactaagtaacttgtctgaggccacttagttaccaagacgtgggagctgggacttgaacccaggcagtctggctggattcatgcctgcagcctctgcactcctgctacttcctgtgtgagaagcgcctgttctgtggaaggttgtgggctgagatctttccatgacttccactcatttacccccaaggctgttcttaaagacgggcatgacagttatgcccattttacagatgggaccctgaggctcacaagggcatgccactcacccatctccacaaagctatagctcgtcagcagagggcagaattcggccgcctctcccctagctcgaaggctgtgattgacacagaggtttttttgttgttgttgctgttgtttgttcctttttcttttttttttgagacagggtcttgctctgtcatcccggctggagtgcagtggtgcgatctcagctcactgcaaactctgcctccaagatgcaaatgattctcgtgcctcagcctcccaagtagctggaattacaggtgtgcactaccatgcccagctgttttttgtagagatggggttagtagagatttgtttaatagagacgaggtttcaccatggtctctactaaaccctgtctctactaaaaatacaaaaattacccaggcgtggtggcacatgcctgtagtcccagctactcaagaggctgaggcaggagaatcactcgaacctgggaggtggaggttgcagtgacccaaaatcatgcactctggcctggggtctcgcttttgcccaggttagagtgcagtggcacaatcatagtggcttactgcagcctcaaactcctgggctgaagggaatcctcccacctcagcctcccaagtagctaggactataggcatgtgccatcatggcgagttaattttttgtgtgtttttattttctcgagacagagtcttgctctgttgctcaggctggactgcaatggcgtgatcttggctcaccgcaacctccacctcctgggttcaagcgattctcctgcctcagcctcccgagtagctgggattacaggtgcgtgccagcatgcctggctaattttgtatttttagtagagacagggtttcgccatgttggtcaggctgctctcgaactcctgacctcatgatccacctgcctcggcctctcaaagtgttgggattacaggcatgagccactgagcctggcctggggagctaatttttaaatttgttatagagacaagagagacaagagtctctcttatgttgcccaggctggtctcgaccccgtggcctcaagtgatcctcccacctcagcctcccaaagtgctgggattacagatgggtgtcaccgcagctggcctctgaggagggtttcattataaacctgccctgaagggagggaatccaattttacgagagggtgtagcctggtgaggcctggatgacctccgcaggcaggggcttgtgcctgggctgaggcctaagggacaatgggcagacatgaagttgccccaggcagagggtacagtgtgggcaaagtcaggaagtggcagggcttggatcactccaggaagagagaggactcacgtgtcacaggagctcgagacccagagagagagtgaggcaggcaggcagggaccaagcttgggcacagccaggaaggcaggacagggcatggtggggccaatggaatcattacccaagacgggcattttcagggaaacagcttagataaggccaggcgtacagtagctcccacctgtaatcccagcatttggggaggctgaggtaggaggactgcttgcgcctgggagttcgagaccagcctaggcaacatagtgagaccccatatccacaaaaaatttaaaaaaggagtttgtgttcctgtagtagcatacttgggaggttgaggtggcagtatcacttgagcccgggagttcaaggctaaagtgagctgattgagccattgcactccagcctgagtgacagagagatacgctgtctcaaaggaaatacaaattaaaaaaccagccgggcatgctggtgtgtgcctgtagtctcagctacttgggacactgaagtgggaggatcgcttgagcccaggagttcaaggctgccgtgagctatgattgtgcctgtgcactccagcctgggcgacagagaaagaccctgtctcttaaaaaaaaaaaaaaaaaaaaaaaatcttagaggatgctgtgcctccctgggggtcttcagtcacccatggtcctggcagcagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcaccaccatgccacccaccccgagtatcccctgggcatcctggcatagccagatgacttccgtgcccgttgcaataaccactgcttccaactctctatagaccaccccttgggtatatctaatgtaagtgatatttattttatttattttttgagtcagagtctcgctctgtcacccaggctagagtgtgctgatgtgatcttggctcactacaacctctgcctcctgggttcaagccattctcatgcctcagcctcccaagtggctgggactacaggcatgcaccatcacgcccagctaatttttgtatttttttcagtagaggtggggtttcaccaagttggccgggctggtctcaaactccccacctcaagtgctctgcccgcctcggcctcccaaagtgctgggattacaggcatgagtcgtggtgtctggccctaatgtgagtgatctttaacaatgaagacttgaaaaagaaaaccctgaagaaacctaattctttgatgtctggacgacaaggaagaagatagatagaagtggcatcagataataaacagtgtaaatgtttatcagaaagaggctggtggttgggaccagtaggaggatcgcttgagtccaggagtgcatctctacaaaaaagttaaaggattttttaacattggccaggcatggtggcacacatctgtgatcccagctacttgggaggctgaggcaggattgcttgaagcccaggaggctgaggctgcagtgagctgtgatcgagccactgcactccagcctgggtgacagagcaaaacccagtctcaaaaaataataataatattttacataaccaaccacttctaaagactaaaaaaaaaccctacaattaaaaacctcaggtccctcaggcaatcataccagatattgaaacaaagcaataacataaggactgcagtatttattttatttttatattatttatttattctttgttagtttgtttttggagtgtgggttttgttttgttttttgatttttttcttttgttccacccacagatttcttcttattgcccaggcttgagtgcaatgacctgttctcagcttactcaacctctgcctcttgggtttcagtcatttttctgcctcggcctcctgagtagctaagggaggagtcttgagattatcatccacggagggtggaagaggagagggtggaaggggaataagaagacactccagtgaagcacttgccttgcgtgcaaaaatgtaagggggcctctccctctccctctccgtctccctctccctctccctctccgtctccctctccctctccctctccctctccctctccctctccctctccctctccctctccctctccgtctccctctccctctccctctccctctccctctccctctcactctccctctcactctccccacggtctccctctcatgcggagccgaagctggactgtactgctgccatctcggctcactgcaacctccgtgcctgattctcctgcctcagcctgccgagtgcctgcgattgcaggcacgcgccgccacacctgactggtcttggtggagacggggtttcgctgtgttggccgggccggtctccagcccctaaccgcgagtgatccgccagccttggcctcccgaggtgccaggattgcagacggagtctcgttcactcagtgctcaatggtgcccagactggagtgcagtggcgtgatcgcggctcgctacaacctacacctcccagccgcctgccttggcctcccacggtgccgagattgcagcctctgcccggccgccaccccgtctgggaagtgaggagcgtctctgcctggccgcccatcgtctgggatgtgaggagcctctctgcctggctgcccagtctggaaagtgaggagcgtctgcgcccggcagccatcccatctaggaagtgaggagcgcctcttcccagccgccatcacatctaggaagtgaggagcgtctctgcccggctgcccatcgtctgagatgtggggagcgcctctgccccgccgccccatctgggatgtgaggagtgcctctgcccggccgagaccccgtctgggaggtgaggagcgtctctgcccagccgccccgtctgagaagtgaggagaccctctgcctggcaaccaccccgtctgagaagtgaggaggccctccgcccggcagctgccccgtctgagaagtgaggagcctctccgcccggcagccaccccatctgggaagtgaggagcgtctctgcccggcagccaccccgtccgggagggaggtgggggtggtcagcccctgcctggccagctgccccatccgggagggaggtcgggggtcagccccccgcccggccagccgccccgtccgggaggtgaggggcacctctgcccggccacccctactgggaagtgaggagcccctcagcctggccagccgccccgtccgggagggaggtgggggggtcagccctccacccggccagctgccccgtctgggaggtgaggggcgcctctgcccggctgcccctactgggaagtgaggagcccctctgcccggccagccgccccgtccgggagggaggtgggggggtcagccctccgcccggccagctgccccgtctgggaggtgaggggcgcctctgcccggctgcccctactgggaagtgaggagcccctttgcccggccagctgcccagtctgggagggaggtgggggggtcagccccctgcccggccagctgccccgtctgggaggtgaggggtgcctctgcccggccgcccctattgggaagtgaggagcccctctgcccggccagccgccccgtccaggagggaggtggggggggtcagccccccccgcccggccagccgccccgtccgggaggtgaggggtgcctctgcccggccgcccctactgggaagtgaggagcccccctgcctggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaagaaaattaaaaaaaaaaaaaaaaaaaaaacaggctacctacaatttgtgttgaagatatgaatgaatgaagtttccacacccttatgtggagttctgataagtaagcaacaataaggaagggtccccaggttggggagaccccaagttgagaacaataatgaacaattattgtatgaacaattgttagagacagctaatcacaaacaacctgcgggcacaatgaccccattccacacgtagcacccttcagcaggaccctataaaactctcctccagcccttgcctctttgcaggtagccccttctgtgctgagctgcccattgcaacatattttcataatttctctaataaatctgcccttctttacctacaactatcttggtaaatggctttaccacctgcaaaactgaccctaggttgttgctacccgatatggtttggctgcatccccacccaaatttcatcttgaattgtagttcccataatccccatgtgtcatgggagggacccggtaggaggtaatcgaatcatgggggcaggtttttcccatactgttctcgtgatagtgaatacatctcactaaatctgatggttttataaagggcagtttccctgcacgtgctctcttgcctgctgccatgtaagacatacctttgctccttctttgccttccaccatgattctgaggcctccccagccttgtggaactgtgagtacattaaacctctttttctttataaattgcccagtttcgagtatttcttcatagcagtatgaaaagtaactaatacactacctgagacaccttaggagatttgtaatagctgtaatgccaggtccaccatatttttagcataaagcaaatgtttacccatgatatgactgcacaggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccgtctctacaaaaaatacaaaaattagctgagtgtagtggcacacacctgtagtcccagcaccttgggagggtgaggcaggaggatctcttgaacccaggaggtggaggccgcagtgagcagtgatcatgtcagaggtgtgtgaaccagagcaactccatcttaaataggagctgggaaaaatgaggctgaaactgctgggctgcattccctgatggttaaggcattctaagtcacaggatgacatagaaggtcagcacaaaataccagtcgtaaagaccttgctgataaaacaggttgcagtgaaggagctggccaaaacccaccaaaaccaaaatagtgacaagagtgacctcccatcatcctccctgctacattcctacaagcaccatgacagtttacaaatgccatggcaacatcaagaagttaccctatatggtctaaaaagaggaggcatgaaaaatccaccccttgtttagcatatcatcaagaaataaccataaaaatgggcaaccagcagccctcacggctgctctgtctatggggtagccattcttttattcctttactttctctttttcttttgagatggagtctccctctgtcacccaggctggagtgcagtggtgcgatctcggctttctacaagcttcgcctctcgggttcatcccattctcctgcctcagcctccagagtagctgggactacaggcgcccgcaaccacacttggctaatttttttgcatttttagtagagacgaggtttcaccatgttaaccaggatggtcttgatctcctgacctcgtgatccacctgtctcggccccccaaagtgctgggattacaggcgtgagccaccccgtgcccctcctcctttactttcttaataaacttgctttcacttcacactgtggcatcaccctgaattctttcttgcacaaaatccaagaaccctctcttggggtctggattgggacccctttcctgtaactatcatgccactgcactccagcctgggcaacagagcaaggccctgtctctcaaaaaaaaaaaaaaaaaaagtaacgtgacttaatacattcattttggagggtaagtctctcaaaataggcctttcactgggggaaaatggtaaaaatactccctggtaattcaagaattggagactcctgagatgctgctcatattagctgaacacttatcaatacttcactttcttccatatatactcaaggaacaagtgctatttaaagtgtttcactctgctgtgctaggtgcaagactataaagaggtgtgaggatcaacacttttatgaaaaccaatgtcattctgaatatagtttcagatgctagtgcaaaggaagctcttggtatacggaaaaagtattcaacaataaattaggcatggttgcttccattttctgcctcacatacctttttttcatggttaaagtgatataaagtctatgatattttagattggcagttgcaaactagtggtcctcagcgtgctttttatgacacctacaaggtttgaagactctgatttcatattaaaaatctgggtttcaggctgggtgtgatgttgcatgcctgtaatcccagcactttggaaggctgaggcaggagaatcgcttgaaccagggaggtggaggttgcagtgagccaagatcacgccactgcactcaagcttaggcaatagagcaagactccatctcaaaaaatgaataaataaataaaatctgggtttcaggccaggtgtggtggtgcactcctgcaatcccagcactttgggaggctgagatgggcagacagcttgagctcaggaattccagactagcctgggcaacgtggcaaaaccccatgtctacaaataatacaaaaaaattagctgggtgtagtggagtgtgcctgtaatcccagcaacgtgggaggctgaagtgagaggactgcttgagcctgggaggttgaggttacagtgagctgagatcaccctcctacactccaacctgggcaacagagccagaccttgtcttaaaaaaaaaaaaaaaaaaaaaaaaattctgggtttctggcatctcaaaaaaaaaaaaaaaaaaaggaaaggtcagggcacatggctgctacagtcctctattaagcaatgtgccacagcaggggtccctgacccctgggccatggacatgtactggtctgtggcctgttaggaactgggccacagagcaggaggtgaatggtgggtaacaattgaagcttcgtctgtatttctggctgctcctcattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagttccctatagactttgcttcctaccgtcttacgttctgccttataggcatctcagtttgcaacccttgtttttgtcagtatgctacgctggtgacattgaccaaattgaccacacattaatgataagcttagttggtgatgacctcaacggaataacgtgacataagtattgtgacaatacttcttgcatgtatctacaggtggaattgtaaacctggtggtccgagatggtctaattcgatcttcctatgtatctccttatattaatagtggtaacatttgtggtggtgattcagcgtttcaatgcctcttctcacggcaacaacaaacgttttccttctgaatcaacattaacctagatgttactgcagatcaaaattagtatctacattttcaaccacagaaatattgggcagtaaaaatttttcttaatattgattgcctacataggttgtgtaattagcatatgtttatagttctatgatttgtgcctggctgctacagagctggagggggtaaagcaacagtgttttctcagttgtgtgagcagcattacattataataaataggtaatattaaactgggctgatgagagttgcaaaagactactttaatgttcatatggaaccaaaaaagagcccgcattgccaagacaatcctaaacccaatgaacaaagctggaggcctcatgctacctgacttcaaactatactacaaggctacagtaaccaaaacagcatggtactggtaccaaaacagacatatagaccaatggaacagaacagagccctcagaaataataccacacatctacaaccatctgatctttgacaaacctgacaaaaactagaaatgtggaaaggattcccgatttaataaatagtgcttggaaaactggctagccctatgtagaaagctgaaactggatcccttccttacaccttatacaaaaattaattcaagatggattaaagacttaaatgttagacctaaagccgtaaaaaccctagaagaaaacctaggcaataccattcaggacatagggatgggcaaggacttcatgtctaaaacaccaaaagcaatggcaacagaagccaaaactgacaaatgggatctaattaaactaaagagcttctgcacagcaaaagaaactaggatcagtgtgaacaggcaacctagagaatgggagaaaatttttgccatctacttatctgacaaaaggctaatatccagaatctacaaagaacaccaacaaatttacaagaaaaaaacaaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaacacttttacactgttggtgggactgtaaactggttcaaccattgtggaagacagtgtggcgattcctcagggatccagaactagaaataccatttgacccagccatcccattactggatatatacccaaaggattataaatcatgctgccataaagacacatgcacacatatgtttatcgcggcactattcacgatagcaaagacttggaaccaacacaaatgtccatcaatgatagactggattaagaaaatgtggcacatatatactatgcagccataaaaaaggatgagttcatgtcctttgtagagacatggatgaagctggaaacgatcactctcagcaaactatcacaaggacaaaaaaccaaacaccgcatgttctcactcacagatgggaattgaacaatgagaacacttggacacaggaaggggaacatcacacactggggcctcttttgtggtgggggagggggaagggatagcagtaggagatacacctaatgtaaatgacgagttaatgggtgcagcacaccaacatggcacatgtgtacatatgtaacaaacctgcacattgtgcacatgcaccctataacttaaagtataatttaaaaaaataagtaaataaataaaaaaagaaacaattgctggctttgcaattctctttcctccaaaatcaccaaggcctcaatttactcattgctgaaaaaggacgactgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccacttcttagtcctttaatacctgtttttctccttctcttattcagaccgtgtgtcttctgtttagtttctcaattcatacaaaaccatatccaggccatcaccaataattctatatgacaaatgctccttctaacaaccccacagtatcagcccttaccccaaaatctttcttcagttgaatctctcccactgtaggttcccatgccgcccctaatcccgctcgaagcagccctgagaaacatcgcccattatctctccatatcacccccaaaaattttcgccaccccaacactttaccactattttgttttatttttcttattaacataagaagacaggaatgtcaggcctctgagtccaagctaagccattaagccatcatatcccagtgacctgcatgtatacatccagaaggcctgaagcaactgaagatccacagaagtgaaaacagcctcaactgaagacattccaccattgtgatttgtttctgccccaccctaactgatcaatgtactttgtaatctgccacactcttaagaaggttctttataatctcccccacccttaagaagtttctttgtaattctcctcacccttgagaatgtactttatgagatccacctcctgcccccaaaacattgctcttaactccaccgcctatcccaaaacctataagaaccaatgataatcacaccaccctttgctgactcctttttcagactcagcccacctgcacccaggtgaaataaacagccatgttgctcacacaaaacatgtttggtggtctcttcacacagacacgtgagacaggagttcgagaccagcctagccaatctggtgaaactctgtctctactaaaaatacaaaaattagccgggcatggtggcgggcacctgtaatcccagctactcgggaagcggaggcacaaaaattgcttgaacccaggaggcagagtttgcagtgagccaagatcacactgtctggcatctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactgttcaatatactttgtaatctcccccacccttaagaaggtactttgtaatctccccaacccttaagaaggtcctttgtaattctccccacccttcagaatgtactttgtgagatctacccctgcccacaaaacatggctcttcaccccctatcccaaaacctgtaagaactaatgataatccaccaccctttgctgactctcttttcggactcagcccgcctgcacccaggtgaaatgaacagccatgttgctcacacaaagcctgtttggtggtctcttcacacggacgtgcatgaaacacacgactgcacttcaggctgggcgacagagctagattccatctcaaaaaaaataaaaaggagtcacctcccctgagaggcctctggaccaacccatctgagcaggccactcttccttctctatcttaccatcttgtttctgtcccagtagttagggctacctccagtaatcctatttgtccctttactgtttagtgcgtctcacttgactagaagctccatgaaagcagagatcctacctacctccttcaccactagacccccagggcctggtatgtggtgatcgctcagggcccattttcttcctttcctcctcctccaagggtggggaaagagcatcagaaggtctaggtggccccaggcccaaacaatcctcctttaaaaggaaaccagattgttacaaaggtcagaggctgaaaagttatttccgccttttatccctctaaattcttcacttcctgaaaaaacaaacaaaaaaaagccactgagggcccttggactaaatccaggcctgagttgctgggcagaggtcagtcttgtccagacatgggaaaaaaataactcgagtcagacaggtgggtcaccagagaacgaatccagcctgcaaatggtgtgtgcaatcttcagctctgtccagacctgcctccctctggggatgcctttaaaggtgatgaatgacctggatgaatgggcttagaagagggaaaaacaaatatcacaggtcaaatcattatttgtcttcaagtttaacaccgtctactggactgaaagatgtccaaagaatagttgttcaactatgtaaattcctttttttttttttttttgagacagagtctcgctctgttgcccaggctggagtgcaatggtatgatcttggctcactgcaagcaacctctgctcctgggctcaaaccattctcctgcctcagcttcccaagtagctgggactacaggcatgtgccaccacgctcagctaattttagtattgttagtagagacagggtttcatcatgttgaccaggctggtctcgaactcctgacctcaggtgatccacctgcctcggcatcccagagtgctgggattacaggcatgagccactgtgcccagccaactacataaattcctaacaacgtatctccagaaagtataggcacaacagcacatgcagtcattcctgtaatcaggtgctccgggaggccaaggcaagaagatcccttgagcccaggagtttgagaccagcctggacaacatagcaagactgtgtctctataaaatatacaaaaattgggctgggtatggtggctcatgcctgtaggcccagcactttgggagaccaaggcaggaagatcgattgaactcaggagcttgggaccagcctggacaacataatgagacccagtctctactaaaactcaagaaaattagccagatgtggttgcatgtgcctgtagtcccagcactttgggaggccaaggtgggtggatcacctgaggtcaggaggttgagaccagcctggccaacatggcgaaaccccatctctactaaaaatacaaaaattagcccggtatggaggcatgtgcctgtaatcccagctacttgggaggctgaggcaggagaatggattgaacccaggaggcagaggttgcagtgagccaagatcgcaccactgcactccagcctgggcaacagaacaagactccatcaaaaaaaaaaaaaaaaagaaagaaagaaagaagaaaagaaaattagccaggtgtggttgcatgcacctgtagtcccagcactttgggaggccaaggcaggaggatcaatcaaggctaggagtttgagactgcagaaggaaaccctgtctctaaaaacaaggtccagctaaaatcagggtccagctccaccacaagcgcagctccagggtctgttgagttttgcctctaccattccaagtagtccctgctccagaccaagtcccaccatctggcagtcaggtcagtccaaccacagtcatatcagggcgcttcccggttctttcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaagcaaagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaggctaaggcaggagaatcgcttgaacctgggaggcagatgttgtggtgagccgagatcacgctaccgcactccagcctgggcaacagagtgagactccatcaaaaaatagtaataataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagaaacccaacaggaaaaggaagagactgctctatggccaggcacggtggctcacacctgtaatcccagcactttgggaggcccaggcgggcggatcacgaggtcaggagatcgagaccatcctggctaagacggtgaaaccctgtctctactaaaaatacaaaaaaattagccgggcgtggtggtggatgcctgtagtcccagctactcgggaggctgaggcaggagaatggcgtgaacccgggagacggagcttgcagtgagccgagattgcgccactgcacttcagcctgggtgacagtgagactccatctcaaagaagaaaaaaaaaagaaccaagaggagtccaggagaagagaacagcagatgcaaaggccctgaggcagaaacaatcttggtatgcgggaggaataggaaggcagccagtgcagctggagcaggataggttaagagaggatcaaggtgatgagggcctggaaagaggggctggggtcaaatcaccagatcctgttggttgcaatggaagagcctggagtttattctcagggcagtgagaagccactggaaagttgttttttgtttttctgtttttgagacagagtctagctctgtcacccaggcagactgcagtggtgcaatcttggctcactgtaacctctgcctcccaggttcaagcgattctcctgcctcaggctccccagtagctgggattacaggcacaggccaccacacccatctaatttttttttttttttttgagacagagtctctgtcacccaggctggagtgcagtggcacaatctcagctcactgcaacctccacctcccaggttcaagcaattctcctgcctcagcctcctgagtagctgggactacaggtgcatgccaccatacctggctaattttttgtgtttttagtagagacaggatttcatcacgttagccaggatggtctcgatttcctgacctcgtgatctgcccaccatggcctcccaaagtgctgggattaacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctacctcagcatcccaaagtgctggattacaggcatgagtcaccatgcctggtcacacttctcattctttaaaccagacctcatttgtccacctcccccatcccccgccccaccccacggactgtcctataatgcccatacaacaggtcactgtttagaaagtgccacaaagttacaaacacagtcccttctgagcctcccaccaatgttggtgggtgcaaggtcaaaaaaaaaatctcatctatctaaggggcataggagactttttagttagagggcccaattatagtcctcctgaaaagatgccaaaagtccccttaaacacttagcaaagattcaagaaagatgaatctcacattctttgtatgggaaatgaggaacttgacatcttcaatataatagattccactaaaataagatgacgatcaataggaaccaactaaaaaaatacttgactagctgttattgaaaggctgaaattcagctgacataagcagtattaatattgagctagaaaataattcgcattgaattcagcccaacttttgttttctgatttgggtctcttctaaattttttttttcttctggacattgggaacaatccaatttgaaggcctcaatgcccaaatctacactcgttttattctatatccttggtttctttttttttttttttgagatggagtctcactctgtcgcccaggctggagtgcagtggcgtgatcttggctcaatgcaagatccgcctcccgggttcatgccattctcctgctgcagcctcctgagtagttgggactacagatgcccgcccccacgcccggctaatttttttgtatttttagtagagacggggtttctccatgttatccaggatggtctcaatctcctgacctcgtgatccacccgcctcagcatctcaaagtgctgggattacaggcattagccaccgtgcctggcccacacctgggtgatttttaaaattcttctagtagagacagggtctcactatgttgggtcaccgtgtttgatgtcagttttccctgacagaatctacaatctccttgatcaccattatatcccaacacagagctcagtacctggtacaaagcacatttgatcaatacttgctgaataaagaaataaaaatgaagaggcattccagcctgggcaacagagtgagatggtctcaaaaaaaaaaaacaaaaaaaaaaaaaacaaaaaatgactggaaaggagatgagggtacttgtgaagccatattatatgacacgctctgtgctaggacttttatataccttgtctcatctcttcatctcatataatccttacaagtatctcaaaagtggggaaatccccatataactgaagaggaaggcagttcagaagttcactgatttgccctaaggttcctcaatttgtaaacatcaggccaatgatccaaccccaggtatgtttggcagtgaaggaccagttgagtcatagctgcaagtaacaaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttatgttcagaacacaaaaataagtcttatgtcttcattaaaaatgggtgaagaatttgaacaaacatttgcaaactaaaatacaaatgaaatacactcaacatcattaatcatcaagaaaataaaattatgagataatcctaataatcactacatatgcaccacagtgattaaaatttttttaagttaagccacgtgacccaataaggtgcattcactcaagagaaacgcaaatatatgtccactcaaagacttgcacatgaatgttgagagcaggtttatactgaatagtgcaatgtgaaaaaaccccaaaatctagcaaagaatgaagggagaaataaactgtggtatatacatacaatagaacactactcaataataaaaaggattgtattcctgatacatgcaatatgggtgaaccttaaaaatatcatgctgagcaagagaagccaaacacaagagaacatgttgttatgatttcacgtacatgaaactttagtaaagacaagtctaatccatagtgacagaaagcaaatgagtaactgctgacagggccaaatgaggagatgatcccaagggaaccttctggggtaagacggtgttctgtatctcaatcgtattggtggtcacacaagtgaagacatgttagaactcatcaaaccatacacttagaatgtgtaatataaacctcaataaagcaaaatttaaaaaaaaaaacacctttaattttctcttacaaaaaaaaaaaggaaaaccacttaactttaatttttctccaacaactgattctggtacatagtataccttactgcctgcatccatggcctcacatcatgctgtttacatgaacgtaaagcttcaccgaagagtggaataagacagtcctgccagagaaaaaccaaaattactcaacgtaaaacaggctgttgatacgtttgcagatatatagcaagtcttaagtcaaagactgcaatatagtttggctacttcagattgattgcagtagttttatctattacactatacccttacatcatttatcttctactcacaagaggcaagcacacagtaagagaaagccttttgttttgaagggaaatcttcttcagaatattaagtctaatttatcaatatacttaataaagcacattacaaaaaaaaagtcacagcacatttactataaagcagactgcagaaaaacattacaactaatgctttataatgaagttctcgaagatcatcattcattcagaagcccccatctctggttgaactttaccccatttaggatgaagaggagagatctttgtttgcagcaaatctaaaatttacgtaatctgcctaaaggaactgtctttacatacaccacctcccactccaaaaatagaagaaaaaactgagcaatttgccatccttgcgattatctcaggttcttccatctgccccatgtacttcccaaatgaaagactgcctgaaaacagcatgttagatttctggatttaccagcttgcccaactacaaatcctatttcaaaaaactcaaaaaataaggtctttgttctacagtaatgaccattaatagtcataagaatgtgcttgtaaaaatatacagacctctgtttaaagtctgttagaaactgtgttctccaaagcaggtgagcaatacagctgcaaggtacttagaactggcaaagactgtgaaactgttaaagtagaaagtctcagaggtccaacagcgatgcgggatgtttgcttcaagtactttaccacatttctgaaacaaaatatttactgtcaattaataaaaattacaattcataaccactcaaagaataaagcaattgataagatgctatcaaactgacatccaaagttagggggcagtaagaggagcagcctgctctataataaaatgatattagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttatctccgtaagagtaacttactcagttatagactgccacttctgatcttgttctatcgggtttaaagcagttgccaaacaaacagaacttcttaacaattgaacttcaatggatttctgaggttcccttggatctggacttaacatgttacgaagcaggtttttcatgtctacagaagttaaatgaaatgtcattaattaatgtgcttttattataaattttgatttatgtttggcattattaaaaactaatcaccaatgaacagctcctttaatatttaaggcagttaaacactataagcattactgagagctatataaaaatcatacttcatacaaaattactgtacctcagacccctaaaaagcagttgccttcaaaggctcaaaaatcagtaagtcgaggccaggcgtggtggctcacgcctgtaatcccagcactttgggaggccaaggtgggtggatcacgaagtcaggagttcaagaccagcctggccaagatgatgaaaccccgtctctactaaaaatacaaaaaattagctgggcacagtggcagacacctgtaatcccagctactcaggaggctgaggcaggagaattgcttgaactcagaggacggaggttgcagtgagccaaaatcccgccactgcactccagcctgggcaacagagtgagactctgtctcaacaaaaaagaaaatcagtaagtcaatctactatttaagggaacaaatctagacctgcattagcaaatcttgctcaatccagaatactcattaaactttttaataacattttataaagtgttccatttgtgataaagaacttaatgagccacatcaagatgaaaatcaagaaaaatatttagctgaaacactactttgtcctttatcaaacaaaatggctagataaatctcaaagcattaaggtggtcatttttttatttgacttaattttaagtgcttttcatttcccaaatcaaacttaaatagggcagccctaaatttgttgcttcacatgggattctgccccccaaaaatgtaaaatgacttccagattttccagtaaaatatactaagccaaacattttgagcaacttgtccactaaaataactttaaaactattttctcaaatacctacctattttttcttttgatcctccagcaagtagattgatattttctcctggtaacaattctaattgctcagtacattcaacaaattttccagactcgaagctgcttaatgatctgtaattaaaatattggttagcttgtattcctacgcagcctgtggaaccattaaaaaaaaacaaacaaacaaaaacagaacaaatcctaggaagacagcaaagtacacagcatttttctgacaaaattccttccacgaggatgtcattattttggtttttatgttgaagatgtgactaccacttaattagtactcaaattggagtggcaaaccagaaagtcacagctacagactttcagtagagctgactcgcccctgtgtctccttcctgttttcatgtgttgcagcctgttctcttcagagcctaacacactgacagtagacctctgcaggacaactttgacacccagttctctccaagctgccagtgagctccttgtgcagcctcactcctcacctacagcatgagcccttgcagctctcccagcatcataatcttgtatctcagtcctggcttctttcactgctggcatccctccatctctccctttttcacctacttttcttttttcaaagaattcttctctttcatctgcttttatgaaaaataatgacacctctgaaattctttcctgtagtcctgcagcatcaatgccaggaagacaggcctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacattcgtcatttctgccattaaaaggtcctaagtcctctccagtgacaggttcctcaagtccccactatgctctataatgccctatgctttcagctaatgactcagtcctcagaaaaacaaacaaataaaaaaacacaggctttaatttcctctacccctacccccaatccaccatacactgccaaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatctccctccagcaatagcttcctatcctcgacttcaagaaaaactcactgaccaaataacttacctcaagcttttcattttcaaatgtctctaccactcaatagtattcaatctagcttcttctgtctctctacaaaactctttttccttataatccctagagcatctgacaaggctgactactcccatctggatgtcctatatctaggacacttcccttctcaatgtccctgtatttttttgaatggcttcctcttctatactttcacaaaaatgctaaactaggattctgacccaggccttccttcctcttcactcactattctccagaggcttctctctggtttggttgcttacaaaggctctagagtatagagactgaaaaggaaacagggccttttctgtgtactaatgatgtgcaaatctctcaagcttagactttctccttagttcaaaatccaattttttttttttaattgatcattcttgggtgtttctcgcagagggggatttggcagggtcataggacaatagtggagggaaggtcagcagataaacaagtgaacaaaggtctctggttttcctaggcagagtgtgtgtgtccctgggtacttgagattagggaatggtgatgactcttaacgagcatgctgccttcaagcatctgtttaacaaagcacatcttgcaccgcccttaatccatttaaccctgagtggacacagcacatgtttcagagagcacagggttggggataaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcctggacggggcggctggccgggcggggggctgacccccctacctccctcccagacagggcggctggccaggcagaggggctcctcacctcccagacggggcggcggggcagaggcgctcccatctcagacgatgggcggccgggcagagacgctcctcacttcctagatgggatggcggccgggcagagacactcctcactttccagactgggcagccaggcagaggggctcctcacatcccagacgatgggcggccaggcagagacgctcctcacttcccagacggggtagcggccgggcagaggctgcaatctcggcactttggggggccaagacaggcggctgggaagtggaggttgtagccgagatcacgccactgcactccagcctgggcaccattgagcactgagttaacaagactccgtctgcaatcccggcacctcgggaggccgaggctggcggatcactcacggttaggagctggagaccagcccggccaacacagcgaaaccccgtctccaccaaaaaagtacgaaaacccatcaggtgtggcggcgcacgcctgcaatcgcaggcactcggcaggctgaggcaggagaatcaggcagggaggttgcagtgagccgagatggcagcagcacagtccagcttcggcttggcatgagagggagaccgtggaaagagagggagagggagaccgtggaaaccgtggaaagagagggagagggagaccgtggaaagagagggagagggagaggagggagagggagagggagaggagggagagggagagggagagggagaggagggagagggagagggagagccaaaatccaattcttaacagcttacccaacaatctcatctgcacatttcattagaaatcttaaaacatagcttgttctctgtgtgctcctactccagttaatagcattgtttctcttccctctaccattgcccccacaaattaatggtctccatgcttccatacttgcccctcacctccagtctcttcaccatagcagaatgaaccaccaagtcagatcacaacacatctctgttcaaatcccacctgaaattttcagtcttactagaataacagccaaagttcttttctcagttcccagctacttctctgcccttatatcctactgtttaaggtgctcctaaacacacaggcctcccagctatttccagaacactccaagcccatcattctcacatcaggtctaggcccaaagggcatcctgatgggcatgccttgaccttgtgtcttccctccaaagaaggtcagctttacctaactgctttccttatggcacagaaaaggtgagtgaggtccaattaatccttctatcaataatctttatctaatctttgctttaaaaggttggaatttgtgtctgttttatgtgctgcctgggtcatagtatatgctcagtgaagcaattacacattaacccatttagcagtagaaagcaagggtatcagacaaagtctaatgacctttatcttcccagccaagtgtctgcaacagagtgagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaatcagtacaaatttttccttatattcactctggcataatcttcaaactctattaaggttttagaatgacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcatagttattggaaatttgttttataactggaaacagaaagccttactttatatagttgaattcagctttcaggttgagggaagtgctactggtactctttttcaagtcatggatagcattctgccattcctgcacagcagcgcaatcggcaattgagatgtagcactcacacatgctttatttcctaaataatttataacctcaggggaagagtcagtcggtttggacagcacagtttttctggattcacctgaaagtattttataaaataagaagagattcagatcaattagaaatatttcaaagagcacagaaacctaaaaacatgataagatcatcagtacaaaatatatcactataacttttgctttatttaaaaatactgaacgctcaccattcagacaatgtttcgggctggcactgttacacccagcattggctaaggtgagcaccaatttgtcaaagctggagatgcagcaatcaacacctgtcatggcacacaggtgctcctggtactccacagaggccttttcaaacctgaaaagcaaattgaagcagtcttatttctttatttatctacttacttactttcttttttgagatgaagttttgctcttcttgcccaggctggaatgcaatggcactgtctcagctcaatgcaacctctgcctcctgggtacaagtgattctcctgcctcagcctcctgagtagctgggattacaggcactcgccaccatgcccggctaattttcttgtatttttagtagagacggggtttcaccatgttggccaggctggtcttgaactcctgacctcaggtgatccgcctgcctcggcctcccgaagtgctgggattacaggcatgagccaccgcgcctggcctttacttacttacttacttattttttgagacagtcttactgtcacccaggctggagggcagtggcatgatcatggctcgctgcagccttgccctaccaggctcatgcaatcctccaacctcagcctcccaagtagctgggactataggcacccaccaacacacctggctaaaacaaggttttgctctgttggccagggtggtctcaaactcctggactcaagcgatccgctcacctcagtctccccaagtactgggatttcaggcatgagccaccgcgcccagccccaaaggaggctgttattttaaacacacatatctcatttcccccccccacaaaaaatggtgcaagaataaactgagctaaaacagtgagttgactatggtggggggaggtttgatgtcttcctcacaactgtgaaactaaatttaaaagtggttaaatgtttttaaaaaaatgtaagagtataaaagaactagtggaaaatattgataagtaactgatgtcagtgtgtggaaaggctttgtagaaggataaaatgcaagaaaagatgcacaagtaacagatctagatgcataatgctgaaatacaacactaaacattaaaaacaaattataaatcaagaaattggatagcatcaacaatcttagtatttaataaaatttcacagattaacacaggaaaaattgagaggccatgaagacatgatccatgttttaaaaaatcacaaaaggtcactatatggggcaacttctactattagtcattaataaatatagaaatgtaaagtacaataactattttcgctgatggtggtggcagcattcttgtttctcagtgactctcagtatccacaaagatgaagggaagggggtactctattattaagggtatacattgcagccatcttttctgtagagtaacttaccaatagaatatattataagacttatggtttggcagcctttcttctagtaaatcagtttatgagaatggattccaagaaagtaatcagaaatataagcaaagatattaagtgctatggtacatttagtaaaaaaaaaaatcagaaacaaccttaatgcccaacagtaagaaatattaaattatggtacactcataaatacaaacctttattaaaaataacactgtagaatatttaacatggcaatttttttttttttgagacagagttttgcttttgttgcccaggctagagggcagtggcacaacccgggctcacagcaacctccgcctcccaggttcaactgattctcctgcctcagcctcccaagtagctgggattacaggcatgtgccaccacaccccactaatatgttttgtatttttagtagagacggggtttcaccatgttaggctagtctcaaactcctgacctcaggtgatccacctgcctcggcctcccaaagtgctgggaatacagatgtaagccaccgaacccagcctacctaacacggaaaattttttttttttaaatattgagtgggaaaaacagatcataaaaccatgtgcctatgtacactgatgttttggtgaagaatggagaaaacgacatgaaagaaaaaagaattacaaagcatatggatatggaaatatgggactacaaaaggacacacaacagaagttactacaaagatatggaagtatgagcagttcttttatcttcctaaatttgcaagatttcattaaactaacataaatggacacagaatattatggtacaagctcctctacctggaggaagcaatgagtctgaatgtagagttcacaggactaatgagcaaatactctgacaataaagggtaatttgtatcagactctgagggggaaggagctcaactagggatcaagttcaaaagcgtttataaaacaactgacaggtcttgttttacagtgtgatttgccactaattcttaaataagaaaggcactccagtattgcggctaactaaagaacaaactgaagatgcctcctggtgaagtgatttatagcaagcttcaatgctgaaagcaaacaaagctgttttaagatttggctacaatgtcagtgagtaatacaaagaatttaaacataaagtaattctgtcacccatttccttccctccaacctacctcccttcagcctgttgagccactgagttaatccacagaagattttttccaacaatagatgatgaccagacagcaattccctgtatagcttcaggacaatgaagttcacatagtgcttctaccaccatcataatggttatttccaattcattcccctgaaaacgcattcagaaaagttagtcacccaataccattaaaacataaatccctataaaatttacaactgatcacagtctgtgcctgcttaaagccaaatgtatttaacaattattttcacaattttcacattatttagctcagaattctttaaaattttacatataaaatagccacaaagggtgactaacagaaccttagcagcacatggatgtttgtacccccaccccaaagttacccaaaaacatttaacctgtgacctctgtaggaataacacatggagtaaaaagaaagcaaaaattaaatataaataaacaggaattaaggaatgattaacttcatgtgtttgaatactgcttgacattacctgaattgctaaacattttgttatttttggattccagttatttattgtgagcccacttgcaagccaggaattactcaagcatttgtcatacgttataaaaacaatttctcctggccaggtgcagtggctcatgcctgtaatcccagcactttggaaggccgaggtgggcggatcacttgtggccaggagttcgagaccagcctggccaacatggtgaaaccctgtctctactaaaaatacaaaacttagccgggtatggtggtgggtgcctgtaatcccagggactgaggcaagaagaggcttgaacccgagaggcggagcttacagtgagccgagatcgcacaactgcactccagcctgggcgacagagtgaaactgtgtctcaaaaaaataaataaataaataaataatttcccccataaacaaattttcagaattacctttaaagttctaaactttgcacgtaagaaatatagttttaacgtgttctaacatgaatattgttttaacatgaacaaaaacatgaacattattttaacttctaacactgttttaacatgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggcaactggtatagaaaaaagctctaatgacctttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcccggaaaccaaccttgggaggtgaagttaatgcattagcacatccctcatatacattatacattaatttctccagattttccagatactgcagaagaagaacaagtctaagttggttgttaccatggccttcatcattgtctgcagttgtccactgactaacatcctgatcagggtttaatgtgtgagctgcgagacttcgaatgatacctgaaagcaaagacaacattctgaatttttaaaaatcttaaagttcctagaataagtgtgagttttttatgacaaattcacatttatcaagtatcctctgtctacccatcatttaaaaataaaaaatcccaacatgaaagatctttcattttaggggaaaaaatatatatatattttccacacaactcccataagttttggaaaaaaaccaaacatatttccaatgcaattattcaatgaaagcttattctaacaaacatacctgaaaattattgactttttttcaaaaaaaatcatatactctcaaatctttaacaaagatttaaaaatccattatttcttaataaggctttgaaagtattcacatcacaaagcttgagcgagttaccttcaattgtctggaaggtgtcttgagctctgcccagtggggttctcagcttagaaagaacagtgaattgtgcagcttcccatatggcccactgccaaaagatagcatctgtcttcaggagattgcgtggaattgttgactggtcacacttatccagtctctggcagctatagaacagtctttccaaccaattgtccttcctgggaaaagtagtttcatatttaaaagacaatgacaacttcattttaataatgaaaaaaaaaatgcaaggggaatgggaatacggaactgtaattttccctactccaaaaaaaggcaaaacctatgaaattgagaagcattatgtccccccctctcattttgaggtcttttatagttaacaggatgaggtacagtgtggaaggatgattagggtaaatggctcatgccagtcaggaatgaaactcattcaatgcaactaagcatctctagaatatctccacccccaccccactccccaaagtgttaatgacatcacatcagttaattgttaaccacatttcattactcaatttcaaagcccatttttgtttctacagatgctatcttcaaagcaattttcctattgatgaaaactgaaataacccatatgagaagaatgttacttgatactctgccacccccaaacatattttctcttcaaaactgcatgtaaagtcaagggaatcttaaaattatctttcccagataaaatagtcaaagaaatgccttaccctgttctatgagagttcccatacaaaataaaactaataacatcagagaaatcttgggggtggaatgtattacttggtgctttactcatgtgacttcttaatgctaaagaaatttcttgaatttctgtgtgattgttattgctgtagacagaaaataaagttgttgttatgcaaaatattttagcttaaaaggttagcacctactgtaagtggattatttacttattaactcactggaggtaaaaatatagtaaaatagagactttaaaatggatacagagatgtgattacaactttagatcctttttttattcacctcagatgggtaatgtgccgacatcataagaggatttgagggaggcatatcaaacatgtgaacataaaaacccaatcattatgcttatgtattacaaaaggatcaagtttaggctcttaaaagctcccaaatcaacttgatcaaaaacaatgaaagattactgtttagtttttcaaatatctgagctactaagaaacatattttggcactacatgagttattctatactaattattgtgagcctataaagctcattaaaaatttttaattttcttgcagaactgcaaaatttgattatttgacatcacttcaatcactggcaagcagggccataaaagatgtgtcattaatgctctaataggtgatctgtcttctcctaaagtagacaaccagtagaggctgtaaatataacagaatgtctttgctccaaaacaactgttataccttaggacaacatctaaaggaattgatttcaacagttttccaaatgcttgtcgaatacgagttccacggtgcactagttgaacacggcaaacatcaacacatctatgaaagaacgaaatagacaaagcaggtgtgttaacatttccaggttattagggttaatgtcaaaagacatgatcttaatttcatacctctgtaaaagatcatctggcaaggaagaggacagagcgtgtagactgctgcatgcctgcagacagatattcacatcttcaacgagagctattaaacattaaaagacagttactttcagctggccaaaagaaattatatcccagtttgtcataattatctgaatccattcattcattcaacaaagagtgagtgcctactacagactaggcactgttcttgtccagaatccttattgactgtcacatttggaaaaatgacacattcaacaaaacccatgtaatgtaactgatgggtcatcacacaaacctttttctgagagaaaatgtaaaagtatatgcaaaatataaacattcacataagcttaaaaatgtgacaatcacttcaaaacatttttctaatactaagaatgaaaaaaatcaagactgtgtatctgtcattaaaatgaggattacacatcttcaggtcaggaaaagagctcgattgatgaccatctcccattaccaaagacccttttaaggactgataaacaaaatagaaaaaaaaaaaacagagtcttactgttggctaaaaggcctttgcaaaatttatggaaagacggaagacagaataaaggtgcatatgtttcggacttcttcattaaaacagctacttccaaagcccaagtcattaacagtttcctgaaacacaaaatatacagttgactgtacacaaaaaaaacaacaacaaaaacaaaaaaacgttaaaagcctagtcttcttacattggttttctcttggtttttcaaacatctcaaacaataaaaaataaaaataaaaaatgaaactatagaaattactgtcaaaattgttgtgtgccttttaagaaaacctcccaacgcagcataatagcaaagaggccgggcatggtggcttacctgaggtcaggagttcaagaccagcctggccaacaacatggtgaaacaccatctctactaaaaatacaaaaattagctgggtgtggtggcggtcacctgtaatcacggctacttgggaggctgaggcaggagaattgcttgaacctgggaggcagaggttgcagtgagcaaaactccgtctcaaaaaaaaaaaaagcatagaatattaaaaatctatatatattcttctatgaaacactgggggtgagggattgaggtttttcatgtatttcttttcagaaagaataagaaagcctagattaaataataaaaccaaattataaggtgtttgacaataaagaagctgctctacctcacctctataatccacatttttttaaatgttttgtaatccacatttcttattctcaaattataaaggcaaattaacaaagttaggaatagttaatactatataatatctgttacctcgtgtcctggttaaggttatctttcttaagtaatattcccagaagatttaacataattgagaaatgtttctttgtggccgtagttacagtgctaatcacagctccatcaaacaaaggaggagaggaagaactgaggctactagagataaagtgatcatgcctgaaagacaaagcatagattatcttttcatctttaatcaaagaaagcaagcaagcccaaagttaaatcaacatacatctttaaaatctatccattaaaaaaataaaatgttttgtggggttcttttgttaagaaaaatttgtgaatacagtacctggtacaatgagaatacaaagtgtagagcacagcatactgaatggtagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggacatttttaaattaaaattacagactggaagggatctagtacactacacctgggacaaatactcttttgtgaagtcagtaaagcctttgcgtgcaatatagcatctctatgcaatgcagcaactcctcgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccgcatctctactaaaattacaaaaattagctgggcatggtggcgcacacttgtaatcccagctactcaggaggctgaggcaggagaattgcttgaacttgggaggcagaggttgcagtgacccgatatcataccaatgcactccagcctagatgacaaagttaagactctctctctcaaaacaaaacaaaacaccagccacatacaaaacacaggaatgagagtacctgtgttccaagaaaactttcttgagtcggagtctctcgctctgttgcccaggctggagtgcaatggggtgatctcagctcactgcaacctctacctctggggttcaagcaattctccctgcctcagtctcccaagtagctgggattacaggtgcccatcaccacgccctgctaacttttgtatttttttagtagagatagggtttcaccatgtgggccaggctggtcttgaactcctgagctcgggtgatctgcctgtctcagtctcctgagggattacaggcgtgaaccactgcgcccagcccgagaactttctttacaaaaacaggcactagtgttgtgatggttgtacacttctgtgaatatactaaaaatcagtgaattatacacttaaaataacaaacaaaaaacaggtgctgggctgtatttggcccacggaccatagtttgctgatctctgatctaaacagagccctttgtatgtgccttttgtggaagtagactgtatttcctcaattttccatatactgcaaatggcaaggtgccctgttcaataaggaaacaaaggcacaccctgccactctacaccttttccatccatctttttcctttacactgccaagacactccattccacctgactgccccatccccacccactttctccttatttctagagtacaggacataaacatctttgaatctgtaaataatgtgaataattttcctcaaaaatcaagctttcatgtttgaagaagagtttattgtgacttcaaacataagctgtaactggtaataagcgaagcagctatggaattatacaaggcaatccaatcaaacaacacggagcacattgaagcgcaaacatcaaattttaccttcttcctcctaaaaactttattccctaattacatccattactttctttctttgtttctttctttttttttttttttcttttgagacagagtctggttctgtagcccaggctggagtgcggtggtgtgatctcagctcactgcaacctccacttcctgggttcaagcaattctcctacctcagcctccaaagtagctaggattacagctgtgcaccaccacccctggctaatttttctatttttagtagaggtgagctttcaccatgttggccaggttggtctcaaactcctgaccacaagtgatcagcccgacttggccttccagagtgctgggtttacaggtgtcagcaaccatgcccagcctacacctattattttctattaaaaataatgtttttcaactctgtgtggtccaataggaagaagaaatacacaaaccataaacaataaatacaaatcaagagcagggccacgtcaaattacttaaaaaaaaaacacacacaggctgggcgcggtggctcatgcctgtaattccagcactttgggaggctgaagcgggtggatcacctgaggtcaggagtttgagaccagcctggccaacatggtgaaatcaagtctctactaaaaatacaaaaattagcccgtcatagtggcaggtgtctgtatctcagctactcgggaggctgaggcaggagaattgctggaacccgggaggcagaggtggcagtgagccgagattgcaccactgcactccagcccaggtgacaacagcatgactctgtctccaaaaaaaaaaaaaaaaattcccccccccccaaaagaaagactaaaggttgagtatcccttattcaaaatgcttgggaccagaagtctttcagactttgtatatgtttggatttgagaatacctgcatatatataaaatgagatatgtgggggatgggacccaagtctaaacacgaaattcacttatgtttcatagacaccttctattcatagcctgaagatcattttatgcaatattttaaataattttgtgcatacaacagtttggactcatcacatgaggtcgggtttggggttttccacttggggcatcatactggtgctcaaaaagtttcaaattttggagcattttagatttaggattttcagattagggatgctcaccagtaagtgttatgaaaatattccaaaatccggctgggcatggtggtgctcacctgtaatcccagcatttttggaggccaaggcaggtggatcacctgaggtcaggagttcacaaccagcctggctaacatggtgaaaacccatctctattaaatacaaaaaaattagccaggcgtggtggcgcatgcctgtaatccgagctacttgggaggctgaaacaggagaatcgcttgtacctgggaggcggaggttgcagcgagccaagatcgcaccattgcacttcagcctgggcaacaagagtaaaacactatctccaaaaaaaaaaaagtattccaaaatccaaaatcaaaaacacttccagtcccaagtatttcagataaggaatattcaacctgtatgaatgtttctagggaaaaagagacagccaaaatataagaccatgtataagaactaacttcagtagacagaaagaaaaaagtaccaggggaagaagaaagagaccgcattttaaaacaactatacaaatttgagctgtaagaaacactgacattttctataagcatgctagagcaaacaggagaaattcataagacattttctagaaaataaaactaatataaaaaaacttatcaagatttgtcaaggaaaaagaagaaaagttaaatataatggcaagaaaacattcctaccaattttatttatccaggcatgtcttaaatatggctgtttgttacatggagaaaccttaaatgcatactggtaagtgaaagaagccaattgaaaaggctacatactatatgactccaactacatggcattctggaaaaagcaaaatgatggagacagtaaaaagatcaggggttgccatgggcttaagatggagggagggaggagtggggagagggaatgaggaaggagtgggtagaacataaaagatttttagggaagtgaaactatcctgtatgatactggtaataggggatacatgtcattacacatgttaaagtccatagaatacataacacaaagtaaactatgaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacttattttacagttatcatgggcattttttcacattagcaaagagaggtgtaattctggcagaaatgctcagcagaatgtcatctagaatttgctttaaaataagccagttagagatgaaaggatagcaaagaggcctagatgaaaccagatgggccgtttgcttctaattatagaagctgagtgttaaatatgtacaaatttattatactatgctccctatttttatgtgcttcagaatgtccataataaaagtggggggaggatatttatggttaagaaattaaaggaggccagccgggcacggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcgaaagagtgagactccgtctcaaaaaaaaaaaaaaaaaaaaagaaattaaaggagaccaggcatgactgctcacacctgtaatcccagcactttgggagggcaaggcaggaggattacttgagaccaagaattcaagtccagcctagacaatgcagtgagaccccttctctccaaaaaatacaaaggttagccaggcatggtggcatgcatctgtagtcccagatagtcgggaggctgagtgggaggatcacttgagcccaggagtttgaggctgcagtgagctctgattgtaccgctgcactccagccaggggaatatagcaagatcctgtgaccaaaaaaaaaaaaaaaagaaaagaaagaaaagaaaagcaaaaaacaaagaatctggtgcgtagagcaatgtttcctcagaaaaaacgagtaaagctacactgagactagctatcaaccactaaaaatagaggcctggcagagtggctcatgcctataatcccagtactttgggaggccaaggcaggtggatttcttgagcccaagaattcaagaccagcctgggcaacatggcaaaactccatctctacaaaataatataaaaaattagccaggtgtggtggtgcacgcctgtagtcctagctacctggggggctgaggtgggaggatcacctgaacccaagaggtcaaggctacagtgagccaaaatcatgccactgcacttcatcttgtgcaacagagtgagaccctgtctcaaaaaaaaattgcattaaaaataaaagtaaatagacactaaaatgaaggcatagattataagactgatgaatgtactctaaaaaaataatataataaagcaaagcccttatgttttttcttttttggagacagggccttttttgtcaccttggctgagtgcagtggcacaatcagagctcacttcaacctcaagttcctgggcttaatcgatcctcctccctcagcctcccgagtagctaggactgcaggtgcacaccactacaccaagctaatttttgactttttgtacagatggggtctcactacattgcccaagctgtgccagaattcctggatgccagcaatccttctgctttggcctcccaaagtgctgggattacaagcataagccaccatacccagacaaagcccttaatttcttacatatcgatttaagggcctgaataaaccaacacattaaaaaggaaaagaataattcacataccagcatgagtaaattcaagactgagatgatataatcggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaatctgtaaatggggaaaacaagcagctttttaaaaaaattcacgtgcttccacaaagcaaggaaatactttttatttaatgcaatttcaactgaaaattaactgcttgccttgccagcagtctcttaatattctagttctcagtagctgaataatgatacctttactacaatatgtaaacatgatcttggctaaaaaatcctaaagtgctactatgacaggaaatggaatctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaactttctatctactgatggtctcttttgaaagataagcactctcatgcttaccacatagtatcttcaaaaatcatatgatttccaatacacacacaaacaaaatcccccacttaactataatggccaataattgtgtactaaatttctaataaaataggggagaaaacagagcaaatgttaaaaaatacttctataatatttaacaaccaatacatacaggattttatttagtctacccataattttcattaaaagtatccttggaggttgggcatagtgactcacatctatcatcctagcactttgagaggattagctggaaggttctcttgagtccaggagtttaagaccagccatgtcaacataacaacacctcatctctaccaaatttgtttttaaattggttgggcgtggtggctcacaccagtagtcccaccaactacttgagaggctgaggtgggaggatcacttaagcctgggaagtcaaggctgcagtgagccaagatcgtgccactgcactccagcctgggcaacagagaccagtggctcatgtctataatcccaacactttgggaggctgaggtgggaagactgcttgaggccaaaagttcaagaccagcctgggaaacactgagacgccatctctacaaaaataaaaaattagcaggagctatggtgggaggatcacttgagcccaagagatagaggctgcactgagtcgtgatggcaccaccccactttaaaaagaaaaaaaaaagagctgggtatggtgacacccgcttgtagggctgagtgaggtgggaagttcacctgggcccaagagttcaagactacagtgagctatgattgcactactacactccagcctgggtgagagagtgaggctccagctccaaaaataaataaaaataaaataaaaaaataaaaaccccaccattctaccattctcaaaggcctaaaagatcctcataaatcaatatacacctatcctataaattatgtcccttttattttatgtctgaattaacagctttttatttcaactctgtacagtcttcaaacaaccaccttttagacattaaaaatgaagcaaagatattaaaccattttgaaaccatattggtttaaaataccgatatgctggtttcatttatctttaagttctgacatttctgctcaagtacacaacttactatataatcaatatcctattttatttagcaacatgttcagcaaaagtatatgctcctaaaagcaagttttatcctaacggtaaaattttcatcagttagattaaattttttatgactgtatcacacatgcttctttctccttattcacagccgagtacaatgcctggggttcatttcttgtgtcttttccactgaaccctcattggatgtgctatatacagtgcagctaatgtttgaggctgctgaagtgtggcaatctatctacctcatttttaatttgtttatgttctttgatatcaggctatcaaagaatataaagatatacaagttttcatatgagttccatcttatgctcagagaagattactttctgaggcttctcctatagtgtgctattcgtaatatgttgaaaaactaaaaggaaacccaataatttaaaagtaaaattataagaaatattatttaaaaatgaaagaataagatttaaaaattcagagtggccttttgtcatgggagggtagggaagttggatgaaaggaggatgagatataaaaggattccctgcttttctggttatttaagaaagcagtcagacaatatatacatatacacatacatacatacatgctaaacaaatgaaggattaataacagttcacctggtaaagagaagcatttacaatgtaaaacaattttatttttgaatgacacttcaaatgcccaaaagcacttacatctgttacgtatgcctcagtaatcggaggacccgaattgggctgaagcgttccccaatgctcctcaccacagtactaaatacccggagaagcgcagtcagctttggtaatgacactgatggaggagggacgtcttcatccactgattccccagaggccacatggctgaggtcctagatgtgaattcacagcattcttaataagtagtacattgtttaaaaaaaaaaaaactctaaaatatttcaatcaattcattttagaatagatttttaggcttttagaaagagaactgtggcccatgagaatattcatgactctgaatataaaaatgggttttacctaattatttcaaaaagccaacattaaacccaatagacaacaaattaaggaaataatctcttaaatcaactcagaaagctgttggggaaaaataaattctagcacatatgctctagttatatgtaggtataaatgaagacggaagcttttgccactcctgaattagtttttggctaaaaatctcattctaggtattctttgagccactcagctcaacagtaagtcctccaaaccaagagcatgcacatgaagagcaaagggagattacaagacctggtctacagatgtgtaactgaagaagtacgatatatgaaaaggacaagattcgcaaaaactaggatactagaaccaatctatacatttacctaaaattaagcaccaaaataacagaagagaatgagatcttaaggataacaaggggaagcatctctacaaactagaatgtgtggcttatgagaggtagatcagctttaaacgtgggctgtgaaaaaagacattctaggtgtgggggcaaagaaaaaacaacacagaagcaaaacatttccttgcttttctaggaaagagtaaacacatcagtacagctaaaggtactgaattcctgttgactacaagcagcaaagatgataaaaacaagatgaggccaaaatctttatgggagccttgattggttgatctgaataggggagaaacacaaagagattcagataagagatagcacagagttaagccatgacagtggggccagaaaagccaagtaccagtaacagaggcttcagcagtgctcttaaagctcctatgctatattcgtacagccacaaaagctggctgaagccaaggcctgtcctccaaagtacgattcagatctcccgtacatatgtaagaggaaaatctttaggagcttttggtgttttgtgtttttttataacacaacatcaatttgctttaagactctgaagactgggaacaaaaaataaaaataaataacaaaaaatgtctttagaaaaataccagctaccaagagtatgtaaagctttgcgaaatacgaagcttgcaacgtttcttttagtctctccagtaattctcctggtaacttaaatacatctgaaataaatgtttaaaatactgactgagcacgggggctcatgcctataatcccagcatttgggaggccgacgcgggtggatcaccagtggtcaggagtttgagaccagcctggccaacatggtgaaaccccgtctctactaaaaatacaaaaattagctgggcatagtggcgggcacctgtaattccagctactcaggaggctgaggcaggagaatcatttgaacccaggaggtggaggttgcagtgagctgagatcgtgccattgcactccagcctgagtgacagagtgagactccgtctcaaaaaaaaatttttttttcaaaatattgcaatgggcttgtaatttctgcttaaatgtcaggaggtctgagccattttaaaataaatctagcacaatttaagattttttcttaaccaaaattttaagaaacagctttctatatactcacctcagcatatgcttccatgtcttctagaaaatgaccaagaagagtcgtagaaaatgcaagatcagctacccaaaatggctccaaactctgcaaccacccttggaatcgtataagaaattgtgaaagggtggggggagaaaaaacaccaaaaaatccaaattaaaaaaatataagaggcttgttttaaaaagtatccggttttcaagcagcataccctaaaacatgtcctatatcataaaattaagactgctaaacatgctgatcacgattaaccaatacctctttaattaatacctctttaatttctgcaaaaattaacatgtaaatgttatttccttactttttcagtaaatttcctatctatattgtcactacacatgacttaacactaaaatgccacaatctaccattggcctggctaatcccagggccacatctaaccattaaaggtgtatacttatctcctcagtgaaaatgaaacagaccactatcacctgaatatcctattttcaaaagtttattacaccaagtaagttacgagaaactatgacacttgaaacaagctgaaatgtgcaaatgagccatgctagtcattcacttaactccaaaaaaatgggaaacaaaaccatttctcatttatgacaattctccaaattaaccctatttccttttttaaaaaaataaccagaaaaacaataaaatgttacaaataacttggatcttccattgtccacttcagggtattgccactgcaatatattcttaccatatactttttcctaccagtacaaactacaaataacttgggtaagtcctgtctgtacttattctacccacctactagtaatttcttctgaaaatatatatttagctaacaagtaatgttcatttacaatataacatttctctgaattagttttcttgcattattaaagaaatgttattgatagatggtcactgggggaccactgctcctccccgacagtatttaaataactggtataggctgcaagacttaccagatacctgctgcgtgagcgaaggtttctgagtatgatctatatgccatccaactaatatatcaactgtatccttgatggaaacaaagagagagggggccaatcattttaagatattactgccattcacctgtggaccattccacagcaaaagatcctaaaaggagcatctatgttctacctactcaacattctagaaacttagaaaggggagaggggcaggaaaataaaagaactacatttctgacaacaatgaaatagtttattttcttcaaatattttaaggtacgaacgtcagaaataaaaatgcagcatttaaccctggaacctcaaatatcactgattatactcaaaggagcagaggcattgttttccatctgattcctcagttcctcacacacacaaccatccccctcaccccatgatctgaaaagcgaaatgaggaattcaccctaaaattagtgtggagaaaacaagcaaattaggttatttactaagtgactacataaaaaactgagtatgagaccaagaaaaatagattctgtagttttagttaaaaaaaaaattgacttgtaaatcccaactactcgggaggctgagacacaagaatcgcttgaacccaggaggcagaggttgcagtgagctgagattgcaccgctgcactccagcctggacaatacagccagactccatctcaaaaaaaaaaataattaataaataaataaaataaatatactgaaaatatttcactccactaagatgttaagctaaaaacaaatactgttttctcttcttcaatgtttgttaacattagtccttaataacatctgtttacaatatccctaaatgctctctttaagattccacctgtgattaaatttcaaatacaaaaaagtaaaacggatttgggaaacttttctataaagtacagcaattaatttgcaatccaaaatataaagcaaattttatataatttatgctttactatattagtacttgcttcacattaaaattaaagatcagtatggcaccacacatgaataacatgcaggctcaggttaccattatacataaatttttaaaataaatatatggcaaaaataataattgtcattccattgaaagaatatttattttgcagctgttaaaagacatttttccctaaaaaaagaaaagctgtgctttacatagcaatcttataaaagaaatgctagaatcagaaaaccatcattttaggctgggtgcagtggctcacacctgtaaccccagcactttgggaggacgaggcaggtggatcacttgaggtcaggagttcaagaccagtctggccagctcgatgaaactccgtctctactaaaaatataaaaattagcagagcacagtggcacctgcctgtaatcccagctactcaggagggtgaagcatgagaactgcttgaacctgggaggcggaggttgcagtgagccgagattgtgccactgccctccagcttggacaatagagcaagatttcgtctcaaaaaaaaagagaaaaagaaaaccattattttgcaatagccaatgttataatctacacaggcacagactatcaatgctaaaaatcatttaaaagacatcttaggggtaattacagaaatttgaatatagaacacatatgtaataaaattcattttcttaggtatgattacaatattcttgttatacagaagaaaaaccttattcttgggagatgcaaactaaaacattatgggttgaactgtcatcatgtgtatggttttcagatgctcaacaaaagtgtgtgagaaaataaaactggcaaaatattagtaactggtaaatctaggtgaagcatattattatgaaattattatcgtatttacaggtatttattttactggtgcatctatctttctatgaatgtgagaattttcacaagagctgggaaaatgttcataattatgcatgcagaataagcccaagctggtggcattctgttcagttacaggtaattttctgaatcttccctcaaatttttctcaaacctctataatcaaggggaaaaatgttttgttttgctttgcttttttgagatagggttgcctataatggagtgcagtagcttgaccatagctcactgtagcttcaacctcccaggcacaagcgatcctcctgcctcagccttcaagtagctgggactacaggtgcataccaccatgcctgacttattttttttccttttttttttttttttttttttttgatagaaacagggtttcaccttgttgcccaggctggtctcaaactcctggactcaggcgattcaccagcctcagcctcccacagtgctggggttacaggagtgagccaccatgcccagttaaaaatacactttttatttaaaaaaaaaagagaacactccttatatttcctttatattttgtaaactacatacccaaaataaagcatatcaaaaactgtaaaaaaaaaaaaaaaaaaccctaatatcagatattccagacacaacaataccataatttaatcacttaaaatcttactcaaaactaaatcaatgatcttttaggccaggtgtggtggctcatgatagtaatcacagtactttgggaggccaaggcaggaggatcacttgaggtcaggagttcaagaccagcatggccaacacaatgaaaatccatctctactaaaaatacaaaaattagccaggctaatggcacactcctgtaataccagctacttaggaggctgaggcaggagaatcgcttgaacctgggaggcagaggttgcagtgagccgagatcatgccactgcactccaggctggacaacagagcaagactccgcatcaaaaaaaaaaaaaagatattttaatatattcagatacacaaatatgaaataaaactaagtagagctggtattcatttacacataattatcttataccgtttggaataagaatttggggcacgttagcaaaccaaaaggctcagaaagacgtcgtgatatttagttcttgtctccctctacaaatgtgaagcactcttctatccggcattcctagtggagttcctattttcaaatttgcaaatcattctggtgctaagcaatctcaaaaaaaacatttactaaaaaccagaggaaaaaaatcttataactttgggaggctgaggcagatggatcactgagatcaggagtttgagaccagcttggccaacatgatgaaaccccatcttctctaaaaatacaaaaagttagctgggtgtggtggcaggtgcctgtagtcccagctattccagaggctgaggcaggagaatcacttgaacctctgaggcggaggttgcagtgagctgagatcgcgccattgcactccagcctgggcaacagagtgagactctgtctcaaaaaataaatataaaaaaataaaaagctgctattctccattaatacctgcaggcccgacaaaggcagcctaggaattctagatgaatggaatgaatacaacttgctggaagttcttaggaaacaaaatgactattcacagaaccaaataaaagccttccactagaaactaaaaataataataataataataatggttttatatatatgcatacacaagcaaagccagaagagaataaatagcaaatgaatgaaaactagaagcaaaaacaaacaggaaaccatctctacattttttttactcaatcgaccctgaatgctacagcattatccagggccgcagaaaacacacataatactttattcctgataaacaattcgatgtccttaagtccgccaatatcaccgtacattctgtgcaatcaagaaatttactcagctgggcacagtggctcacacctgtaattccagcactttgggaggccaaggcgggtggatcacctgaggtcaggcattcgagaacagcctggcccacatggcgaaaccccatctctactaaaaatacaaaaattagcccggtatggaggcatgtgcctgtaatcccagctacttgggaggctgaggcaggagaatggattgaacccaggaggcagaggttgcagtgagccaagattgcaccattgcactccagcctgggcaacagaacaagactccatcaaaaaaaaaaaaaaaaaaaaaagaaagaaagaagaaaagaaaattagccaggtgtggttgcatgcacctgtagtcccagcactttgggaggccaaggcaggaggatcaatcaaggctaggagtttgagactgcagaaagaaaccctgtctctaaaaaaaaggtccaggtaatttcagggtccagctccaccacaagcgcagctccaggggctgttgagttttgcctttatcattccaagtagtccctgctccagaccaagtcccaccatctggcagtcaggtcagtccaaccacagtcatatcagggcccttccaggaattctcgacgcaaactggaggccgatggcgcgggtcttttcgtggacggcggcagcacggtcctcggcttgcgtccgtagttgctcaggcttctggttcagggctgggcggcggcgcccctgcggcgggcggcccgcaccaggctctgctgcagcacggggtagaggcgctggcagccctcgaggcccaggcgtacggcctccgcccagctctctgtcaggccgccctcgccgctgcccagcagcccggccacctgattcagcacaggcatgagcgccacggtgaggccggcggcggcgcgctcttcctcgagccgcgtggggtccaggagccaggtgggcgcgggccccggcgcgaggctgaggccgcagcccaccaccaggtcgtacatctccacgcccgcgtcggccagggcgagcgcggcggcggtgagcgcggcggccagggccgagccaccgtcctccagcagcagcgccgacacctcgagctgcgcgcgcgggtagcggcccaggcgcacagccggctccagcgcctcctgcagcgccagcgccagctcacgctcctcgcagccgcccgggggagcgcggcgccggcggcccgcgaagggtgcgcggcggaagtcgcagagcaggcgaccgcgcagcgcggccggggcctcgccgcctgctccggccgggccgccgccgcgctcgccgccctcggcctgtcgcgggcccgacacggcacacagcaccttggtgcctcccgcctccaggtaggccgagcccttggcctggctcagcagcccggcgcgcgcgtacacgggccgtagccgcgttgggtcgcgggtgccgggcgcctcctcctcgtcggccgcgtacagctgcggcggctgcgattcttcagggccgcggatgcggcggtgatccccaggcatggcggttcttggcgtgcgaaccccttccgcccaacgccctgccgcatccactggttcttccgttgtttaaagacgcgcggctgcgcatgggctgtcgagagagcggcgggaggcactacagcgcccctggaggcccggagggagaacggcccggtcccagttgtgcagggtagccggatccatccatcttgctggaagggaggggggagagcagctccaagaaaggcttctctgcttccaactacctccacccctcatctactgaattatgaacgccttgctccaagtcaccccacctatttggcctccacctccacagacgtttgaggcagccctaggggctgttcccaaaattttgggttctggggctggactaggtgaacaccacagcagccagcaggagccacagcatttattctacagacgccaaaggctgtcaaaagagccagcccctattgggaagagggatagagatcatgcggcattaagtattgcacgtggtccttttattctctgcagcaaaaacgattcctacttgctgacgcggaaagctcaggtctggagagccgttatctatagatgcgagcgtgacgatcaacagcaatgcggggttagtggttctagaccgatggcactgacgtggagggctcagggcagaaatttaaggggcactgagacataggactgctcccaagtgtgttccagttactgc

SEQ ID NO: 419 - DNA, 140118 bp, Homo sapiens
gtgcttgcattggttgcaattctgagagtcatctctgatggatggacatagataccttggccttggacaatttgtgctgactgtggagcatctgtgggtcctgtggctggcagtggaggcggtaaggagatgactagcagtgagctaccctaaggcccccttgtctaccgcctctcgtctcaaagtcctcatcctcctgtacacatgactgcatggacagccagtaggtgctttcttcttcagtttcttgaaacttgaacagtcatctgttttgctgatagattaagtttgttaaaaccctgccttgtccaagggcagtggttcatgcctgtaatctcaacactttgggagaccaaggtgggaggatcacttgagcctaggaagtcaactctgtttttcttataattctaccatccgctctccaccatggagccagactgacctttggaaaacatcccccaaccccccaccgccaaaaaaaacaaagaaaagaaaaacatcccagatcatttcattcccctgctagtgatactcccgcatgagtgattttcctttgtactttgaataaaattccaactcctgctgatggcacccaagggctgtgtgtaactggcttccgcctgcctctccagcattgtcttagatcatctccccacactccccgtgtcgtgtacatgccggcctcctttttgttcttggtctgtcttacctcagggcttttgcacatgctcgtctcagtgtctgccaaatgtatagctcgttccttatccttcaggtctgtttccaaatgtcacttccttggaggctgtttctgaccatcctgttttaaatatgcccctagttactctatcatgttagctttatttactgttttatttgtatgtttatttgtatattgattggtgttctcctcattcacacacgcaaactctcaaatgtaaatttcataaagacagggacttccccattcttgttcactgctagcagaatatctgaaactcagaatgccctcaaatatttctttttttgttttttttttgtttgtttgtttgttttttttttgagacggagtctcgctctgtcgcccaggctggagtgcggtggcgcgatctctgctcgctgcagcctccgcctcccgggttcaagcaattctcctgcctcagcctcctgagtagctgggattacaggcacctgccaccatgcccagctaatttttgtgtttttagtagagacagggtttcaccatgttggtaagactggtctcgaacccctgacctcgttatccactcgccgcggcctcccaaagtgctgggattacaggtgtgagccactgcgcccagcctaagtttttgaatttttagtagagacggggtttcactgtgttagccaggatggtctcgatctcctgacctcgtgatccgcccgccttggcctcccagagtgctgggattacaggtgtgaggcaccatgcccagccaccctcaaatatttgctgaatgaatggctatcgttctttgtcaaatccctttctcattaatcccatgcactgagtagaatggcatgaaatatgtttggtttctctgtctagtttgagttcctgagatctagttggtgagagacatgatgttctaccggttgctgtcgattgttggaagacaaagagccagcccaggatggcagaactggtcctctgcaagaaacagcacgtcagctgccgaggcgcgttccatggccctgcccacccaggcacaggtggtcatctgtggaggtggaatcacgggcacttctgtggcctatcacctctccaaaatggggtggaaggatattgtccttttggagcagggcaggtaaggatcagactgcatttggctcatggctgtgctgcactaatcgtataagattccctctcctttcagagatactgccccaccagtagctaatctaaatgttgctaagtagcatgagaagaagcaaggtggaatctcctgaattttgtttaaggatgactaataatgctcatgttctctggtttttagagagttggcaaatttcgttttccttttttttttttttttttttttttttggtggtggtgttttggtagacaggatctcgctttcttacccaggctgagcttgaattcctggcctcaagcagtcctcccaccttggcctcccaaagtgctgggactacaggcatgacccactgtacccagcaacattttagactttgacaaaaatttgcgtttgtaaataatgtggattgcatttaagcaaagtagacaactgcttgtgtttgcttaattgctaggttcttaatattgttctcattccccaagagaaatatgctctataggcttagtttctctgtgctcgccttcttttaggtcaagtattttctgctttattggcttgtaagctaagtccctttatattaatttgtaatagttacagagattacagaatggattcttataatccatcattaattaatattataccactatacaagtaatgttagattcatacaacaatattggccgggcatggtggctcacacttgtaatcccagcactctgggaggctgaggtgggcagatcacctcaggtcaggagttctagaccagcctggccaacatggtgaaaacctgtctctgctaaacatacaaaaattagctgggcgtggtggtgtgcacctgtaatcccagctactcagcaggctgaggcaggagaatcgcttgaatccgtgaggcggaggtggcagtgagcagagatcatgccactgcacgctagcctgggtgacagagcgagactgtctcaaaaaaaaaaaaaaagaatacaggcctttgactctgataattctcaacctgtgtttagctaatgttttcttattcccttttttttttttttttaagatggggtcttgctgtgtcacccaagctggagtgcagtcacactatcacagctgactgtagccttgacctcgtggattcaagcagtccttctgccatagccttccaagtagctgggactactgacatgcaccaccacatctggctggttgttgtatttttctgtagagatgggatctccctgtgttgcctaggctgttttcttttctttcttttttttttgaaatggagtctggctctgtcacccaggctggagtgcagtggtgcaatttctgctcactgcaacctccgcctcctgggttcaagcaattctcctgcctcagcctcccgagttgctgggattacaggcacccaccaccatgcccggctaatttctgtttttttagtagagacaggatttcaccgtgttagccaggctggtcttggactcctgacctccagtgatctacccaccttggcctcccaaagtactgggattacaggcgcgagccaccacacctggcctaggctgttgtcttgtgatcagacttgggttagagacttttataaccatcactgtattgagatacaatttgcataccatgccactcatccttgttaagtgctgaaatctgtttacagagttgtgcatccatcatcataaccaggtcatacatttttggcagtaagaccacagaaattaggctggactctcagcagtgcaccacatcaggaggtgtatggctgtcctgtctcacttctggtggtgataaacctggtcactcagttacattggtgtcctccaagcatctctagcacagagaccctgttttctccccttgtaatgggccagtgccctttgaggagagatggattctgagattatgccaatatcctgttcatatgagacctccacctaccgggcttagcatccattgacaactgttgcctgagtcagccaccaccgtgatggttgacaaatggtgattttttgatcatacttctacatttattatagttggcatattactgtcaggaagagatttccttctcccccatttatttactcagttatatatctgtatacacacatacacacacacacaccagtttagactcatggatttctattttatgcagtggatagttttttttttgagacagagtcttgctttgtcacccaggctggagtgcagtgacgtgatctcggctcactgcaacctgtgcctcccggattccagtgattctcctgccccaggctcccaagtagctgggattaatagttgcatgccaccacacctggctaattcttgtatttttagtatagatggggtttcaccatgttggccaggcaggtcttgaactcctgacctcagctgatccacccgcctcagcctcccaaagtgctgggattacaggcatgagccaccgtgcccggcccgcagtggatacttttaagagcaaaagtgggttttgtttttgttaatgtttttgagacagagtctcacgctgtcactcaggctggagtgcagtggttcaatctcagctcactacaacctctgcctcctgggctcaagtgatcctcccaccacagcctcctgagtagctgggactacaggcatgcactaccatgcctggctaattttttgtttttttggtagagacgtgatttcaccttgttgtccaggctggcctcaaactcctgggctcaagtgatccgcccacctcaacctcccaaagtactggggttacaggtgtgggccgccacacttggcctcataatgcttccttgatgtcaaagtctttctcctattttttgaaatccttttaaatttaattatcaggtatttccacaaaaagtgataaactaatcgcagtgtaaatgtttctaagtgggagaccctagggaggttcatttttggtttaatttgttgcttcaagattatataataccttagaattgatataaggcagactatttaaacctcacacttaaaaataattacgccagccaggcacgatcgctcacacctgtaatcccaggactttgggaggccaaggtgagtggatcaccggagatcaggagttcgagaccagcttggccaacatggtgaaacgccgtctctactaaaaaatacagaaattaactgggagtggttattcgcgtctgttaatctcagctactcgggaggctgaggtaggaaaatcacttgaatccaggaggcggaggatgcagtgagccaagatcgcaccattgcaccccagcctgggcgacagagcaagactcagtctcaaaaaaaaaaaaaaaaattatgcctcggccaagtgcagtggctcatgcctgttatcccacgactttgggaggccaaggtgggtggatcacctgaggtcgggagttcaagaccagcctgcccaacatggggaaaccccgtctctactaaaaatgcaaaaattagctgggcgtggtggcataagcctgtaattgtagctactcaggaggctgaggcaggagaattgcttgaacctgggaggcagagattgcagtgagccaagtttgtgccactgccctccagcctgggcaacagagtgagactgtctcaaaaaataatagttattattatgccttatccgtggcttgtgaaatggttttatactgccctttatgtataattattcctcttgtccatcttcactattgttctcatagatcaatgggtcttaaatctgtctgcacattagaatcagctggggagcttttaacaattaccagtgcccagacctctccccagaacaaaccagaatctctaggggtgaggccaggcatcaatatttttaaaagcttccccggggactctaatgtacctccaagggcgagagccactgtcaaagctgctcaaggagtgctatcccagcagagacgtcaccagagctataggtgctgaccaccagccagttaatggaactcccacctggggtggagctccacacagttacaaagatgatagaaaaatctctttagggagctgacaatcttatgtggaaaatataattattagagtaaatacagtaaactcaagtgacaggcatgctgacacagatgttagtttatttactgagtgataaataatttggggaaaatgaccttagaaccccccacctgctttcttgacatatgggtcccttgcaaaactgggtctttgggccctagcattactgtagcctttatattctgttgctaccacaaattagagaacatttttttcaatgtaaagtttatgtacttttgaataggcaatgtatttatatgattcaaaattgaaaatatgtaaaagaagctgggtgcagtggcttatgccggtaatcccagcactttgggaggctgaggcgggtggatcatctaaggtcaggaattcgaaaccagcctggccaacatggcaaaaccccatctctactaaaaatacaaatttagccaggcatggtggtgcacacctgtaatcctagctacttgggaggttgaggcaagagaattgcttgaacctgggaggtggaggttgcggtgagccgagattgtgccattgcactccaatctgagtgacgagcaaaactccgtctctaaaaaaacaaacaaacaaaaaaacaaaaattagctgggcatggtgacacacacctgtaatccctgctactcgggagactgaggcaggagaatagcttgaacccaggaggcagaggttgcagtaagccgagattgtgccattgcactccagcctgggtgacaagggaaactgcgtctcaaaaaaaaaaaaaaaaaaaaaagtatatatatatatatgtaaaagagtatacaggaaaaagactccccaatgttctttccttttctttctttttttttttaagatggagtcttgctctgtcacccaggctgtagtgcagtggtgcagcctcagctcctgcaacctctgcctcctgggttcaggcgatcctcctgcctcagccttctgaatagctgggattacagacgcctgccaccatgcccggctgatttttgtatttttagtagagatggggtttcgccatgttggccaggctggtctcgaacgcctgacctcaagtgatctgcctgcctcagcctcccaaagtgctgggattatagatgtgaaccactgcacccagccctcaatcttcacttctaacaaaaagctttctctctggagggaagttaagttctagttatattctctacttctataagcaattatgtgttggtaggtttgtgtatatgtgtatggatattcatttattatattttttctcttttttatataagtgggagcataccttacacactgttcttcaccttgctttttcattatgattgttccattttggtacataaagaccttttcattcttttttatagctgcataatattccattgtatagatgaattccaaaattttattttattttagagatggggtcttgctctattgcttagtctgaagtgtagtggcacaatgctagctcactgcagccgcaaacttttgggatcaagggatcttcttgcctcagcttcccaagtagcctggctaacttttatctttattttttttacttttttttgaggcggagtctcgctctgtcacccaggctggaacgccgtggcacagtcttgactcactgcaagctccacctcccgggttcatgccattctccttcctcagcctcccgagtagctgggactacaggcgcctgccacaatgcctggctaattttttgtattttttgtagagacggggtttcactgtgttagccaagatggtttcgatctcctgaccttgtgatccgcccacctcagcctcccaaagtgctgggattacaggcgtgagccaccgcactcagcctttatttttatttgtttatttatttttatttttatctttttttggtagagacacagtctggctatgttgcccaggccagtcttgaactcctggcctccagtgaacctgctacctcagcctgtcaaagtgctgggattacaggcatgagccactgtgcctggcctaaactatccagaattttaaatctgtcccatgtcattgaacatttttctcaccctgttgcccaagctggagtgcagagatgtgatcacagctcactgcaacctctaccttttgaactcaagcgctcctctggccttagcctcccaagtagctgggactgcaggcatgtgctaccatgcctggctaattttgttgttgttgttggtagagatgggttctccctgtgttgaccaggctggtcgtaaacccctgtcctcaagcagtcctcagtcctcctaccttggcctcctaaagtgctgggattataagtgtgagccactgtgcccagcttgtttccatcttttggtgttagaaacagtattaaatgagaaaccctgacctcgtattcacagatgacgtcaatctacctaatagcattttgcatccatcctgcaggctggctgctggctctaccaggttctgtgctggcatcctgagcactgccaggcacttgaccattgagcagaagatggcagactactcaaacaaactctactatcagttagagcaagaaacagggatccaaacaggtaagcaagtgtcttccatttattgctttgcctgtccctgagattgttatattcatttctgtatttggtcctctgccaggtgtgcctgctgctttggtaattaaaacttgggttggccgggcatggtggctcacgcctgtaatcccagcactttgggaggccgaggcaggcggatcacgaggtcaggagatcgagaccatcctggctaacatggtgaaaccccgtctctactaagaaattaagaaaatatgtaaattatccttactgtacttcttttgaaaataagataccaaattgcttcaactctttcttcataagaattaagagtcattgcattttaggagaattgtcattggcccaagtgtaattatggttctatatcaggtgtgttgattacagacaacaggaattggctctggccaacttggagcttgttgggaggagcttgggcctgtggagttggcaggaggctgccagctggaggcagcctggaagccaggatgtggggactgcaccgcaggcagtccctcagcgagaacaggagcagcctggcgtggctgatgctgcccttgagatggtgacctctagtcattcacctacgtgctcaagactgactcttccaggagggtctgattggataagcttaggtcacatgcccactgtttggctatactggggaagaagaagggagaatccgacccttggtagctgatgttattgtgagtggcctttgccagggattacactcccccaagactaggaggagaaagggtgaaactgcctaaaaggtgggaagaatagggatggtcgaatccctgcccaaaactgtcttttttttttttcttttttttaaagacaaagtctcactctgttacccaggctagagtgcagtggtgcaattttgacccactgcaacctccacctcctgggttcaagcaattctcctgcctcagccttcccggtagctgggattacaggcgtgcaccaccacacctggctaatttttatatttttagtagagacagggtttcaccatgctggccaggctggtctcaaactactgacctcagatgatccgcccccctcagcctcccaaagtgctgcgattacaagcatgagccactacacctggcctagaatctcatttgatcctcacaacctcacaaaactgtgagctgagaatgtttggtcagggcatggagccttagtgcatctgaagttcttaaaattttgcatagaagctcagagaagctgatttacctgcccaaggatattgagtggcagtcccaggattcatcacaggtcttctaacctataatctagtggattttccactctcctgtcctacatttggtctgatctgtctcatttgggctcatttttcttacaggttacacaaggacaggctcaatctttctggcccaaactcaggaccgactgatctccctgaagcgcatcaacgcagggctgaagtacgtaagagtctagaagcgtgtcctgactttaccacactggcctctgccaaagagcctgtgaatgtcattgtcccttgtgttctgtggcagtgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgagcaggtttttgcattttcttaagataggttagcagggaagacattacctaaggaagtgtctcacaataggaagtgacaccaactcaagtttggaaagattatcctctttggggtactcagcctccattttgaacacttataattttatttatctgttaatgagtgttttccctcagggccacatttttaaagttctaaagaactgcttttagtgctaattaatgccccttttttggagacagagcttcactcttttcgcccaggctggagtgcaatggcacaatcttggctcactgcaaccttcgcctcctgggttcatgtgatcctcctgcttcagcctcccgagtaggtgggactacaggcgtgccccactacacccggctaatttttttgtgtatttttagtagagacggggtttcgccatattggccaggctggtcttgaactcctgacctcagatgatccacctgcctcggcctccctaagtgctgggattacaggcgtgagccactgtgccctgccaattaatgccctttggacttaaggtaatattttccgccacaggacttgagaagctcaaggtgaaaacacaccttggaagtttaatccacacctgaaatcatgagcccagttgcattgaatgaggggaagacttaactagcgtccagggtatcatatccatggtatgagcaggttagcacttaaggcgcactatttacatcctctcctctctgctccatagtttatgattccaggaatttaattattgtgttccaaagtctgtttttaaactgagttgctattttcaatcttgaacaaggcccatttacatagtctcaggatgtgattctagggttttgtgttttttttaaatgaaagcattgagccgggcgtggtgtctcatgcctgtaatcccagcactttgggaggccaaggcaggcggatcacctgaggccaggagttcaagaccaggctgaccaacatggtaaaaccccatctctattaaaaatactaaaattagccgggcatggtggtgcatgcctgtaatcccagctacttgagaggctgaggcaggagaattgcttgaacccaggaggcagagagcgagccaagatcgcacgactacactccacccttggcgacaaagcaagactccatctcaaaaataaaataaaaaaataaattaaagcattgacttgactttgtcagtgtttcttctgggtggagaacctgctgcacatgccttcattctggaacatcagatgaaacaccaactctttctttaccttggaacaggtgttcagatctatgaccggacatctgttcttcatgtaatggtcaaaaaaggtcaagttactggagtggagaccgataaaggacagattgaatgccagtattttgtcaactgtgctggccaggtaggtcagcaccaacactgctgttcttatttaacgtttgtctccaagatttttttggtgtagagaagtaagattagtattgtgattggttatacagatatcagtaactacgctgtttcttgtagggtattctaaatcagaaacctacacttagtctgcaaatagaagcctgtgtgaccttgtccttcctccacactgggttgatgggtgctatcctggtcaggaaggccagcaaatggtcaggcattgacgtgaatccttggcactgggtcttgatgttacatttcattctataacctagcaaataacatattaggctattttattgtgtcaggaatgtggacactaatttccaggacactgcttcttttaaagcagattggctcttgccttccatgctatgatcccgaagtgaactaagaaatacttttgccatgtgaagttcatttagtgattgctatttggggtttgtagctgagcccaggcgttttatcaaaaggacctcctttggttcccatgagctcctttgactagctggtaaatatctcttcctttgatctcaaagtaatttttatgtcttaaaaaatgtagtattgctccccatccaaataattgaactaaagcaggctgacttcccacacctgacactgtagcaagagcacacataagccacttggaattaatctcaagaggctgaacttgctcatttttatttctgttcctcttcccacccacaaatcaacctgtccatttgtagtgggcatacgagctgggtctgtccaacgaggagccggttagtatcccgctacatgcctgcgaacacttctacctcctgactcgccccttggagacccctctgcagagcagcacaccaagtgaggacttgcacttttttaaaaaatcttgtttctttgccagtatcctgtcctctgaaaaggaaaactttctgctaaggacagcctgtgtctgaaagagtctttcatttctagagcatgttacagggaggtggacccaattctgacttttctttattaactctttatgaaaggatggccaaaatttccattaatacatttttttgtttttgtttgttttgcaagctaattttagtcctaaacagaggtcattgagaatatttggactgtcttgttgactttttaacttgaatgctatggatagtagaaatgtcataggtaaacaatagacttaggtgggttcgtggttccaagcactgtaggagagggttctcacatccttttgacggtcttcatgcctagaatgggctctgcaacccccctctctgttaaactttcgcttggcacagtgggagttacgtggtttgcttgtggggactagtcaaagcttctaggtaagggataatcagagaaacagtctccactgaaaggctaaatgggaggatcttcccccgtgacctcaaaaggtattttaaagctaatgaatgcctgtgttcattgaatgttctttcattaataaagccattaatgggtgtttttgtttggttgttctgtccatttagaaagctgacttgcctctaaacccttgttttttcttccactccccactccatgtcatttctccacctcagctattgtggatgctgatggaagaatttatattcggaactggcagggtggcatcctgtctgggggctttgagaagaacccgaaaccaattttcactgagggcaagaaccagctggagattcagaatctacaggaagactgggatcactttggtatgtgaactgcattataaccgtagtgccttatatttgtttaagatgttatatttttcaaagtattttgaagaatagttccttgtttaatgtttataacatcgccatgaggtacaacagtggttacagagggtgagtttgcctggtctgaggatggagttactaggtagcagattcaggggactaaaatcttagttaatagacatttgccttattcttttttaattttattcttagttttacttttttttttttatttcttgagacggagccttgctccgtgctcagactggagtgcagttgcacaattatagctcactgcagccccgaactcctggtctcatagctttttttttttcttctttttggtagagacatggtctcgccatgttgcccaggttgatctcgaactccaaggctcaagtgatccctttcaccttggcctcccaaagtgctaagattacagatgtgagccactgtacctagccctttgtgtgtgtttagtcatctctatcattttgtgtgtgtgtgagatggcgtcttgccctgtcacctaggctggagtgcagtggcatgatcatagctcactgtagcctcaaattcgtgagctcaagcaatcctgccacatcagcctcccaagtagctgggattacaggtgcttgccaccatgcctagctaatgtttaaattttttgttgagatggggtctcgctgtgttgcccaggctggtctcgaactcttgggctcagtcaatcctgcctcagcttcccaaagtgctgtgattacgggcatgagccatgatacccagctgctttttttttttttttttttttgagatgaagtctcgctctgttgcccaggctggagtgcagtggtgtgatctcggctcactgcaacctctgcctccccggttcaagtgattctcctgcctcagcctccagagtaggtggtaggtgggattacaagcgcctgccaccactcccgactaatttttgtgtttttagtagagacagggtttcaccatgttgatcaggctggtcttgaactcctgacctcaggtgatccgcctgcctcagcctcccaaagtgctgggattacaggcatgagccactgcgtctggcctttttttttttttgagataagagtcttgctctgtcgcccagactggagtgcagtggcacaatctcggctcactccaacctccacctcctaggttcaagtgattctcatgcctcagcctcctgagtagctgggattacaggcatgcatcaacatgtccagctagtttatgtatttttagtagagacaggattttaccacgttggccaggctggtcttgaaatcctggcctcaagtgatctgcctgccttggtctcccaaagtgctgggagtaaaggtgtgagccactgtgcccagctctgcttcttttttttgtttttttgtttttttttgagatggagtttcactcttgttgcccaggctcaagtgcaatggtgcgatctcggctcaccgcaacgtctgcctcccgggttcaagtgattctcctgcctcagcctcctgagtagctgggattacagacatgcgccaccacgcctggctaattttgtatttttagtagagacagggtttctccatgttggtcaggctggtttcgaactcctgacctcaggagatctgcccgccttggcctcccaaagtgctgggattacagacgtgagccaccatgcccggcccctgcttattctttattcacctaaaattattgctcagattttaggttttaggaggagacttctttcagtaggacttcatataaaattgaagagttctttagaaaacagaattgttttgttttgttttgtttttcagaattgttttgttagtgtagtattttattaaattttaaaataattttatttatttatgtatccattcattcattttgagatggagtcttgctctgttgcccaggctggagtgcagtggtgcgatcttagctcactgcatcctccgcctcctggattcaagcaattctcctgcctcagcctcccaggtagctggaattacaggcgcccaccacaacgcagagccagtttttgtgtttttagtagagatggggtttcactatttggccaggctggtcttgaactcctgacctcaagcgatccacccgcctcggcctcccaaagtgctgggattaccggtatgagccaccgcacctggcctttaaggcctgtaatcccagcactttgggaggccaaggcgggcagatcgcctgaggtcaggagttcaagaccagcctggccaacatggcaaaaacccgtctaaatataaaaattagctggatgtggtggcgcacacctgtaacgccagctacgtgggaggctgaggcaggagaattgctggaacccgggaggcagaggctgcagtgggctgagatcgcaccactgcactccagcctgggtgacagagcgagactccatctcaaaaaaaaaaaaaataataataataatatagttacctagttccaaatttaaaaagatgaaagagtctctaatgaagaatttccctctgacccttgatgggctttctttttttaataaattcttacggaaaatttcaaacttttaaaagtggatagaagctgggcacagtggcttacacctgtaattccatcattttgggaggccaagatgggaggatcactggagcccaggaagtgaagaccagcctgggcaacatggcgagactggagactatgtgtctactaaacaaacctggcgagagtagtatgatgagcccccatgtacccattatccagctctggtctggtttcatctttttctgctgtccactggattatgtcctgatggtagatttcctttaaagcagggtgaaagtctgtcttttgcagctattccaatgcagaacattgcctttttttttttttttcctgagatggagtttcactctattgcccaggctggagtgcagtgtcacgatctctgctcacttcaacctccgcctctcagattcaagcgatttttctgcctcagcctcccgagtagctggggttacaggcttccaccatcacgactggctaatttttgtatttttagtagagacgaggcttcgccattttggccataatgctcttgaactcctgacctcaggtgatccgcccaccttggcctcccaaagtgccggggttacaaatgcaagccaccatgcccagctcagaacatcaccttttattaaaatctctgtggccgccatttaagagcttttccactcacactggtcccttcaagattattatctgtagatacgttttacttgctgttctctgctgctttcctttctaaccaatatcttttttcctcagtctttataccaagtattttgcagctatatcctgtaattctaccaaggtttctgctttgtgataaatggcccagttggctcgtctttaaaaaaatctcttccagccggacgcagtggttcacacctataatcctagcactttgggaggccgaggcaggcagatcacttgaggtcaagagttcgaaactagtgtggccatcatggtgaaaccccatctctactaaaaatacaaaaaattagctgggcatggtggtgcacgcctgtaatccgagctaattggcaggctgaggtgagagagtagcttgaacctgggaggcagaggttgcagtgagccgagatcgtgccaccacactccagccggggcgacagagtgagactccatctcaaaaaaaaaaaaaaaaaaaatcaagaggttttctgaaaggggagagtgtaaaaaagtagaggggttgaaagtggtttaattccttaaaggtgagaactctatttggttttgttgtcattgctcagagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaagtctttctcactcaaagtcagctgtgaacataagtcaacttgctgggtctcttcccttctagaattacttgttattaacatggcgtgtggtatatttaatctagtatgttaagactaataagaagatacatgtaattttggagttgtccccttctaagtatgagaggctccccatgttccagaaatgtcatcgggcaaaatgtttttgcaactcatcttttggagttagccacagatcctgtgggatattcttttatattttttcagttataacaaatattggtcatttgagtgtgtatttgagtttggtagccaagtatgttgattgaggtaggtatttgaactaggtaatacacggtttgtttgtttttttagacagtcttgctctgtcacccaggctggaatgcagtgacatgatctcaggtcactgcaacctccacctcctgggttcaggctattctcctacctcagcctcccgagtagctgggattagaggtgtgtgccaagacatctggctaatttttctatttttagtagagacagggtttcaccatgttagccaggctggtcttgaactcctgacttcaagtgatccacccaccttggcctcccaaagtgctaggattacaggatgagccactgtgcccggccacaagtttttatttaaaaattagacactaggccgggcgcagtggctcacgcttgtaatcccagcactttgggaggccgaggtgggcggatcacaaggtcatgagatcgagaccactctggctaacacagtgaaaccccatctctactaaaaatacacaaacaaaattagccgggcgttgtggcgggtgcttgtggtcccagctactcgggaggctgagacaggagaatggcgtgaacccaggaggcagagcttgcagtgagccgagattgcgccactgcactccagcctgggcaacagagcgagactctatctcaataaaaataataataataaaataaaataagacactaatgaacattaaataagccagtcacaaaaggacaaataccgtgtggttccacttatatgaagttgctagagttgtcacatcatagagacagaaagtacaatggtggttgccagaggcgggggaggggagctattcttgaatgagcacagagttccagaaatgcaagaggaaaagagttctaggatggatggtggtgaaggttacaccgcagtgtgaatgtacccactgccactgaactgaatacttacaaatgggtaagatggtagccacgatgaaaagtttattttaaatttatgagaccagttctcttgagtgatttgtagaatggctctgaaaacagttacagaagaggagttagaaaaatgtttggagcaaaggagatgtggtcacgtaactgtataatctttaggtgacagaaaaaaacccattggatatttagagtatatttgtatgtgttttagtcttatttcttcatagatgaggcttataacttttttgaaacaagatcttactctcacccaggctggagtgcagtggcaccatcatagctcactgcagccgcaagttcctgggctcaagggatcatcccgcatcagactccagaagagctagaactaactgcaggcgtgtgccaccatacccagctcttttttttttttttttttttgaaacgaagttttgctcttgttgcccaggctggagtgcaatggcacaatctcggctcaccacaacctctgcctcccgggttcaggtgattctcctgcctcagcctcccgagtagctgggattacaggcatgtgccaccacgccggctaattttttttttttttttttttttttttttgagttggggtttcgctcttgttgcccaggctggagtgcaatggcgtgatctaggcttactgcaacctctgcctcccaggttcaagcaattctccttcctcagcctccgtagtagctgggattacaggcgtgtgccaccacactggctaattttgtatttttaatagagacagggtttctccacattggtcaggcttgtttcgaactcctgacctcaagtgatccgtctgcctcggcctcccaaagtgctgggattacaggtgtgagccacctggctcactttgaaacttttttttttctgtagagacggggtcttactatgttgcccaggctggtctcaaactcctgacttcaagcaatctcctgcctcagcctcccaaagttctgggattacaggcatcagccaatgtgtctggctggcttctatgttaaatacctcctagggaatcttatcatctggggtaaaatcctcatagtagtcttttgagagcagtacacagacccatgttcgtttcttccagaaaagttaaggaaagtgcccaaaactattcagctggtctatggcaatttaggatcttttgattctgtttgttctcgatttgtagaatattaattttctcaaatctcacacctgagccccaacacgtgccctctgtctatataggtaccttgccgaatggatggtacatggttatccctcagaaaacgtttgggaattggacctgaaacgttttggagccctccagagcagccgcacctttctgcgccaccgggtcatggaagtcatgcgtaagtgaagctttatcgcagttgctcctagttgcaggtatcttctcggtggcccgtgttgtcattcagaaggagcaaagttttcctcagttctttaacaagtgctttgagttgggcatttgatttgactgtttcaggcctgagttaaggggctttatgctcctcatgatatatacgtaacattttctttagtgcatcggaccttgtttcattctgagaacaagaaaatagaataggagttacagttggtacatagcagcttcataaatattctaagcaatgccttcttcccggtctgccttgagagaccgtatgtcgaagtgcgtgctttctgcagtctgccttgagagaccctgtgtcgaagtgaatgctttctcactcccacttagtttttgagaaaatgctttctcactccccacttagttttttctttccaagtcagagaatttgccgagttattctcagagcttcaggcttccgtgagtgactttcaccattaatccaccctacagcagcaagattgggagccacttcccatataaatacaaaacatacattcctgctctcactcccgtgttctcgccctgcttcaactttgaaggattggccacttcatcttaatttgttattctaccttgatctctgatttattttctaggaagcccttagaaagcttttgtatcaggaattgaaccaaaccacgtgggttcaagttgtaatttcattttcctgtactgaggagctgttctcagactttgccaaatggtatctaaatattttgggcatacttatgctcaggactaagtttctgtgttggctctgaccaccattcttggttgcaagtaaactgttagtttggtagttgaacaacattgttggtgaggactctggatggcctttaatgcctgagtgctcacttttggcctgggaagaggatgtacatccatggagatgaaggacctaacagcaatatgtttaactgctaaggttctttaattttagcaaatattttggttaaaatgttgaacttggctgggtgtggtggctcatgcctgtaatcccagcactttgggacgttgagggaggtaggtcacttgaggtcaggagtttgagaccagcctaggcaacgtagcgaaaccctgtctctactaaaaccaaaaccaaaaaattagccatgcctagtggcacacacctgaagtcccagctacttgggaggctgaggtaggcgaatcacctgagctggggaagttgaggctgcagtgagccatgatggtgccactgtgtactccagcctgggcagtgggactgagaccctgtctcaaaaaaataaaatacaaaatcaaagttttttgttttaaagttgaactattataagcctaaatttccctacccatagttactttggaacctgtacaaatcataattgagcttgagcttctgcttggtgatatgacacttttggtagccaattctcatgaaatagaagtggcaggcacatagaaaatggggaaggcgccaggcgcagtggctcaagcctgtaatcccagcatgttgggaggctgaggcaggcggatcacttgaggtcaggaggtctggcctgaccaacatggcgaaaccctgtctctactaaaaatacaaaaatttagccagatgtggtggtacgtgcctgtgatcccagctacttggcaggctgaggcaggacaatcacttgaacccgggagatggaggttgcagtgagccaagatctcaccactgcactctagcctgggtgatagagagggattccatctcaacaaaaaataaaaaaaaaatagaaaagaaaatgggggaggggatgatagaaccgaaagtactaggagatggagagattgtcaccatgcagagaaccccacctggcttccttctcctgtctcccaacctccccaagccttgatgtgccttttgtttgggatggtgtgagatcagggaccacagatcacactcttctggctttttttacttattgctgttgaagattagaccttaagggaaatgaattttttttttttccgagacagtcttgctctattgcccaggctggagtgccgtggcgtgatttcggctcactgcaacctctgcctcctgggttcaaacaattctcctgcctcagcctcccgagtagctgggattacaggcgcctgccaccatgcctggctaatttatgtatttttagtagagacagggtttcaccacattggtcaggctgatcttgaactcctgacctcgtgatccgcccacctcgacctctcagtgctgggtttacagacgtgagccaccacacccggcctaagagaaatgaattctgaccctagctttgttgtgtgaataatgtcattggtacaatacaatataacttctcagatttcagagccacctaatcaagctgcaatatgtaccctttcacttcagaagtgagttaattatcagggaggaaatgtctgtaacaggtctgagatcctaacacaggcacaatgaagaatcgaatgccattttttcacattttgttaccacctgtgtcccacttagtaaccttcttctctgctatgaagcttggtaaggtttaggaccctgacctttctgccatcatttctacctactaatgtggaatgctgaatgtgaatacaggccgagtcatgccgtgacacgtagctccagggagggacgatagcagcttggcaggattgtcttttccttctggagcatgcctgatacactgggtaattttgaaaattagactacattagcctggaaattgggccgggcagagtggctcacgcctgtaatcccagcacttcgggaggctggggcgggcagatcacctgaggtcaggagtttgagaccagcctgaccaacatggagaaaccctgtctctactaaaaatacaaaaattagtgtggcacggtgacacgtgcctgtaatcccagctactcgggaggctgaggcaggagaatcgcttaaacccaggaggcagaggttgcagtaagccgagattgtgccactgcactccagcctggacaacaagagcaaaactccgtcttaaaaaaaaaaaaaaactacgttagcctggaaagctcttttgaatagaaacaactccagagtctagtggacatgggctactcaggtctagaatctgtgtcttgggctttgatagactactcgtgtcttttctagctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaagggtaagaagtcacattctcatttttgcttcttttttttttttttgtcctgggaattaataaaacatattttcaaatgcataggctagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacaaagtttgagataacagtaagtatttgggaaccaaaaagtaatagattaggaaactttacatatttattgaatgccttttgtttttcatcttcaaaactgattcctgactgggtgcagtgggtcatgcctgtattcccagcactttgggaggccaagggggcgtggatcacctgaggtcagagttccagaccagcctggccaagatggtgaaaccccgtttctactaaaaatacaaaaattaaggccaggagtggtggctcatgcctgtaatcccagcagtttgggaggccgagacgggtggatcacctgagatcaggagttcaagaccagcctggccaacatggcgaaaccgtctctaccaaaaatacaaaaaattaaccaggcatggtggcgggcacttgtaatcccagctactcgggaggcaggagaatcgcgtgaactcatgaggtggaggttgcagtgagctgagattgcgccactgcactcagcctgggcaacagagtgagactccatctcaaaaaaaaaaacaaaaaacaaaaacaaaacactgatttcttaagaattctggtatattttagtgtttcatctgtattgtaacatttttctgaaattttagctccttgtttcaggtttttaatttgctagagaggcctgtttatcataagaatcaatagctagcgttccctggagcttcttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcaggtgagatgagctgccgtcccgctctgctccctccaacatgttgattccttaggggtgctgtagcagaggctctcaggcgcttctccgggaaccataaatcccagagtctaagaatcattacatgaaatcaaagccagtttattagcagtcctaaacaaaagaaatcaccaggaggaaaagaaaaaaaagcccaccagattatgtaccctactgggagaagatgccttgtcttttttcttttttttttttttgagacagggtctcactttgttacccaggctggagtgcagtgatgcgatcatggatccctgcagcctggacctcctgggctcaagtgatcctcccacctcagctttccaggtagctgggaccacaggtacacgccaccacacccagccagtttttgtatattttgtagagatagggttttgccacattgcccaggctgatcttgaacacctgagctcaagcaatctgcccaccttggcctccaaagtgctgggattacaggtgtgagccactgtgcccagccgatgtcttaacgttagtaaatctgtataatttcttggcattaacaggaagccagaattttgttttgttgttaggtggtgtatcctagaatggtgctactggccttctgtgaaagctaagaaatcatttcctagtatttgcctcattgctttgaaaccaaataagatttgattgcttcctgatccttttgctgctacctggttttgattattttggggtctcacttttcagtttcttcatgatctctccaaccgaccagcaggtccactgttgggcctggcttaagaaacacatgccgaaagacagcaacctgctcctggaggacgtcacctggaagtacacaggtacgggggttcgggctctgccacgtcgaaaaggccagcagatgcagatgtgtccacgtttgccttctttacatttgactctcaaaaatgaacattagagttagcataaaagaggctctctggtcatagaaaattgatctctaggggatgcggtggctgacacctgtaatcccagcacttttggaggccgaggttggaggatcactaggtcaggagttcgagaccaacctggactatatggtgaaaccccgtctctactagaaatacaaaaattagctgggcgtggtggcacacacctgtaatcccagctacttgggaggctgaggcaggagaatcacttgaacccaggaggcagaggttgcagtgagccccagattgcaccactgcactccagcctaggcgagtgagactccatctcaaaaaaaaaaagaaaattgagggctggacacagtggcttacacctgtaatcccagcactttgggaggctgaggcgggcggatcatgaggtcaggaatttgagaccagcctggccaacatggtgaaaccccatctctactaaaaatacaaaaattagctggacatggtggtgcatgcctgtagtcccagctactcatgaggctgaagcaggagaatcgcttgaatctgggaggcagaggttgcagtgagccaagatcatgccattgcacctccacctcccgggttcaagcgattcttctgcctcagcctcccaagtagctgggattataggcgcccgccaccacgccgggctaatttctgtatttttagtagagatggggtttcaccatgttggccaggctggtcttgaactcttgacctcgtgatccacctgcttcggcctcccaaagtgctgggattacaggcatgagccaccacgcccagtcccagagagtacctaatttttaaggatgacttggttccctgattttctcactctcagcagtctcggcttaacccctcccaccttcccacctaactgatcttgccccttggccccaccagcgtttgctctcccaggctctcattctcaattccttgtagtagcaaatatgatatacgtcctgctcctggattgggatactacagaatgttactgaacaaaagtcatgttctagcctgtcttaggatggatgacatgtaattagcacaagctgatgtcacaaacactggtgtccagaataatgctttccttatctagtaagcattaggatatgtttgaagtggatttagcttctctgaatttaaagtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggtaagtgctgataaagttctgtttcttaaatgggcagagaatgtgtctttcatagcggtggcaggtacatattcttactatggtgttagcacccacaaagagtgtcttggctgggtgaggtggcacatgcctgtaatcctagcactttgggaggccgaggcaggtggatcacccaaagtcaggagtttgagaccagcctggccaacatggtgagaccctgtctctgttaaaaatacaaaaattagctgggtatggtctcacgcacctataatcccagctacttgggaggctgaggcacaggaatcgcttgaactctggaggcagaggtcgcagtgagccgagaacacgccactgcactccacctgggtgacagagtgagactctgtctcaaataaaagagtgtgctggccaggtgcagtggctcacgcctataatcccagcactttgggattacatcttatatttataaataaatataaaaatacaaaaattagccgggtgtggtggcgcatgcctgtggtcccagctactcgggaggctgaggcaggagaatgacttgaacctgggaggcagatgttgcagtgagccgagattgcgccattgcactccaggctggcaacagagcaagactgtctcaaaaaaaaaaaaaaaaatgtgctgcccttcattagcaaagaagtgactaagtatatttatttatttatttatttatttatttattttgagacagagtttcactcttgttgcacaggctggcgtgcaatggtgcgatctcggctcactgcaacctccacttcccgggttcaggcgattctcctgtttcagcctcccgagtagctgggattacaagcgcccgccaccatgcccagctaactttttgtatttttagtagagacagggtttcaccatgtttgccaggctggtcttgaactcctgacctcaggtgaaccacccacctcagcctcccaaagtgctgggattacaggtgtgagccactgcgcccggccttatttgtttattttttacactccaagcttgctttatttaataagcattaggatatctttgaagtggatttagcttctctaaatgtaaagtctttatgctttttggtttctgtagcactggattaaaatttgaagttacaggattatgacacacacaaaaatgcctttcgaagttaggtcccttctctccatgcagtgtggcctcttttctgtacacagagtaacttctgtgtctgtggcatcttcagggaagaaatggcgtaggtgaatctctgaacttcctacataattttctttcctataagtggcaaccacagctgagtgaaacaaactgtaaccgaatgaaagcaatgacaacggaatcctccccaggaagctgctgattagagagggccaaacggacagacatcttggccacctgtaacgagcaacttccaggtggttactgatggagactctttgaagttcacccaaagtgggatccacctacaaattgtttcacagttttccttcttctccgaggcaaagtgaaagcaacagaaaactctccactgttagctatcagtggacccctcccagcgtttgctctgctgcttggaggagtgacccatacgctcaacacctggcgagtgctgcatcctgtcagcctcctgtggaagcggttcacttcggtgctgtccaggactttccactttcctttataggaacggtgattgcgtcagtggccgctgttagggaactgagctgctatgtaacgtgttctgagaatcagaagcccatctttgaccccaggatagcagattaattatgtctgtgggcatcgggcatcatcttttgtatggcaggcggccagggtttgtctgctgattcccccagagaagacactcgccttgtcctcattgtgcctgctaccctcgactaacacaaggacctggcaaagaggaatattttgtgcttgtcaaggactttcctccactctctaccatcagcttggctaaaactcctgagatggtaacagtagcaagcagagatgtcacataggcagtgctccattctctgtgcctcaggacctggaagttaaccactttcgggatgaaattcttgccttgacgtctgtctccctcaacagtaaacagagggtgcagcactaatgaaaggtttccccaggcgtccctcccttgacaagtaatgtgagtgcccaggctgactgctgcctttgtccctgcaggagatgagtgtgggctatgcaaatgggatccgggtgatgagcatgacgcacacaggagagccaggattcatgctctacatccccatagaggtgagagggcacccttcccttcccttcccttcacttcccttcccttcccttcccttcccttcccacaaccactgtggggtgccagtgctcccagcagcgcgttcaccagcactggcaggtttggagagctgtatctgattgggccttgggagctgaggtaggctgcattgaagagatttgaccatttttaactaagttatataagtttttttgaataggtgatacatttaaaaagtatttggcgccgtctgatctgttctcaccaactgtcaccaataatattagtattacttttatatgtcatttcagatttgtatgcatattgcaagcaaattcataattaatttttttttttttttgagacagggtctcactcttttgcccagggtggagtgcaatggcatgaccgtggctcactgcagcctcgacctcttgggctcaagccaccctcccacctccgcctcccgagtagctgggactgtaggcatgtgccaccatgcctggctaatttttgtatttttttgtagagacaggttttgccatgtcgctcaagctggtctcaaactcctgacctcaggtgatacacccaccttgtcctcccaaagtgctgggattataggtgtgagccaccatacccagccaagccccctttttaaaaacagaaatggaagcatactgctattcttcatcctgtttttttttttttcacttcacaattttttttttaattgaggcagagtctcactctgtcacctagggtggaatgtagtggcataatctcagttcactgcaaccttcgcctcccaggttcaagtgattgtcctgcttcagcctcccgagtagctgggattacaggtgcacgccaccacgcctggctaatttttgtatttttagtacagacggggcttcaccatgttgcccaggcttgtttccaactcctgacctcaagtggtccacacacctcagcctcccaaagtgctgggattacaggcatgagctaccatgcccggcctcacttcacaatttctcttagagctctttctttgttggtacctaaagcaaaagagcttccttgttctttttttctttattttttaacagtggcgtagcattccattgtggtacatcattccgatactaatagacatttatgttatttctagtcttttgctgttataaaaaggtctgcaggctgagttcagtctaatcatatgcaaatagtaatagtttcttccttctccagaaccttttttttgagacggagtctcactctgtcgcccaggctggagtgcagtggcgcaatctcggctcactgcaagctccgcctcccgggttcacgccattctcctgcctcagcctcctgagtagctgggactacaggcgcctgccaccacgcccggctaattttttgtatttttcatagagacggggtttcaccgggttaaccagaatggtctcgatctcctacctcgtgatctgccagccttggcctcccaaagtgctgggattagaagcgtgagccaccgcacccggccggcttttttttttttttttcttttttttttttgagatgaagtctcacacttgtcccccaggctggagtgcgatgacatgatctaggctcaccgcaacctctgcctcccgggttcaagtgattctcctgcctcagcctcccgagtagctgggattacaggcgcctgccaccacacccgactaatttttgtatttttagtagagacaggatttcaccatgttggccagcttggtctcgaactcctgaccttaggtgatccacccacctcggcctcccaaagtgctggaattacaggcgtgagccaccgcacccgggcccatagtctttcttcctataatttccttcctttgttctattgtgacaggtagcaatcaatgattgtaggcatgcttgttttcttcttgatgttagtcatactacttgtagtgataggttttctcttaattttttttttttttgtgagacagggcattgctctgtcacccaggctggcttactgcagcttgacctccgaggctgaagtgatccccctgcctcagcctcctgaatagctgggactacaagcatgtgccaacatccccagctaattttttaattttatttttgtagaggcagggtcttgctatgttgcctaggctggtctcagactcctggactctagtgatcctctcacgtcagcctcccaaagtattgggattacatgtgtgagccactaccccgaccttatttattactattttttagtgcagtgggatgatcatagctcactgtagccttgaacttctgggcttaagcagtcatcccacttcagcttcctgagtagataggaccacagatgcccagctatcttttatttttttgtttttagacggagcctcccactgtcgcccaggctggagtgtagtggcatgatctcggctcactgcaagccccacctcctgggttcaagcgattctcctgcctcagcctcctgagtagctgggactacaggcacacgccaccacactcggctaattttttgtatttttcatagagacagggtttcaccgtgttggccaggatggtctcaatcgcctgacctcgtgagccgcctgcctcagcctcccaaagtgctgggattacaggcatgagccaccgcacccggcctatttttttattttttgtagctttgagagtctcaatatgttgcccaggctggactctaactccagcctcaaatgatcctctcatctcagcctcccaaagtgttgggattaccggcgtgagccactgtgtctggccctgttttaactatttgagccactgtgcccaaccctttttaaatgattaaagcacagataatatcagcgcatgaaatttcatctgcttttccacactcagaagtattacaacaatatgaagatgaagagattgttcaagacttgggaagaatttaaacagatgcagctgccatggttggcctgtgcaggcaggttgattctgaagtgccacccagtggttcaggtgttgtcacctgggtgcttgtggtcaaacctcatcaggaaggggaggctctgtggctctagcagcttcatccttgcttggaggccttggtttcagctttctgatttccctgggctgttcccattcttatgatttttcaagagtctaagagattatttgtgccacgcttgggttctttataagctggcttttgtccaggaagcttatgtttgtctctctgagaagaggtcttccaaaacatgggggcagatggcagattctcgttttgttcacactaaatctctggtattttgtgagaaaaacgagtaaatggtggggaactactctttgagtaaatggtggggacccactcttctctttgattttcccagcattagtcacgtagttggatctggcccaacactagtcacctggttacatcgttcttccttggtcatcctcttacctaaaggaccgggcattgagcttgaggtgggagagtaccacattccctggagatgccagctgtgtattctcctcgtcctgccgcattctgtgggtctcctgcacccaccttggctgattcaggtgtttcccttacacacataccacaggcgagtgttgcatgcaatagcttggattccttttttccacatttaaagttgtcttcccggcacggtggctcatgtctgtaatcccagcaatttgggaggccaaggtgagtgaatcatctgaggtcaggagttcgagagcagcctggtcaacatggcgaaacctcgtctctactaaaaatacaaaaattagctgggtgtggcggcagccacctatagtaccagctactcgggaggctgaggcaggagattcacttgaacccgggagtggagatggcagtgagccgagatcgcgccacttcactctagcctgggcaaaagagcaaaactctgtctcaaaaataaataagtaaataaagttgtcttgatcatagtggtctgtttggtagatgcctgttcagctacagtggtgcagttcatagaaacatactgtgctaggataaagaactgcagtaccactgaagctggttctttgctacgtcttgctttggatttcattttacagttttaaaagcaaacagtgtagtctcatttttgttggactttaaacttaacagcgtatgttcagacagggattgaatatttgctttcagtttggaaaaccttctgttcactgatctgataacgtacatgtttctgaaaccaagaaaagagcagcttgagagcctgaatgctgtgggacatgagcaggcgagccctgccttcctggctcccccgccgtcatccgatgtgtgcacacgtctcgagtaacgtgtgagagctgggcctcacagcttgggccagtacgtgagggagtaacagtggttgggaaattggagcaaaagaacaaagccagaatcagatgaagaccatggagggttggtgggctgttttagaaatgatgatgagattggccatttaccaaatggtgagagagcttctataaattattatttaagaattgctgtaagctagaatcaccacacaagacattttagagaggtgaaaagacatggatcctgttgtcatggagcttaagtccaggctggggtgaccccagctcatcactcctgggctgtgccctgagcgtgtcaaggatgagacatcctgggagttttatacgcctcctctcttgtccatgttaatagtgtgagccatcagcgcttccagacatgctccatgcttaattctgaaggtctgctgcttatgaactttctgtctcttcctatagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaaggtactgtgtttacccagactccactttcactcagcatcccgagtagtgaatctgcactagactaggaagaagaactgatgtgacaggaaaagggggaaaagattgaggccttgatgttagcatcaggtaaatgaggacaagagtgccctgagaatgaaaactttataggataaaatatcttcaaatgaaaacataataatggtggctcacgcctgaatcccagcactttgggaggctgaggcgggtggatcacctgaggtcaggagttcgagaccagcctggccaacatggcaaaacccgtctctactaaaaatacaaaaagtaggccgggcacggtggctcacacctgtaatcccaacactttgggaggccaaggcgggcggatcacaagttcaggagatcgagatcatcctagctaacacagtgaaaccccgtctctactaaaaatacaaaaaattagccgggtgtggttgcgggcgcctatagtcaggagaatggcgtgaacccaggaggcagaggttgcagtgagccgagatcacgccactgcactccagcctgggcgacagagcgagactccgtctcaaaaaaaaaaaaatttacaaaaagtagctgggcgtggtggccagcacctgtagttccagctactcgggaggctgaggcaggagaatcacttgaacctaacaggcagaggttgcagtgagccaaaatcgcaccactgcactccagcctgtgtgacagggcaagactccgtctcagaaaaaagaaaacatagtaaatagatgacacttggtcaggtgcggtggctcacaactgtaatcctagcactttgggaggccaaggcaggaggatcacttgagctcagcctgggcaatacagcaagaccttgtctctgaattacaattgaaaaacaaacaaaaaaacccacttatttctagtgttctgctgtctaaaagactgagtgctttctgggaagctattctgagttaattatggtgatgcattaacatgccacgaatatttgtacaaactagtcgtcctatagtcagctgcctaatttttgtggtttttttcttttgtttttgattttgaggtggggtctcattctgtcacccaggttggagtgcagtggcgcgatgttggctcactgcaatgccctctcatgctcaagtgatcctcccacttcagcctcccaagtggctgggaccacagatgcacaaccatgcccagctaatttttttgtattttggtaaagacagagtttcaccacattggccagggtggtctcgaactcctgagctcaggtgatccgccctcctcggcctcccagagtgctgggattacaggcgtgagacagcacacccggcctaatttttttggtttttttgttttgggcggatcacctgagttcacaagttcgagaccagcccggccaacatggtgaaaccccgtatctgctaaaaatataaaaattagctgggcatggtggcaggcacctgtaatcccagctactcggtaggctgaggcaggagaattgcctgaacctgggaggcagaggttgcagtgagccgagatcataccattgtactcccacctgggtgacagagcaaggctccatctccaaaaaaaaaaaaggtaataacccattttggaaaatataaagaaggaaattaaaatcacccatattttgtctatttaatggtagtaactattttttttttctttcttgagacggagtttcgttcttgttgtccaggctggagtgcagtggcgcgatctcagctcactgcaatctctgcctcctggcttcaagcgattctcctgcctcagtctcccgagtagctgtaagccatccagctaattttgtattttttgtctttaccaaaatacaaaaaattaggtgggtgtggtggcgcatctgtgggcccagctacttgggaggctgaagtgggagaatcacttgagcatgagaaggcatttttgtattttttctttttttagtagagatggggtttctccaggttggtcaggctggtctcgaactcctgacctcaggagatccccccgccttagcctcccaaagtgctgggattacaggcgtgagccaccgtgcctggccataatcaccgttaatagtttattctagtcttatttgttgtacatatgtgtatatatgtgtgtatgcattgaatatagatgtgcatggtcttgttgggattatataaaaaagtctttttttttttttttttgagacagagttttgctgtgtcaaccgaggctggactgcagtggtgcaatcttggctcactgcagcctctgccacccaggttcaaacgattttcctgtctcagtctccctagaattataggcacactccaccagaatcttggctcactgcagcctctgcctcccaggttcaagtgattttcctgtctcagcctcccaagtagctagaactataggcacactccaccacacccagcttatttttgtatttttagtagagatgaggtttgcctcatctctgttcaaggcgtgagccaccacgactggccaatataaaaacatttttctaaagtactggactgataaggtattttattaagtgagtgagttttcttcctaaacgtttttgttctatctggtcttgtgactttatgtttataaaataggaaacaaaatgcgtacctctgttgttacaaaaattaccgcggcgtcttttatatttcacatgcagtttttcacatggtagaaatcgcacagtttcccaaaagctggcagggttgtgggaggaggcggctgtgccccattgcagtgacaccaggggacccttcccacggtgctgctctctgtgccgagggtctgagtgtcgctggatgactcggcgtttcctttctttcttagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcaatttgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactactcttgcacggctgcttgtgaaatgttcttcatctgtagtgacttaaatgtgtttgccaccacaaagcataaacagcgtgcagaggagagtgtgtacctccctgtgtgtaccagtgtgagggaggatttggggacgggggtagagaagatgtaggtgtttatcttaccctccctgcagcgctggagtggctgggggtaaaagcttcccgcctcctgaaattccgaccggccttctgcctacagctgacctcaggaggaacctgccacctgatgttccacacgggcacgtgtgcactcaggtttgtgtggaaagcaaggggggtcgtgttctcaccctgtggaaacaaccctgagagaaacaaccagtgctctttttctacaccagcttccatccacaagttggtccctggacttgacctgttcactaatttttttttttgaggcagagtcttgctcttttgcccaggctggagtacagtggtgtgatcttggcttactgcaacctccactcccaggttcaagtgatttcctgccttagcctccagagtagctgggattacaggcacgcgccaccatgcccagctaatttttgtattttcgtagagacggggtttcgccaggttggccaggctggtctcaaacccccaacctcaagtgatccacccaccttggcctcccaaagtgctgggattacaggcgtgagccactgtgcctggcccaaagtaatttttgagtagtttttttttttttaagtatttgtacttttgagaatctcataggttaacatgtttacaacaatctcttcatcttgtcttctaaatcagccccttctattccagttccaggaatagtcaaccacgccagaaacctgggactcacctggtctccccactcgcctctccctacacctcccgctcattacccagcctcacagggctgtctcctcagtgcctctcctctgttcggacctcactgtccccaccactgctgctgtggcagagagggttgtcagccctgacttcgagaacaatctcttactgattttcctgcttctcatgtcatcccccctccctctgcagggttgtctttgtaaaacaggggaggtcaatttactcactgccttgaaaccctcaagggactcccctttgtcgtgagacaaagctctcagtccttagcctggccagccagggtctccagggtgtggcaggccacgctgccccagggctccggcctgcgctgcgtgtgatgtgggtcctgcagccgagtgcgtgctcgccatccacagctggatctcacctcgaatcctgctttccagtcacactgagaggtctcccactcccatatttgctcactaaaatgcctcctggcagccctcccctgtgcttgtggaaagtcgcaaattgaggatcacatggacccccactcccccaagttgtcctgacagagacctcctgtctttcatttgattgattgattgagacggagttttgttcttcttgcttaggctgctggagtgcagtggcgagatctcggctcaccacaacctccgcctcccaggttcaagcaattctgcctcagcctcctgagtagctgggataacaggcatgcgccaccatgcctggctaattttgtatttttagtagagacgaggtttcactatggtggtcattggtcaggctggtctcgaactcctgacctcaggtgatcaacccacctcagcctcccaaagtgctgggattacaggtgtgagccacagtgcctggcccctcctgtctttcaaaagctctgcccaagaccaccatcatcccacagtggagcctttccttccccaagagaatggcccctttggggtcctcacacacccgtttctgatgtgtctttatttggttatctgccctgctccttctgtaagtccctcggagaaagactcgaattctcccaaactccaacacctcacatggtgtttggtgtttaacagatgattaaatgaatgggcaaaaagtggagggcaaaatctttaaaatgtcttttaagatttaaggattttaggccaggtgcggtggctcacacctgtaatcccagcactttggaatgccgaggcgggcggatcacctgaggttgggaattcgagaccagcctgaccaacatggagaaaccttgtctctactaaaaatacaaaattaggcgtggtagcgcatgcctataatcccagcttcgcgggaggctgaggcaggacaatcgcttgaactcaggaggtggaggttgcagtgagccgagatcacgccattgcactccagcctgggcaacaagagcgaaactctgtctcaaaaagaaaaaaagatttaaggattttaaatgtttgatttttttttcttgttgagatagagtcttgctttgtcgccaggctggagtgtagtggcgtgatctcggctcactgcaacctctgactccctggttcaagggattctcccacctcagcctcccgagtagctgggattacaggcacacgccaccacgcccagctaattttttgtatttttagtagataccgggtttcaccatgttgaccagcatggtctcgatctcctgaccttatgatctgcccacctcagcctcccaaagtgctgggattacaggcgtgagccaccgcgcccggcctgaaaatttttaaatgattgtttgccgactttacaacaggacgatgttgttgttcgcaggccagtaggtggcgctgtggcacgtgatctgagcctcctggattcacacaactgttcatgtggagaacccagtgccgggacccattagcaccccagtcaggctatgcgtctccctcccaagggtgctcacctggtgtggccttcatggcacagggggagtgagatgaggctcctttagtacaccctcccctgagaagagcgacgtgtgcttaccctccagtggcttgttctcatgaaaggctccacagttagggaccttcagatgcttagatctggggtgtcacctgactcaagcagctcagaatcccagattgttgtggtgggtcaagggcatggggctttgggtttactggcctgggtctgaatgccagcattgcctcttccttggtgtataggaccttgggtggttacttttcctaggcctctgtttacttgttttaaaatggacagtgatgcctactttatagggttgttatgaaactcaactaatgaatataaaatactcgacccagactggcatggtggttcacgcctgtaatcccaacactgggaggccaaggtgggaggatctcttgagcccaggagttcaagaccagcctgggcaacttagggagaccccgtctctaccaaaaataaaaaaattagccaggtatagtggtgtgtgcctgtagtactagctacccgggaggcagaggtgaaaggatcgcttcagcccagaagttcaagactgcaatgagccgtgatcatgccaccgcactccagcctgggtgacagatcaaggccctgtctcaaaaaataaattaacaggtcgggcgcagtggctcacgcctgtaatcccagcactttgggaggctgaggcaggaggatcgcttgagcccaggagttcaagacaagcctgggcaacttagggagaccccgtctctaccaaaaataaaaaaattagccaggtagagtggtacgtgcctatagttccagttacccgggaggctgaggtgaaaggatcgcttcagcccagaagttcaagactgcaatgagccctgatcgcgccactgcactccagcctgggtgacagatcaaggccctgtctcaaaaaataattaattaaatacttgacccattgcacgatctttccatgcacgacagctgctcttctattattcttccaggatgagctgcacagcctgcccccttgggtttccaggttgtgggagatgagcaaaactgaatgacctcagtaggccaagagcaaaggatgtgggtccggacctggtggccagttgcttgtgacaggagctgggctggagtccccaagtgccactagtgctgacatcttttaactgtgttcattgtgacttgtttatttctaaaagtaaccactggcgccttggtgcagatggaactccaggtgcatgcggtgagttaaccatggtctggggagctttgtttccacgcctaggacatgcatctgtgtgcatgatatgtgagctgatatagccatgcctctggtgatttgaacgcctgcgcttcccagctgcttcagggccctgaacatcgctggatgtttgtacttcattccctcctcagcccagctggtcccactccgcagctgtgctctaggcatttcatctcaactgggtgatatatttgaatacagcaattataagaacagcaacctcagaagaacatctggcatccagacctccccagcctagttccacaaggtaccaacttccgtaagccttgaagagctaagtaagacatccgggccgggtgcggtggctaatgcctgtaatcccagcactttggaaggccaaggcgggcagatcacttgaggtcaggagttcaaaaccagtctggccaacatggtgaaacgccatctctactaaaaatacaaaaattagccgggtgtggtagtgcatatctataatcccagctacttgagaggctgaaggaggagaatctcttgaacccgggaggcagaggttgcagtgagccaaggccacaccactgcactccagcctgggcaacagatcccttggtatagatacggggagcttgggtggtctcatcacagcagaacctcagctcttggcatgttctttcctttgctaccagcttttgaaactgaagtgtagcagagtcatgaaccagactttgaaacatgaaccagacagagaaacattttaagaagtagcggctgaccaggagttggagattgcagtgcactatgattgcacctatgaatagccactgcactccagcctgggcaacatagtgagacccctatctaaaaaaaaagaaaaagaagggccaggcacggtggctcatgattgtaatcccagcactttgggaggccaaggcaggtggatcacaaggtcagatcaagaccatcctggctcacacagtgaaaccccttctctactaaagatacaaaaaattagcctggtgtggtggtgggcgcctgtagtcccggctactcgggaagctgaggcaggagaatggtgtaaacccgggaggcggagccgggcgcggtggctcacaactgtaatgccagcgctttgggaggccaaggcaggaggatcgcttgagcccaggagttttagaccagcctagacaacatggcaagaccccgtctctaccaaaaatacaaaaaattagccgggcatggtggtgcatgcccatagtcccaactacctgggacgctgaggtgggaggatcacctgaaccccggagccgtgagcacaccactgtactccagcctgggtgacagagtgagaccctgtctggaaaaaaaaaaaaagtagctgggtatggtggcacgtgcctatcgtcctacctgctcaggaggctgaggcatgaggatggcttgagcccaggaattcgaggctactcagcaattatggtaccactgcactccagcctgggtgacaaagtgagaccctcaaataaaacaaaataaattggccataaatgtaagagttttttcctgtattgttcattctgttccttgatctatatgtcttgtcctttttccatatcttatagatgtgattactagaagtttcatagcaagttttgaaatcaggtagtatacattctccagttttattctttttcaaatgtgttttggttattctaattcctttgcgtttccatgcaaattttaagatccagttttcaaattttttttgagatggatcttgctatattgcccaggctggtctcaaactccagggctcaagggatcctcttgcctcagtctcccaaatagctgggattacaggcacatgccaccaaacctggcctctcaattgctttaaaatacaacaacaacaaaaatcttttggaagtttgatgggcattgcattgaattaatagacaaatttggggagaattaccatctatcttaacaatattgagtcttcccctggccaacatggtgaaatctgtctctactaaaaatacaaaaactggccaggtgcagtggctcatgcctgtaatttcagcactttgggaggccaaggtgggtggctcacttgaggtcaggagttcaagacctgcctggccaacatggtgaaaccatgtctctactaaaaatacaaaaattagccgggtgtggtggcgggcgcctgtgatccaagctacttgggaggctgaggcaggagaatcacttaaaccgaaggggtggaagttgcagtgagcccagatcgcgccactgaactccagcctcagtgacagagtgagactctgtctcaaaaaaaaaaaaaaaaaaagaaaagaaaaaaaaagaaattagctggacatggtggcaggtgcttgtaatctcagctacatgggaggctgaggcaggagaatcacttgaacccaggaggcggaggttgcagtaggaagagatcacgccactgcactccagcctggacgacagagcaagactcagtctcaaaaaacaaacaataaaacaatattgagtcttctattccatgaaggtgaaatgtctatgcatttttttagatctttagtttctctcagcaatgttgttttacagttttatgtgtatggattttcttttttttttttttttttttgagaatgagtcactctgtcgcctagtctggagtgcagtggctcaatctcggctcactgtaacctccgcctcccgggttcaagcaattctcctgcctcagcctcctgagtagagtagctgggattacagttgcccaccaccacgcctggctaattttttgtatttttagtagagatgaggtttcaccatgttggccaggctggtcttgaactcctgacctcaagcaatccatctgcctcggtctcggaaagtgctgggattacagatgtcagccactgtgcctggccatgtgtggaactgtttcctcaatttcattttcagattgtttattgccaatgtgtagaaatgcagtggattttggtatgttaattttgtattctgagacctttattctagtagggtttttttttttttatacattcctttggattttctacagtagaattatgtcatctgcaaatgaagatagttttacttctttcttttcagtgtggatgcctttaatgtctttttcttaacttattgcacaaattgcgcattcaatagtacaatgtttagtgggaccggtgagaaaagacatccttgccttgttttgatcttagggaggaaagtctttggtctcactgttaagtgtgatattagctgtacgttttgcgtaagggctgtattcgtttgctaggactgccatacaaggtaccacacactgggtggcttaaaaaacagaatgtattttctcagagttctggaggcataaaggccaggatcaaggtgccggggggttggttccctctgaggacctctctccttggcttgtctacagccgccttctccctatgtcttcacaggatcttccctctgtgtgtctcttcttataatgaggccagtcagactggatcaggacccaccccagtgacctcatttaactttaattacctctttaaagaccctatctctaaatacagtgacacggaggtaatggaggtaggacttcaacatactaatttggggctggttgtggtggctcacgcctataatcccagcagatgacttgagctttgagaccagcctgggcaacatggggaaggcccatctctactaaaaatacaaaaattacctggcatggtggcgcacacccacagtccagctactcaggagcttgaggtaggaggatggcttgagcctgggatgtggaggtcaaagccccaggagcagaggtcacagtgaaccaaaattgtgccactgcattccagctgggcaacagagccagacttcgtctcaagaaaaatttaaaaatcaaatagacatgatttttttttagacagagtctcattctgttgcccagcctggagtgcagtggtgtgatctcagctcactgcaacctctgtctcctgggctcaagtgattctcatgcctcagcctcccaagtagctgggattacaggtgtgtgccaccatacccagctaatttttgtatttttagtagagacgggattttgccatgttggccaggctggtctcaaactcctgacctcaggtgatccgcccacctcagcctcccaaagtgctggtactacaggcatgagccactgcacctggcctaatttttttttttttcttgagacagaatcttggtctgttacccaggctggtgtgtagtggcacgattacagctcactgcagccttgacctccctggctcaggctatcctcccacctcagcctcccaggtaggtgggactatggacacgtgctaccacgcccagctaattttttgtattttttttagagacggggtttcaccatgctgcccaggcaggtctcaaactcctgagatcaagcagtccacccagcttggcctcccaaagtgctgggattataggtgtgagtgagctactacgcctggcctggacatgtaatttttaaaagaaaatgtggccacaactctcctagagttaaatgttttttttgtttgtttgtttgtttgttttttgagaccatcaacaagatttcaaggctttaaagaaaggagctgcttcaggaagagataaaatgactcaaacgctataaccttcaaatgtagactgggagaagaggtatcagctatgcatgagctggagaggggtgggatagatagagacacaggtgataaagaaaatatagcaaaatgtgaatcctacaatctgggtggtggatgtaaaccctgtagtagcctcacctggggaaagctgccttgcaacaatgaggctgcccattctccaaacccaccccagccaccgagcaggctccactaaaaagtctgaacccaggagggagtaccatggaaaccaagttgcaatgccctggttaggggcccagcagaggggtcatcccagctctacgccattggatactgagtttcaggagtgggagtgccatcctcagggtcacacagcgtgtcggttccagcctaggtcttccagtgtctcattaatcttttatccactcagcttctcttctggcccatgaaccttgctctcctgggactcttttttttttttttgaggggtcgggggtgggacagagtctcgctctgttgcccaggatggagtgcagtggtgccatcttgcttcactgcaacctccgcctcccagattcaagcaattctcctgcctcagcctaccgagtagctgggactacaggcacccaccaccctgcccagataatttttgtatttttagtagagacaggatttcaccatgttggccaggctggtctcgagctcctgacctcaagtgatccgcctgccttggcctcccaaagttctgggattacaggcgtgagccatcacacccggcctgggactcttcttgcagtgagccagggccatgggacccttcaaaagttgctccaccctaatccccaaaatatctttttctcccgcctgtcccaagtgcctggcatcatactatatgggtcaactggccatgtttgccatggaagcccaattgtaggaagtgggtcttttatcacccggcatagcagagctgtggaaactgcactgggaaagatcaggatgtgaattaaagcgttgggaatgggaaggcagagaccttggattagctgggatgctccatgcactcgctgagtgaccttggacaagccccttagacacactaagcccgtttcctcatctacacgacgggcatcccatctgctactgcaccaggttcttgtggcaataacttgaactcacacatgcaaacaggctttgtgagctccataaacacaggtggctcggccaggtgtggtggctcatgcctgcaaccccagcactttgggaggccaaggtgggaagatcccttgagcccaggagttggagaccagcctgggcaagacgatgaaatcctgtctctaccaaaaaaaataataataattagccaggcatggtggcacacacctggtcccagctccttgggaggctgaggtgggaggatcacttgggcccaagaggtcaaggctgcagtgagctgagattataacactccaacctgagtggcagagtgaaactgtctaaaaaataaaaataaaaatacatcaaaaaacaggtagctattaagcattgctaggacccacacgcagtgaccctgagggtgctgggtttctgtttgagggagaagaaactcctgagcccctaggtattgtgggggacatgcagttccagaccgccttcatggcctgtatgcctggcctcatccccatccctggcacccatgacgatagccacattccactggtgtttccccaggaaagccaaccctacctgcatctcagcagagcttccacggagttggaaccccgctccgagagggtgtgggctcaggggccaggggtcacacaaactccagaaggaggacgtagttggtttgcaaggctgtcctttgccctggttgaataacctttggtcttccccgagaggaacgtgggcattaggctgcagcccacaggaagctatgtattttctgagaaacttggcccatggtgcagatctgctccagctcactctggtgggatcacgccagccacggccgggccacggcacatcatggcaacgtgctgcccacctgctacgccacctgtttttctagaggcggacgtgatcccagcaggactggagtcagcccagggcatcacgtgctctggtccccgcctgctttgactcctcctgcctcactccccccctggcctgtagtcacgttggtgagggtggtgggcaccggggctgggcccagcccccgaccctgcccagacagactttcctaaggcacccttttcctcgtgcaggtgcggcctcagcccacccccctttgagcccacagattgcacccctctggtgtgcggttacctcttgcctatgtttaattcatggctggggggttgggacgagcttcccaagaaaggaaagaactcccctggggtcttgcccagtttctgctcaccagaaggaccatagccgaggtcctcctcccagggcccggggctggggagcggaagccatcagtgggctcggaggacactgtcccagccaggacacggccatcggtcactaatctgcagcactggaatgtccgcaggccaatcagcggggtctctgggggctccccaagggtgctaataatcccacaatgattagcaggggccgcgggtcagtgcacgccactctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggaggtaagggacacctggtgaggaggtaggtggaggcaccattatgagctctgaggagtgggtgctaggagacttctggaagcccggtcccaggcctgagccccaggccgtgcgggtggtttaatgaggaagccctgggacagcccgggggcggtgaggggtggatgctggactggggaggaaggaggaggaaggaggaccagggctggggtcaaggaggaacgccgaggagcgctgtggctggggcctggagaaatccgtggcccggaggagccccagacaggggcctgcgggagccagggctggcccctacacccagcccgcaccgctgttccctcccgccaccccaaccccagcactcagcccacgcctgctgtacctggtctctctctcagcctcgctccattgctatgccccacgtcccctgcacccaccacactcctctcccatcttgttttccaagggcagggacacatgcttattctgccgtgtgttgggttcaggtccccccatcctcgggctgcctgaccttctctctccaccccagccctgaacaggaaggagagtttcttgctcctctccctgcacaaccgcctgcgcagctgggtccagccccctgcggctgacatgcggaggctggtgagtacccgacccagctgggctctgccaggggggtggccggaggcgcggaccccagagggcggctcaggaggccacgcctgtccaggtgcccttccacttgaccagggtgggcaggcacagccagccaccttgcccctgagggacggaggccctggttgctgggggtctctgcagtttcttaaccccccaccctcagttcaggaggtcgggccccttggctcccactcgcctgaagggcaggaccttgggccttccctggcatcttgttgccacagagaccaggagccacaggaggagccggatcccctcctccagggaaggggagcttcacgaggagccctgcaggatgggcggccgggccagggagggagaaggtcgtgctgggctggggaggggcttctgtgcggcaaggacccagcgcctcctcctgagcttatctgagccacgaggacgggccttgcccatgttctctgctcactcactcgtccacattttccacattttcagcaggggccgggggtcgggggtatagagttccccaccagcccggctggggctgcggggttgggactgtcatctggaggctcagaaacgctgccctccattgtctgggaccccagcagccccagcccatgttagcaggccagggagccagggcagggtggtgggggcgggagggttccccatggctgcttcccatgaactcctccaaggcaggtggccacagtggcgaccttgagcactctagggtcagtttcccaggaggtgggggtggggtggctaaatgcggggggtcgcttctcccccattcccagccctgagtggctctgcctctcctcaggctcagaccctgggcaaccaggggtgctcccagctgtgacctccgtggttgggtactcctgcctgggaccccaggaggggctgcggtggtcgttggctggcagctggcaccctttccagggcccttttgtcaaagtcttagaaaacttcatttccataaaggtgcaaatggagctccatggctcagcctccctcgtggcccggccccgagcaccctccgggcctctagggctccagggcaccccttctttggacacagtggagactgaaggtcttgtgggggtggagggctgctgagggaccccggggagcccccagctcctggccccagccttcatcagaggtaaaaccccgatggacattagtgcaggatgaagttggcttggggtgcagccccgaggggcccccctccctgcatccactcagtgcttgtgagtcctatcctgcaggcacctccctgctccgtttacagatgagctcagggagtctcgggagatcaggggactgcaccaagtcacccaggggtggtgattgccaggcccacttgtttaagaagagggagggggctgggcacggtggctcacacctgtaatcccagcactctgggaggctgacacaagcagatcacctaaggtcagcagtttgagaccagcaatggccaacatggtgaaaccccgtctctactaaaaatacaaaaattagccaggtgtggtgtcacatggctgtaatcccagctgcttgggaggctgaggcaggagaattgcttgaacctgggaggcggaggttgcagtaagccgggatttctccactgcactccagcctgggcgacagggtgagactctgtctcaaaaaaaaaaagaagagggagggggcggggtcagctgtgcgtggtggggagcatatgaggccaggctcctgggggcaggagactagggcagagaggcgtggctgtagggctttttgcatcacaggagggcagcatggccgggtgggagcagtggagcctttctgacaatggccagggcccaaacacagaaccagtctgcaacgcgtgggcactgctcacatgaccagatgggagaaagacagcaggagcgggtcccactgcctgggcagggccgaaggatgcccacgacaggatttggagatggaggctcagtcgtgagaggagctgggctcctcctggagggacatcagacaacaccagtgcttcctccagcaggactcctcatccagtgctctctttgccacctgacctggcacccggtggatgctcagagatggcaggggagttgaatctttgaggcctggcccagcagtcaaaggcctcccacagatgtctgtttgtgctgcccccaggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcaggtgagtgtgctgcaggtgaggccagcgtgccagctcccagatacagacttccactggtccatctcagaagaggctacagtttgtcctaaatgttgggattccttttcctccaattggtttagttttactttttttttttttgatacggagtcttgctgtgttgcgcaggctagagtgcagtggcgtgatctcggctcactgcaacctccgcctcctggactcaagtgattcttgtacttcagcctcctgactagctgggactacaggcatgtgccaccaggcctggctaatggctttatacttttagtagagatagggttttaccatgttggccaggttggtcttgaactcctggcctcaagtgatccacccacctcagcctcccaaagtgctgggattacaggcgtgagccactgtgccccgccacattttttctttttttggagacatggtctcagtctgtcaccccaggctggagtgcagtggcgtgatctcagcttactgcaacctccgtctcctagattcaagcgattcttgtgcctcagcctcacaagtagctgggattacaggtgtgcgcctctacacccagctcatttttttgtatttttagtagagacagggtttcaccatgttggccaggctggtctcgaactcctgacctcaaatgatctgcctgcctcagcctcccaaagtgctggggttacaggcgtgagccaccatgcctggcctaagccactttttttcaatctgaaatataaataatttcaaacataaacgtatttatttatttatttgagacgaagtcttgttctgtcacccaggatggagtgcaatggcttgatctcggttcactagaacctctgcctcccagattcaggtgactgtcctgcctcagcctcccaagtagctaggactacaggcacgagccaccacaccccactaatttttgtatttttagtagagatagggtttcaccatgttggccaggctgggtctcaaactcctgacctcaagtgatccacctgcgtgggcctcccaaagtgctgggattacacgtgtgagacaccgcacccagcctcaaacgtaaatttaaaacggccccactcttacccactacctaggtttagaagatgctactaaactaaagccctgctcctccccttttcccgctgtccctccctggagggaatcttcccaaagttcaggagcatcactgccaagcaagtttccattttttctcttcattcaacaaatatttgttgagggtcttctacacacacctggtgctcttcagatgcactgaaaaacacaagcaaaatcccaggaaatatttaatacctccactacctgtgcaagtgggttgtgcatgtttaaatattacacaaggctgggtgcggtggctcacgcccgtaatcccagcactttgggaggccaaggtggcaggattgcctgagcccgggagttcgagaccagcctgggccacatggaaaaaacctgcctctacaaaaaaatacataaattacccaggtgtgatggtgtgcgcctgtagttccagctacttgggaggctgaggtaggagaattgctggagcctgggaggtgaagattgcagtgagctgagactgcgccattgcactccagcctgggcagcaggagtaaaaccctggcttagtaaaaagaagaacatgtgcccctacaactaggtgctgccaaagtgcttacgccaactgtgcagaccagcaaaccagttcccacttcccgaagatcttctggctccttaatttttttttttttttttgagacggagtcttgctctgtcgcgcaggctactgtgcagtggcgcgatctcggctcactgcaagctccgcctcctgggttcacaccattctcctgcctcagcctccctagtagctgggactgcaggcacacgccaccacacccggttatttttttgtattttgtttagtagagacagggtttcaccgtattagccagggtggtcttgatctcctgacctcatgatccgcctgcctcggcctcccagagtgctgggattacaggtgtgagccactgtgcccagccttggctccttaagttttgtcagactcaaaggtgtgaaaaacctaactctgttttgttgttggtggttgttttttgtttgttttgtttttgtttttgttttttcgattcagagtcttgctctgttgcccaggccagagtgcagtggtgcgatcacagctcactacaacctccgcctccccagttcaagagattctcctgcgtcagcctcctgagtagctgggattacaggcgcctgccaccacacctggctaatttttgtatttttagtactcctgacgtcaggtaatccacctgcctcggcctcccaaactgttgggattacaggcttgagccaccacgcccagcctctattattgtttctaattttcttgatgtgaatgtttagatcattaattttaaatcattttttgtttctactatatacatttaaagctataaatttccctttaaacgatttcagctgcatccaataagttttgatgttttttctatttccaatcatgatgttgtttttgtttgttttgagacatggtctggctctgtcgcccaggctggagtgcagtggtgcaatctcagctcactgcagcctcaatttcctgggctcaggtgatcttctcacctcaggtccggagtagctgggactacaggtgtgtgccaccatgcctggctaattttttgtatttgtaatagagatggggttttgccatgttggccaggctgatcttgaacttctgaactcacatgatccacccaactcagcctcccaaagtgctgggattacagatgtgaaccaccacacctggccatgatgttgttttagattttgaagtgtatctttaagtttctaaactatgttatcttctctatttacttgtaaattatttactttaaatttcattgcattgaattcatagaatgtgggctgtaggatgtgctgattctttgctatttgttgaaacttgcttagtggtctaatgtatggtcctcctttctggtttgcaaaagtcccatgcattcctaaaaacgatacatattctttaagtgttggatacatgtatatgatcacatgttcacatctgcctgctacaagccagtcttgtacatgtcatttttagtctctactggagagtttgtttcactcttcttatatattgcccatttgtgctatttccaagctgttgctgattctaagactttaaactggtttgcagacctgtatccattaggttttattgcatgacatactaccccaaaatttagcagcttacgattctgcaggtcagccacttgggttgggctcagcagggaggttttctggtcttggctgggcccactcatacacctgcaatcaactagggggccggctgggagctggctgtgcaaaaaggcctctaatggttcatctctgttccatgaggccttccaaactcctatactgagtttgttcatgtggtgactgagcatggttctatgagaatgagtggaaatggcaaggtctcttaaggcctaggttcaaaatcggctcagtatcacttctgtggcattctggtggccaaaccagttacagagccagccagattcaaggagcaaggaaagagacacctctctttgctgcaaaaagctgcagagtcacatttaaaggagtggcctggtgcaagaaatgaatggttgtggtcaccatgcagtcacaaggcccttgatgttccagtctttttttggctactcccctccacccatcaacaatctcccctcatttcaggtacctcccctctccatccccctctcaactaagaaagccttcctaggccgggcacggtggctcacacctataatcccagcactttgggaggccgaggcaagcagttcacctgaggttgggagttcaagaccagcctgaccaacatggagaagccctgtcgctactaaaaatacaaaaaaattaaccgggcctgtaatcctagctactcgggaggctgaggcaggagaatcacatgaacccaggaggtagaggttgtggtgagccaagatcaggccattgcactccagcctgggcaacaagagcaaaactccatctcaaaaataaataaataaataaataaataaataaataaataagccttcctgaactattcccacccatgcttctacccctgcccaggacagctgctgctcctgagccctcgaggaggtaagggagccctctgttcacctggatgatagcgaaagctgtgtccccctccccaggggtggttcacaatagggtttctgatcccctgtgtctcctgtagctcgtgtgggccacctcaagccagctgggctgtgggcggcacctgtgctctgcaggccaggcagcgatagaagcctttgtctgtgcctactcccccaggtaagccctgctacaccctctgctgggatgtctgggagacagggaggggtgctttcaccgagggtgagattcccacacatccacccgaaagtagagtccctgatgccttgctctgcacccttggtgggagaggggaggagaggaaaggcagagggtgctaaagattctggccacgcagaaggtgctgctctgcggatgtcccttcctggatactggtcctggtatcagggagtttgtccaggattggtttggaggccatctcttctctcccagggaatctccctatctcacccagctccctgactccctggcctggccgcaggagctgaaggggccaggggggcaggcagcagggccctgcctctgccttgcccaaggccaggccctcccacaccctgtggtgcctgctcgtcctcacagaggcaactgggaggtcaacgggaagacaatcgtcccctataagaagggtgcctggtgttcgctctgcacagccagtgtctcaggctgcttcaaagcctgggaccatgcaggggggctctgtggtgagtgcatgagggctcagtctggtgaccctggggtgggggtggtagcatcctactgggctgtcccagaagccctggcccttagcacccagggaggctcctgcccggcctgctgggaggagacccttttctcagagtcccctcctcctctgaccagaggtccccaggaatccttgtcgcatgagctgccagaaccatggacgtctcaacatcagcacctgccactgccactgtccccctggctacacgggcagatactgccaaggtgagggcactggagcctgggtgtgcccagccctgctctcgtggcaggtcctagggctgctacacttcctgagagtctcaagggtgtcagaggtgctgactgtgtactccctgagtctgcccactgcatacattctttcaacaagcattcactgagcactagctgtttgccagaccctgagctgtgcaggagattcaaagtgaaatcaggttcagccccttaggctctgggaggaggacagaattaggacccagaagtggattcttgccctactgcccctctaccctaacccactctgtgaccatgggcaggtcacctcccaaactccaatatgcctcactctgcaatggggaccaaaccaaagacaccaggcgtgccagcaatcggaagccttggtgggttctgtctatgggaggggtattcttgctgtggttggcattccctggatgttcgaggcctctggggggcagcgtggggtccagaaggctgggggctgagcctctgccccactgccctgccctggcagtgaggtgcagcctgcagtgtgtgcacggccggttccgggaggaggagtgctcgtgcgtctgtgacatcggctacgggggagcccagtgtgccagtgagtcctgccccagggcccccaaagagccagctcctctcaagaccccccttcaatggggcatcagctcccaggagcccgctgtgtgcctctctttccaactcattcagtgacaacacgttgagatcttgaaactggccacagcatggatatttacaccaaagaaattggcaaatgctataaaccatggatttttttttttcttttgagagagagcaagctcaatattccaacttaccagctcgctcctgaccctcaccacccactcttttggagcaggtggccagaggaaggggcaccctgagcttagctccccggcagggcaggaaagggcagggattctgaagtccacacacaaactcaggctcccctaccccagccaaggtgcattttcccttccacacctgtgacctgaggatcgacggagactgcttcatggtgtcttcagaggcagacacctattacagagccaggatgaaatgtcaggtgacagtcacccctagcttcctaggaaccccctagggcctcaagtgagggtcttaatgcagggaccctggagtgagaggtggttccttccacgtctctgacctcaccctattcatcagcataaagcaggggtcgtggactccaaggctcatagaagccaggaggtcacttattgacctgaggggccaaggtcaagaccaacctccatctaagggagttccagccactggttgccttgcaggaatgcaaggtcagggtggccagagctcggggttgttcaagaaaaccagcaacccagacttccactggcaactctcgaaaccacaattaattactggggttggcaatcaacttggatatatttaagacactgtgcaggtgaaacagaacctcctcaggggccagaccttgcctgggcttgtgggctgctggtcgcgcccccgtgcacagggagaagagaagcagacgggagcagaagggacccctgctcttggaagggaggctgtgcgggctgggggtgatgatagcccggccagcacacacacgtggcatcttaggccatgggcaggggtggcaggaaggggcagcctgggctctgggagccttgcctgtgtgacccagggtggggttacagaggaaaggcggggtgctggcccagatcaagagccagaaagtgcaggacatcctcgccttctatctgggccgcctggagaccaccaacgaggtgattgacagtgacttcgagaccaggaacttctggatcggtgagtgcccagctgattgggggtatggcgagtaaggggttgtgatgccccaccctgctgcaggaaccctgggccatggcggctgccagcagatggcaagggtgtgttgagggcctggagcccagagcggggccagctgctcaccccctttcccgggaagggcccaggtagggagcacatgggggctgccagcgctgggaagaggggccagaaaggcagctggcagcagactccagggtctgagtgggccaaccttgactaccccggcccagggctcacctacaagaccgccaaggactccttccgctgggccacaggggagcaccaggccttcaccagttttgcctttgggcagcctgacaaccacgggtaagtgtggggtgcctccctcccctgggcctccttctcacttgggcctgcctggtggagccccccatcccgctgcctggctgggccctttgagggtctgatccttccctggtgcctgcccaggtgccagagagttgtgggcacagctggtgtgggccggtggtggggtgagggagatgcaagccggaaggcacgtcacgtgggggagagagggacccaggaagcctccatccatctgtccatccccagtgtcccctggtgtgactccatccctccaattctcatccactcacccctccgtctgcatgccctctgcctgcatcagttacactgatgccagcattccttagctgtcacccacctgcactcattcacaatacaaccctgcacctgcagacccaccagccatcctgtagcaagaaccctctggtcacgtggccccaccctgctcttcaaagcccagcaatgcccagggccagggtggaggtggtccggctgcgaggccaccaagggctccagcgatttcagccagccctccttgccaacagccggcctgtgcccctggcctcttgcctggaggaagtctgggccttgttgggttcccaggtgtacctctcaagtgggctgtctattccagtccccaccatccccacaggctggtgtggctgagtgctgccatggggtaggcagagctgttaccccaggaaggggcttccctgagaagtggagcagggctgggggcttggggacgggcctggctcccggcagccccgtcggcaggtgggggcactggagcccctgagatgcagggtcctgatgggtggagggcttaggcctctcccggatccctgacttcactcttgcctcctgaccaccacaccatggcctgcaggtttggcaactgcgtggagctgcaggcttcagctgccttcaactggaacaaccagcgctgcaaaacccgaaaccgttacatctgccagtttggtgagggacttcctgaggctccccttctctgatctctgaccctgggggtgctgctgacccggtccagcctgcaagggtatctaggtggcaggttcagagtgggtctgggcacacggggccatagaggatgccctgttgatggccttgtacctgtgggctcctgagcccagaggggcaacgacgggcccagcttcatacagcaaggccacgcaggaaggactagagctacagctctgcaggggatttctccaaggaccctctcctgtcatgaaagctgctgcctgggaacctgttgggttccttggtgttcccgggagccccatgaactgtggtggaggcggaggtgaaacctagcatggcaccagctcccagcagcctctgctaggaaggcctggagcgccacagggaccacggccatgggcacttccagaccgagtgcaacagggctgccatcttgggactgcctgggctgccatcgagccctgctctcttctgcttccttccagcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcagacatcacccacaaggggttatcactgtcccagtttacagcggaagaaatgaaggcagagagattgagtaacttgcataagatcatacagctgggagtcaaacccagtgagtctggctgtcatttatttattttttttcttttcttttcttttttttttttttttttttttttttgagacggagtctcgctctgtcgcccaggctggagtgcagtggcacgatctccgctcactgcaaactccgcctcccaggttcacgccattgtcctgcctcagcctcccgagtagctgggactacagacgcccgccaccacgcccggctaatttgttttttgtatttttagtagagacggggtttcaccgtgttacccaggatggtatcgatctcccgacctcgtgatccacccgcctcggcctcccaaagtgctgggatgacaggcgtgagccaccgctcccggccctatttttttcttttttgagacagagtctcgctttgtcgtacaggctggagtgcaggggtgcaattggggttcactgcagcctcgaactcccaggctcaagcgatcctcctgcctcagccacccaagtagctggaaccacaggtccgcaccaccacgccccgctattttttgtgttttttgtagggacggggttgcaccatgttgctcaggctggtctcgaactcccgtgctcaagcgatccgccatcctgggcctcccaaagtgctggggttacaggcatgcggcccggcgccggcccagtctttccctctcccactgcttcccagggcttcgcctgtctaaccgggcgcgggcagttgtcctgtgtcctggctcagcgcggacctacgcggggtggtcacacagatgcccccagctctctctacctcccgcgaaggcgctgagccccctgatccctgcccgggcactggcgcaaggtcgcctgcgagcgccaggccttcctgcccggtgggagacgggagggcccgctctccggctcggtctggttcccgggtcagccagcagccgcgcctcttcctcccagacccgggacccgccccttggccggggccgcggccgcagcgcccggaggggccgccctgcgcatgcccgcgggaggtgggtgacccgggagcgcgctgcccgaggccggggggcggtggggacagcacaggcggggcggccgaaccgagaccttcccaccccgccccacgcctggttggggacctgacgcgccgtcgtgagtggggcgggtgcaggtgtccctgggggccgggggcagacactggtgcgggacgacctgctcccgagggggtccgcaggccacacccagagaaactggggcgcctccagtcaccgccgcggtccgccccgccggaggctttgaccccctgaatcagcgtcggggcagggatccgcgtggggtggaagaggctgggaaacttgggagtcccgggcctcctctggagccgcccgcccttggctggctggtccttctcttcctcggctcccgccgggctgggccctgggccgccctcactccctcccctctgcagcctcccttgcgtttgtcattcactctgccaggctctccttctgcctccgcatgcccaacgatccggagaaaaacacggaccatgacatcaaaaggccttggccaaggaatcgtgattattgtgatacaagattctgcacctcaaaggggatccctgtagtgagttttggaaaacgtacaaagcctgacttacaatatgcctgttatctgtggcgtttcatctggggaacttacttttccttgatagggtaaactattctcatccagagtatgtccctcagtctgtaaaagtccatggtgccctacatctattaggggagtgaggaagggcagtgggcattggatctgcttctttgaaagcccccacctgtgtttagcttctgttagaggcctttgaaccagagcaactccatcttgagtaggcgctgggtaaaatgaggctgagacctactgggctgtgttcccaggtggtggaggcattctaagtcacaggatgagatgagaggccggcacaagcagtaaagaagccgcggccaaaacccaccaaaaccaagatggtgatgcgaatgacctctggtcgtcctcactgctacactcccaccagcgccaagacagcttacaaatgccatggcaacgccagaatgttaccctatatggtctaaaaaggggaggcatgaataatccaccccttctttagcatataatcaataaataaccataaaaatgagcaaccagcagccctcggggctgctctatggagtagccattgttttatttctttactttttttttttttttgagagggagtcttgctcttgctcaggctggagtgcagtggcgtgatctcggctcactgcaatctccgtctcctgggttcaagcgattctcctgcctcagctttcgagtggctgggactacaggtgcccaccaccatgccggctttttttttttttgtacttttaatagagacggggtttcaccacgatggccagggtggtctcgaactcctgtcctcagatgatctgcctgccttggcctcccaaagtgctgggattatatgcgtgagccaccgcgcccagccctattcctttactttttttttttgaggtggagtctcacacctggcctccaatatgtttattcatattgctgaggcaggggattgcttgagcccaagagtttgaggttgcagtgaaccatgatcataagctgtatttcagcgtgagtgagagattgagaccttgtctcacaaaataaaagttaaaaagcccttatctggaggtgagaaagccaaatacaaaggtcttctcagttggttcccagtcttcccagtccagcagcctcagcatcaccagggagctggttaggcaaattctcggcggccccaacctactgaattggagaccctgaagatggggctatctgaattttaacaaggcctccaggtttgcatgctcaagattgagaaccactggcaaaagcaaacaatttgaatctgaagtcagcccacctgcatttgaatacaggccctgccacttaataactgtgatttagagcaagttagttacttaacagctaggttgaccaattgtccgagtttgcctggcactatcctgatttcagcactgaaagtactacattatcgctgtggctcacgcctataatcccagcttctcaagctgtccctgtggaatcctcaatatcggtacattcatccctatctagcatccccttcctccctcacccatcctgcaccctcagaattcattctcagatcagcttcccagatttttgccaatatcaattaaaaaaattttttagccaaccatgtactgtgagtaagccaatatcaattagcaaaatctttaagtttcttttggtgattcagtatcttccccctggagttttttgatgattcagtaccctcctagatttggcccctggggcctgcggggatgtgacttgtcatttaattctggagaaaatgaggggtagggcttataaggagactccttcggggcagggtcattacagggtgtgttacatagggaaatgctagctgctggctagctctcgctcttgaaaggctcttcctccctcaactgaaatggggaagggggaaccccggccgactgaggtcctgacatctttagcacatggcttcttaggtcacccagggcatccaggttaccagcttgggaaacaggagatgtaggttggaggaagaggctacagcccaccctggaaataactgccatccgtcccacccatatggttaggctttgtgtccccacccagatctcatctcgaattacaatccccacgggttgagggatggaccaggtggaggtacttgcatcctgggggcagtttcccccatgctgtgctcgtgacagtgagtgagttctcacgagatctgatggttttaaagcgtggcagttcctctttctcgtgcttacatcctcgtaactatcctgtggagaaggtgtctgctttcccctacctccatggttgtaagtttcctgaagcctccccagccgtgtggaactgtgagtcaattaaacttctttataagttacccagtctcggtgtttgcttttttgagatggagatttgctcttgttgcccaggttggagtgcaatggcgtgatctcggctctttgcaacctctgcctctcgggttgaagctattctcctgcctcagcctcccaagtagctgggattacaggcgtgaaccaccacacccagctagttttgtatttttagtagagagggggtttcattatgttggtcaggctggtctcgtgctccaagcctcaggtgatccgcccacctcggcctcccaaagtgctgggattacaggcatgagccaccgcacccaaccttggatgtttctttatagcagtgtagaaacagactcagccgtcgctgcaggccatacctcagctacatagaacacctaactgcccgcaagggagttcctgctactaggatcttcagagtgacaaagaggaagctttggctggcaagggtggtggggaggggaggggctaggtacctaaggcttccctatctttccacacagcctaattttcatagcctctggtctccacatttcactctttcccaaataaagaccttttaaggtgtgggtccccttggtcattctgtaaccattggatcaagttttcagttttttctgctctctcagctgcaaaataacacattcgagttttggtttttttttttttggagacaaagtctcactctgtcgcccaggctggagtgcagtggtgtgatctcagctcactgtaacctctgcctcctggatataagcgattctcctgcctcagcctcccaagtacctgggattacaggcacccgccaccacacctggctaatttctgtatttttagtagagacggggttttgccattttggccaggcacactcgggttttctaaccataccttgagccaagaatttggattctgagcttgtcttttcatttaagctatgtggcgctgttagcatgaccgccctgcccagcagatcttgacttcagtgtaatctttattctcttctatggcaggagccattaggtcccccaaagccttgcctttgatgggtactttgttcccggggacaatgggattagctgtcttgccagggcgtgccatggggctgctggtgtcctgtcccttaataccagctggattttcactgtcctctgaccactttccagccttcaattgctcctgtttcctttggggcttcttgctctgtccagtcctggtcctatttttgtgagaatcaaggttcttagttttaaccaacagaaactaattctggcaactctaaacagaaagggacttggtcagaggtcctggctagttcccaggagctcaaaagggtcagaaaatcaaatcaggaagaggacattgggcaaagctggccaggtgaagaccccacagcctctgctggcacagaagctacaattggcaccaccgaagtgggacagaagctgccacctgtgcaagctagatgtagtcgctgccgctgtcaccatcaatttttgagatgatgcttcttcctgcctgccactttaattcaaagcgaaggccaggtgcagtggctcatgcctgtaatgccagcactttgggaggccaaggcaagaggatcgcttgaggacgggagtttgagatcagcctgggcaacagggtgagaccccgtctagccaaaaaatacaaaaaaaaagagctgggcagaaagaaaatggctcatgcctgtaatcccagcacttcaggaggccgaggcgggtggatcacctgaggtcagaagtttgagattagcctggccaacacggtgaaacactgtctctactaaaaatacaaaaaattagtcaggttgggtggcgcacgcctgtaatcccagctactcaggagactgaggtaggagaatcgcttgaacccgggaggtggaggttgtagtgagctgagatctcaccattgcactccccgctgggtgacagagcaagactagtctcaaaaaaaaaaaaggggccacgtcgatggaaggacaagaataaagaaactgaggccgggtatggtggctcacgcctgtaattccagcactttgggagtccgaggtgggcggatcacctgaggtcgggagttcgagaccagcctgaccaacatggagaaaccctgtctctactaaagatacaaaaattagccaggcatggttgcgcatgcctgtaatcccagctattggcgaggctgaggcatgagaatcacttaaacctgggaggcggaggttgtggtgagccgagatcgtgccattgcactctagcctgggcaacaagagcggaactgtggctcaaaaaataaataaataaaaaatagagacattgggccaggcacagtggctcgtgcctgtaatcccagctctttggaagaatgaggtaggaggattgcttgagcccaggagttcgagggtgcagtgatcacgtcattaaactcccacttgggtgacagagtgaggagctgtctccccacccccatcccccaaaaaaagaaggtaactgggcaaagaagttatttttagtagagactggctttcatcatattggccaggctggtcttgaattcctgacctcaggtgatccacccacctcggccccccaaagcgctgggattacaggtgtgagccacggtgcccaacctcctcttctcatttaatcctcaaaatcatctcacaaagcaggtgctattaatacccgcgtcttacagaacggttaacagatgtgtccagggccgcatggagaacaccttgagagagcaatgagatctcgctctcctgcctcatgaccgatacacggtttcaagaagttagatgacatcacagatactcagggcacccagctccaggccttactgccttcgcacaaggccgctctctactagcttcaccccgcatggaatgcaatggtcaatgaggccctggtcagaacatgggactgacaaagccagcacttgtaggctgagtctcagatcacgtggcttgtttgttttgtttgtttgtttttgggagatggagtttcactcgtgttgcccaggctggagtgcaatagcaccgtctcagctcactgcaacctccgcctccttgttcaagtgattctcctgtctcagcctcccgggtagctgggactacaggtgcatgccaccatgcctggctagtttttgtatttttagtagagatggggtttcatcacattggtcgggctggtttcgacctcctgacctcaggtgatccacccaccttggcctcccaaagtgctgggattacaggcgtgagccactgtgcccggctggcttttttttttttttgaggagtcgcactctgaaatccaagctggagtgcaatgatgtgatctcccaccatgctagttgtgtttgttgttgttgttttttctttagtagagatggagtttctccatgttggtgaggctggtcttgaactcctgacctcaggtgatccaccccccacctcggcctcccaaagtgctaggattacaggcgtgagtcaccatgcctggcctcaatttcttgaaagacaaagaaaaaagacagaaagagagaaagaaagaaaaagaaaaaaaagagaaagagaaagagaacaagaaaaagagaaggaaagctccatgggtttaaatgcaagagtcagcttcaaggagggctgggaagtcaggtgacgccacccttgtgcttcccgcagccagatcacctggtggaggtaccgttggttttgggcccctctctcagcacttgctaccagagaggacagctctacaccagagagtgagggtgggaacctgctcactgctgtctgctcagggctgggcatgaggcaggtgctcagtaggggtctggagaataaatgaatgaaccatcacggggccaagcacctggaagcgggctggagatgcttgctctggactcctggctcaggagtggactccccaggtggacttcctcctgcatcaccacagctgagtgcatggagcacaggtagggcagctaatgagcagggtcatcatgaatgacagcagatgacaccaggacaggggaggtcagtagccagatgggaagaaagcagaatgaaacaggtcacccgggtgcagtggctcatgcctgtaatcccagcatttcgggaggccgaggtaggcagatcatgaggtcaggagatcgagaccatcctggctaacacggtgaaaccctgtctctgctaaaaatacaaaaaattagccggacgtggaggcgggtgcctgtagtcccagctactcgggaggctgaggcaggagaatggcgtgaatctgggaggtggagctagcagtgagccgagatcgcaccactacactccagcctgggcgacagagcgagacagtctcaaaaaaaaaaaaaaaaaagttctggcggagagtgtgggtgagcactagggtactggaaagattccatgcctgggaatcgtgcgtggattgattacatccccacttctggcaaaatgcttcatggccttgtgcaagttaactttgtctccctgggcctctgtttactcatctgagaaacggggtaaagacatttgctcttcttaggtcacagggctcctgtacacgatgtgaaaggactttggaaagtatcctccggtgtgcaaatttctctgagaagtgctgtggctgtttatccttagactggaatgagaagggggagatgtgacttttgtgactttcagggtgggccaggtgttgtaggtgacaggacaatctcaggctggtagcagtggctcatgcctgtaatcccagcactttgggaggctgaggtgggtggatcacttgaggtcaggagtttgagaccagcctggataacatggttaaactccatctctactaaaaatacaaaaattagccaggttggggtggtgtgtgcccggagtcccagctactcaggaaggtgaggcaggagaatccttgaacccgggaggcggaggctgcagtgagccaagattgctccgctgcactccagcctcagcaacagagtgaaactccatctcaaaaaaacaaagacaatctcagatgtgcagttcacaccctggggctctccgtgggatcaggctgagggtcgcatttaactgaaatcttcaggagttcagcgtcggggtagatattccctgagaagcagctgagaggtaaagcttcctccgggaagtactcacttgctccttgttgatttcatggggtctcaggtttcaggaggaaagtaaagatgaaaagcccttgctctggcatcttggaggacttctgggtgagagccaggaaggggaaggcgtttggactcattgccctcccaggcctggagtctgattttcctgctctgtctggttttggaggtggaggctgcgaagccgaagcagtgctggtcctgccagctcctcccagctcctcccctgccctctgcttccctggccttgcacagggacaaggagctccaaagagcggctctgtcctgtctcagcctgggagggaagagggaggtggcatagatggttccacaaacagttcagtacgtgccaaaggagggcctgggaagccccaggtcaggagagggtgcctgcccttcccgtgaaggccagggctgagctgcttcctgccagcatccagttttgctcagagcacccagaacgccgtcttggaggaacgggggcaggcgctgccgcagaaccctggagctgtgtctcctgcctccagggctggccgtagctgcaaagaccagctggcaggtggaggactcaggaagactctccctgtgttggccctgcagccccatgtccccttctctgcttcttgggaacaggaggcctgtgtctgcctgtcctgagcatctcaaaaggaaaagctattctagggatgatgagagggaatcagggcctgaggcacttggaggaacatttgctgagctccctgtgcaacagcccattccaaggccaaggttgcaaaggtggcttagatgctgtccctaaatggccatcgaggttccaagcctggcaggaagggctcgagtggtggggccacagcggagacaaggccaagcagcctgattcttgggagtggaggttaatgagcagcgtttgcacttggctttctatagggtcaggctgtagtgcaacatcctgaggtgcgtggctgcccacaggtgctcagccagcccagcctctgccaaggcagacagagcctgggctgggaagcgggggatcccactgcttggggagtccccttttcttctgcatagtggggatgccaggagcagtgaacaagctcagcaaagagttctccagcccgacccgaggtttccttcctcctgactttgtcacctcactgggagaatatacagctctgtctgaaacaagtttcctgcggggcaccctgtgcaggggaagctcgggcagcccaacctaccagatggaagggaaagatagaggctgtgaggttcttctgggcctgtctacagcctcttctacctggctgccctttgttcagagtaaaggatgcagttcccaagacataagcaccgcgggcttcagagtatgaaggatccttccaggtcagccactttgggcaactggtgagcaaggcgggtgtgcagggccggctacatcatttgtggggcctggtacagaatgaaaatgtggggcccttattcagaagttactaagaatttttttttttttagatggaatctcactctgttaccccggcgggagtgcagtggcacgatcttggctcactgcaacctctgcctcccgggttcaagtgattctcctgcctcagcctcccgagtaggtgggattccaggtgcccgccaccacgtctgggtaatttttgtatttttagtagagacagggtttctccacctggctggtctcgaactcctgacctcaggcgatctacctgccttggcctcccaaagtggtaggattacaggcatgtgctaaaaatttcaagatgaggacagcagagcataagtgaagcgcaggacccttgcaagtgggtccgtctgggtgtgactgcatttggggagaaggggatggggtcctgcctgtccctgcagtcacagcataccacgagtcctggggcagaggagcctggattcaggcccttggtgctcagcggtcctggctcacggacacccctcgttcagcagccagggggttcctcactgtgtcccagatgtcactctaaagattgcttcagaggctccctccccgaatcgttggagggactctgccagttccaatgaccagccagctgccttcaggtcacaaaagaatctggggctggtctgagaccaggtgtacccccagaccccatctctgtccagatcatgagagggggtccagggtcccccgcctcccacagttgggcttcactgcacagctggaactcagccaggcctgttccgggaagcagggctgtgagtgtgagcagtccaggaccttggcattttgaacaaagaattgaacaaaacccacaaagtaacatagcaatgaaacatgggaaggaagcagtgaaagcaggaatttatgaaacagataaagcactctgcagggctggagtgggcctaagcaagcggctcaagagcctggttacaaagtttcctaggtgttttgttagtttgtttttgtattttattttttttattattattatttttgagaagtctcttacccaggctggagcgcagtggcatgatcttggctcactgcaatctccgcctcctgagttcaagtgattctctggcctcagcctcccaagtagctgggattacaggtaagtacccaccacgcccggctaattttcatattttttgtagagatggggtttcaccatgttggacaggctggtcttgaactcctgacctcgttaatcggcccacctcggcctcccaaagtgctgggattacaggcacgagccatggcacccagcctcctgggttttaagtactgcttttgaggttctattggctaccccttatctggatgaaggatttggtctgtggctcataaaaggctaatgtgaactggcgccctgtgcagatgaagggatgacccatgcttcgcctgcggctaatccaggacactctcccttcccatctaagatgtggtggagacaggagggtgatagggtgtctctatattaaaaacacacacacacacacacacacacacacacacacacacacacacacacacacacaaaggcagccagactatgcactaggaactgccctgggaatcccgttgcgttctcacaacaatcccacttcacagataaagaaaccaaggcacagaaatattcagtaacgtgtccagatgcggtggctcatgcctgtaattccagtattttgggaggctgaggcaggcagatcacgaggtcaggagttcgagaccatcctggccaacatggtgaaaccccgtctctactaaaaatacaaaaattagctgggtgtggtggcaggtgcctgtaattctagctactcaggaagctgaggcaggagaactgcttgaacccgggaggcggaggttgcagtgagccgagatcacactactgcactccagcctgggtgacagagcaaaactctgtctggaaaaaaaaaaaagaaaaaagaaatactaagtaacttgtctgaggccacttagttaccaagacgtgggagctgggacttgaacccaggcagtctggctggattcatgcctgcagcctctgcactcctgctacttcctgtgtgagaagcgcctgttctgtggaaggttgtgggctgagatctttccatgacttccactcatttacccccaaggctgttcttaaagacgggcatgacagttatgcccattttacagatgggaccctgaggctcacaagggcatgccactcacccatctccacaaagctatagctcgtcagcagagggcagaattcggccgcctctcccctagctcgaaggctgtgattgacacagaggtttttttgttgttgttgctgttgtttgttcctttttcttttttttttgagacagggtcttgctctgtcatcccggctggagtgcagtggtgcgatctcagctcactgcaaactctgcctccaagatgcaaatgattctcgtgcctcagcctcccaagtagctggaattacaggtgtgcactaccatgcccagctgttttttgtagagatggggttagtagagatttgtttaatagagacgaggtttcaccatggtctctactaaaccctgtctctactaaaaatacaaaaattacccaggcgtggtggcacatgcctgtagtcccagctactcaagaggctgaggcaggagaatcactcgaacctgggaggtggaggttgcagtgacccaaaatcatgcactctggcctggggtctcgcttttgcccaggttagagtgcagtggcacaatcatagtggcttactgcagcctcaaactcctgggctgaagggaatcctcccacctcagcctcccaagtagctaggactataggcatgtgccatcatggcgagttaattttttgtgtgtttttattttctcgagacagagtcttgctctgttgctcaggctggactgcaatggcgtgatcttggctcaccgcaacctccacctcctgggttcaagcgattctcctgcctcagcctcccgagtagctgggattacaggtgcgtgccagcatgcctggctaattttgtatttttagtagagacagggtttcgccatgttggtcaggctgctctcgaactcctgacctcatgatccacctgcctcggcctctcaaagtgttgggattacaggcatgagccactgagcctggcctggggagctaatttttaaatttgttatagagacaagagagacaagagtctctcttatgttgcccaggctggtctcgaccccgtggcctcaagtgatcctcccacctcagcctcccaaagtgctgggattacagatgggtgtcaccgcagctggcctctgaggagggtttcattataaacctgccctgaagggagggaatccaattttacgagagggtgtagcctggtgaggcctggatgacctccgcaggcaggggcttgtgcctgggctgaggcctaagggacaatgggcagacatgaagttgccccaggcagagggtacagtgtgggcaaagtcaggaagtggcagggcttggatcactccaggaagagagaggactcacgtgtcacaggagctcgagacccagagagagagtgaggcaggcaggcagggaccaagcttgggcacagccaggaaggcaggacagggcatggtggggccaatggaatcattacccaagacgggcattttcagggaaacagcttagataaggccaggcgtacagtagctcccacctgtaatcccagcatttggggaggctgaggtaggaggactgcttgcgcctgggagttcgagaccagcctaggcaacatagtgagaccccatatccacaaaaaatttaaaaaaggagtttgtgttcctgtagtagcatacttgggaggttgaggtggcagtatcacttgagcccgggagttcaaggctaaagtgagctgattgagccattgcactccagcctgagtgacagagagatacgctgtctcaaaggaaatacaaattaaaaaaccagccgggcatgctggtgtgtgcctgtagtctcagctacttgggacactgaagtgggaggatcgcttgagcccaggagttcaaggctgccgtgagctatgattgtgcctgtgcactccagcctgggcgacagagaaagaccctgtctcttaaaaaaaaaaaaaaaaaaaaaaaatcttagaggatgctgtgcctccctgggggtcttcagtcacccatggtcctggcagcagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcaccaccatgccacccaccccgagtatcccctgggcatcctggcatagccagatgacttccgtgcccgttgcaataaccactgcttccaactctctatagaccaccccttgggtatatctaatgtaagtgatatttattttatttattttttgagtcagagtctcgctctgtcacccaggctagagtgtgctgatgtgatcttggctcactacaacctctgcctcctgggttcaagccattctcatgcctcagcctcccaagtggctgggactacaggcatgcaccatcacgcccagctaatttttgtatttttttcagtagaggtggggtttcaccaagttggccgggctggtctcaaactccccacctcaagtgctctgcccgcctcggcctcccaaagtgctgggattacaggcatgagtcgtggtgtctggccctaatgtgagtgatctttaacaatgaagacttgaaaaagaaaaccctgaagaaacctaattctttgatgtctggacgacaaggaagaagatagatagaagtggcatcagataataaacagtgtaaatgtttatcagaaagaggctggtggttgggaccagtaggaggatcgcttgagtccaggagtgcatctctacaaaaaagttaaaggattttttaacattggccaggcatggtggcacacatctgtgatcccagctacttgggaggctgaggcaggattgcttgaagcccaggaggctgaggctgcagtgagctgtgatcgagccactgcactccagcctgggtgacagagcaaaacccagtctcaaaaaataataataatattttacataaccaaccacttctaaagactaaaaaaaaaccctacaattaaaaacctcaggtccctcaggcaatcataccagatattgaaacaaagcaataacataaggactgcagtatttattttatttttatattatttatttattctttgttagtttgtttttggagtgtgggttttgttttgttttttgatttttttcttttgttccacccacagatttcttcttattgcccaggcttgagtgcaatgacctgttctcagcttactcaacctctgcctcttgggtttcagtcatttttctgcctcggcctcctgagtagctaagggaggagtcttgagattatcatccacggagggtggaagaggagagggtggaaggggaataagaagacactccagtgaagcacttgccttgcgtgcaaaaatgtaagggggcctctccctctccctctccgtctccctctccctctccctctccgtctccctctccctctccctctccctctccctctccctctccctctccctctccctctccctctccgtctccctctccctctccctctccctctccctctccctctcactctccctctcactctccccacggtctccctctcatgcggagccgaagctggactgtactgctgccatctcggctcactgcaacctccgtgcctgattctcctgcctcagcctgccgagtgcctgcgattgcaggcacgcgccgccacacctgactggtcttggtggagacggggtttcgctgtgttggccgggccggtctccagcccctaaccgcgagtgatccgccagccttggcctcccgaggtgccaggattgcagacggagtctcgttcactcagtgctcaatggtgcccagactggagtgcagtggcgtgatcgcggctcgctacaacctacacctcccagccgcctgccttggcctcccacggtgccgagattgcagcctctgcccggccgccaccccgtctgggaagtgaggagcgtctctgcctggccgcccatcgtctgggatgtgaggagcctctctgcctggctgcccagtctggaaagtgaggagcgtctgcgcccggcagccatcccatctaggaagtgaggagcgcctcttcccagccgccatcacatctaggaagtgaggagcgtctctgcccggctgcccatcgtctgagatgtggggagcgcctctgccccgccgccccatctgggatgtgaggagtgcctctgcccggccgagaccccgtctgggaggtgaggagcgtctctgcccagccgccccgtctgagaagtgaggagaccctctgcctggcaaccaccccgtctgagaagtgaggaggccctccgcccggcagctgccccgtctgagaagtgaggagcctctccgcccggcagccaccccatctgggaagtgaggagcgtctctgcccggcagccaccccgtccgggagggaggtgggggtggtcagcccctgcctggccagctgccccatccgggagggaggtcgggggtcagccccccgcccggccagccgccccgtccgggaggtgaggggcacctctgcccggccacccctactgggaagtgaggagcccctcagcctggccagccgccccgtccgggagggaggtgggggggtcagccctccacccggccagctgccccgtctgggaggtgaggggcgcctctgcccggctgcccctactgggaagtgaggagcccctctgcccggccagccgccccgtccgggagggaggtgggggggtcagccctccgcccggccagctgccccgtctgggaggtgaggggcgcctctgcccggctgcccctactgggaagtgaggagcccctttgcccggccagctgcccagtctgggagggaggtgggggggtcagccccctgcccggccagctgccccgtctgggaggtgaggggtgcctctgcccggccgcccctattgggaagtgaggagcccctctgcccggccagccgccccgtccaggagggaggtggggggggtcagccccccccgcccggccagccgccccgtccgggaggtgaggggtgcctctgcccggccgcccctactgggaagtgaggagcccccctgcctggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaagaaaattaaaaaaaaaaaaaaaaaaaaaacaggctacctacaatttgtgttgaagatatgaatgaatgaagtttccacacccttatgtggagttctgataagtaagcaacaataaggaagggtccccaggttggggagaccccaagttgagaacaataatgaacaattattgtatgaacaattgttagagacagctaatcacaaacaacctgcgggcacaatgaccccattccacacgtagcacccttcagcaggaccctataaaactctcctccagcccttgcctctttgcaggtagccccttctgtgctgagctgcccattgcaacatattttcataatttctctaataaatctgcccttctttacctacaactatcttggtaaatggctttaccacctgcaaaactgaccctaggttgttgctacccgatatggtttggctgcatccccacccaaatttcatcttgaattgtagttcccataatccccatgtgtcatgggagggacccggtaggaggtaatcgaatcatgggggcaggtttttcccatactgttctcgtgatagtgaatacatctcactaaatctgatggttttataaagggcagtttccctgcacgtgctctcttgcctgctgccatgtaagacatacctttgctccttctttgccttccaccatgattctgaggcctccccagccttgtggaactgtgagtacattaaacctctttttctttataaattgcccagtttcgagtatttcttcatagcagtatgaaaagtaactaatacactacctgagacaccttaggagatttgtaatagctgtaatgccaggtccaccatatttttagcataaagcaaatgtttacccatgatatgactgcacaggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccgtctctacaaaaaatacaaaaattagctgagtgtagtggcacacacctgtagtcccagcaccttgggagggtgaggcaggaggatctcttgaacccaggaggtggaggccgcagtgagcagtgatcatgtcagaggtgtgtgaaccagagcaactccatcttaaataggagctgggaaaaatgaggctgaaactgctgggctgcattccctgatggttaaggcattctaagtcacaggatgacatagaaggtcagcacaaaataccagtcgtaaagaccttgctgataaaacaggttgcagtgaaggagctggccaaaacccaccaaaaccaaaatagtgacaagagtgacctcccatcatcctccctgctacattcctacaagcaccatgacagtttacaaatgccatggcaacatcaagaagttaccctatatggtctaaaaagaggaggcatgaaaaatccaccccttgtttagcatatcatcaagaaataaccataaaaatgggcaaccagcagccctcacggctgctctgtctatggggtagccattcttttattcctttactttctctttttcttttgagatggagtctccctctgtcacccaggctggagtgcagtggtgcgatctcggctttctacaagcttcgcctctcgggttcatcccattctcctgcctcagcctccagagtagctgggactacaggcgcccgcaaccacacttggctaatttttttgcatttttagtagagacgaggtttcaccatgttaaccaggatggtcttgatctcctgacctcgtgatccacctgtctcggccccccaaagtgctgggattacaggcgtgagccaccccgtgcccctcctcctttactttcttaataaacttgctttcacttcacactgtggcatcaccctgaattctttcttgcacaaaatccaagaaccctctcttggggtctggattgggacccctttcctgtaactatcatgccactgcactccagcctgggcaacagagcaaggccctgtctctcaaaaaaaaaaaaaaaaaaagtaacgtgacttaatacattcattttggagggtaagtctctcaaaataggcctttcactgggggaaaatggtaaaaatactccctggtaattcaagaattggagactcctgagatgctgctcatattagctgaacacttatcaatacttcactttcttccatatatactcaaggaacaagtgctatttaaagtgtttcactctgctgtgctaggtgcaagactataaagaggtgtgaggatcaacacttttatgaaaaccaatgtcattctgaatatagtttcagatgctagtgcaaaggaagctcttggtatacggaaaaagtattcaacaataaattaggcatggttgcttccattttctgcctcacatacctttttttcatggttaaagtgatataaagtctatgatattttagattggcagttgcaaactagtggtcctcagcgtgctttttatgacacctacaaggtttgaagactctgatttcatattaaaaatctgggtttcaggctgggtgtgatgttgcatgcctgtaatcccagcactttggaaggctgaggcaggagaatcgcttgaaccagggaggtggaggttgcagtgagccaagatcacgccactgcactcaagcttaggcaatagagcaagactccatctcaaaaaatgaataaataaataaaatctgggtttcaggccaggtgtggtggtgcactcctgcaatcccagcactttgggaggctgagatgggcagacagcttgagctcaggaattccagactagcctgggcaacgtggcaaaaccccatgtctacaaataatacaaaaaaattagctgggtgtagtggagtgtgcctgtaatcccagcaacgtgggaggctgaagtgagaggactgcttgagcctgggaggttgaggttacagtgagctgagatcaccctcctacactccaacctgggcaacagagccagaccttgtcttaaaaaaaaaaaaaaaaaaaaaaaaattctgggtttctggcatctcaaaaaaaaaaaaaaaaaaaggaaaggtcagggcacatggctgctacagtcctctattaagcaatgtgccacagcaggggtccctgacccctgggccatggacatgtactggtctgtggcctgttaggaactgggccacagagcaggaggtgaatggtgggtaacaattgaagcttcgtctgtatttctggctgctcctcattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagttccctatagactttgcttcctaccgtcttacgttctgccttataggcatctcagtttgcaacccttgtttttgtcagtatgctacgctggtgacattgaccaaattgaccacacattaatgataagcttagttggtgatgacctcaacggaataacgtgacataagtattgtgacaatacttcttgcatgtatctacaggtggaattgtaaacctggtggtccgagatggtctaattcgatcttcctatgtatctccttatattaatagtggtaacatttgtggtggtgattcagcgtttcaatgcctcttctcacggcaacaacaaacgttttccttctgaatcaacattaacctagatgttactgcagatcaaaattagtatctacattttcaaccacagaaatattgggcagtaaaaatttttcttaatattgattgcctacataggttgtgtaattagcatatgtttatagttctatgatttgtgcctggctgctacagagctggagggggtaaagcaacagtgttttctcagttgtgtgagcagcattacattataataaataggtaatattaaactgggctgatgagagttgcaaaagactactttaatgttcatatggaaccaaaaaagagcccgcattgccaagacaatcctaaacccaatgaacaaagctggaggcctcatgctacctgacttcaaactatactacaaggctacagtaaccaaaacagcatggtactggtaccaaaacagacatatagaccaatggaacagaacagagccctcagaaataataccacacatctacaaccatctgatctttgacaaacctgacaaaaactagaaatgtggaaaggattcccgatttaataaatagtgcttggaaaactggctagccctatgtagaaagctgaaactggatcccttccttacaccttatacaaaaattaattcaagatggattaaagacttaaatgttagacctaaagccgtaaaaaccctagaagaaaacctaggcaataccattcaggacatagggatgggcaaggacttcatgtctaaaacaccaaaagcaatggcaacagaagccaaaactgacaaatgggatctaattaaactaaagagcttctgcacagcaaaagaaactaggatcagtgtgaacaggcaacctagagaatgggagaaaatttttgccatctacttatctgacaaaaggctaatatccagaatctacaaagaacaccaacaaatttacaagaaaaaaacaaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaacacttttacactgttggtgggactgtaaactggttcaaccattgtggaagacagtgtggcgattcctcagggatccagaactagaaataccatttgacccagccatcccattactggatatatacccaaaggattataaatcatgctgccataaagacacatgcacacatatgtttatcgcggcactattcacgatagcaaagacttggaaccaacacaaatgtccatcaatgatagactggattaagaaaatgtggcacatatatactatgcagccataaaaaaggatgagttcatgtcctttgtagagacatggatgaagctggaaacgatcactctcagcaaactatcacaaggacaaaaaaccaaacaccgcatgttctcactcacagatgggaattgaacaatgagaacacttggacacaggaaggggaacatcacacactggggcctcttttgtggtgggggagggggaagggatagcagtaggagatacacctaatgtaaatgacgagttaatgggtgcagcacaccaacatggcacatgtgtacatatgtaacaaacctgcacattgtgcacatgcaccctataacttaaagtataatttaaaaaaataagtaaataaataaaaaaagaaacaattgctggctttgcaattctctttcctccaaaatcaccaaggcctcaatttactcattgctgaaaaaggacgactgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccacttcttagtcctttaatacctgtttttctccttctcttattcagaccgtgtgtcttctgtttagtttctcaattcatacaaaaccatatccaggccatcaccaataattctatatgacaaatgctccttctaacaaccccacagtatcagcccttaccccaaaatctttcttcagttgaatctctcccactgtaggttcccatgccgcccctaatcccgctcgaagcagccctgagaaacatcgcccattatctctccatatcacccccaaaaattttcgccaccccaacactttaccactattttgttttatttttcttattaacataagaagacaggaatgtcaggcctctgagtccaagctaagccattaagccatcatatcccagtgacctgcatgtatacatccagaaggcctgaagcaactgaagatccacagaagtgaaaacagcctcaactgaagacattccaccattgtgatttgtttctgccccaccctaactgatcaatgtactttgtaatctgccacactcttaagaaggttctttataatctcccccacccttaagaagtttctttgtaattctcctcacccttgagaatgtactttatgagatccacctcctgcccccaaaacattgctcttaactccaccgcctatcccaaaacctataagaaccaatgataatcacaccaccctttgctgactcctttttcagactcagcccacctgcacccaggtgaaataaacagccatgttgctcacacaaaacatgtttggtggtctcttcacacagacacgtgagacaggagttcgagaccagcctagccaatctggtgaaactctgtctctactaaaaatacaaaaattagccgggcatggtggcgggcacctgtaatcccagctactcgggaagcggaggcacaaaaattgcttgaacccaggaggcagagtttgcagtgagccaagatcacactgtctggcatctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactgttcaatatactttgtaatctcccccacccttaagaaggtactttgtaatctccccaacccttaagaaggtcctttgtaattctccccacccttcagaatgtactttgtgagatctacccctgcccacaaaacatggctcttcaccccctatcccaaaacctgtaagaactaatgataatccaccaccctttgctgactctcttttcggactcagcccgcctgcacccaggtgaaatgaacagccatgttgctcacacaaagcctgtttggtggtctcttcacacggacgtgcatgaaacacacgactgcacttcaggctgggcgacagagctagattccatctcaaaaaaaataaaaaggagtcacctcccctgagaggcctctggaccaacccatctgagcaggccactcttccttctctatcttaccatcttgtttctgtcccagtagttagggctacctccagtaatcctatttgtccctttactgtttagtgcgtctcacttgactagaagctccatgaaagcagagatcctacctacctccttcaccactagacccccagggcctggtatgtggtgatcgctcagggcccattttcttcctttcctcctcctccaagggtggggaaagagcatcagaaggtctaggtggccccaggcccaaacaatcctcctttaaaaggaaaccagattgttacaaaggtcagaggctgaaaagttatttccgccttttatccctctaaattcttcacttcctgaaaaaacaaacaaaaaaaagccactgagggcccttggactaaatccaggcctgagttgctgggcagaggtcagtcttgtccagacatgggaaaaaaataactcgagtcagacaggtgggtcaccagagaacgaatccagcctgcaaatggtgtgtgcaatcttcagctctgtccagacctgcctccctctggggatgcctttaaaggtgatgaatgacctggatgaatgggcttagaagagggaaaaacaaatatcacaggtcaaatcattatttgtcttcaagtttaacaccgtctactggactgaaagatgtccaaagaatagttgttcaactatgtaaattcctttttttttttttttttgagacagagtctcgctctgttgcccaggctggagtgcaatggtatgatcttggctcactgcaagcaacctctgctcctgggctcaaaccattctcctgcctcagcttcccaagtagctgggactacaggcatgtgccaccacgctcagctaattttagtattgttagtagagacagggtttcatcatgttgaccaggctggtctcgaactcctgacctcaggtgatccacctgcctcggcatcccagagtgctgggattacaggcatgagccactgtgcccagccaactacataaattcctaacaacgtatctccagaaagtataggcacaacagcacatgcagtcattcctgtaatcaggtgctccgggaggccaaggcaagaagatcccttgagcccaggagtttgagaccagcctggacaacatagcaagactgtgtctctataaaatatacaaaaattgggctgggtatggtggctcatgcctgtaggcccagcactttgggagaccaaggcaggaagatcgattgaactcaggagcttgggaccagcctggacaacataatgagacccagtctctactaaaactcaagaaaattagccagatgtggttgcatgtgcctgtagtcccagcactttgggaggccaaggtgggtggatcacctgaggtcaggaggttgagaccagcctggccaacatggcgaaaccccatctctactaaaaatacaaaaattagcccggtatggaggcatgtgcctgtaatcccagctacttgggaggctgaggcaggagaatggattgaacccaggaggcagaggttgcagtgagccaagatcgcaccactgcactccagcctgggcaacagaacaagactccatcaaaaaaaaaaaaaaaaagaaagaaagaaagaagaaaagaaaattagccaggtgtggttgcatgcacctgtagtcccagcactttgggaggccaaggcaggaggatcaatcaaggctaggagtttgagactgcagaaggaaaccctgtctctaaaaacaaggtccagctaaaatcagggtccagctccaccacaagcgcagctccagggtctgttgagttttgcctctaccattccaagtagtccctgctccagaccaagtcccaccatctggcagtcaggtcagtccaaccacagtcatatcagggcgcttcccggttctttcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaagcaaagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaggctaaggcaggagaatcgcttgaacctgggaggcagatgttgtggtgagccgagatcacgctaccgcactccagcctgggcaacagagtgagactccatcaaaaaatagtaataataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagaaacccaacaggaaaaggaagagactgctctatggccaggcacggtggctcacacctgtaatcccagcactttgggaggcccaggcgggcggatcacgaggtcaggagatcgagaccatcctggctaagacggtgaaaccctgtctctactaaaaatacaaaaaaattagccgggcgtggtggtggatgcctgtagtcccagctactcgggaggctgaggcaggagaatggcgtgaacccgggagacggagcttgcagtgagccgagattgcgccactgcacttcagcctgggtgacagtgagactccatctcaaagaagaaaaaaaaaagaaccaagaggagtccaggagaagagaacagcagatgcaaaggccctgaggcagaaacaatcttggtatgcgggaggaataggaaggcagccagtgcagctggagcaggataggttaagagaggatcaaggtgatgagggcctggaaagaggggctggggtcaaatcaccagatcctgttggttgcaatggaagagcctggagtttattctcagggcagtgagaagccactggaaagttgttttttgtttttctgtttttgagacagagtctagctctgtcacccaggcagactgcagtggtgcaatcttggctcactgtaacctctgcctcccaggttcaagcgattctcctgcctcaggctccccagtagctgggattacaggcacaggccaccacacccatctaatttttttttttttttttgagacagagtctctgtcacccaggctggagtgcagtggcacaatctcagctcactgcaacctccacctcccaggttcaagcaattctcctgcctcagcctcctgagtagctgggactacaggtgcatgccaccatacctggctaattttttgtgtttttagtagagacaggatttcatcacgttagccaggatggtctcgatttcctgacctcgtgatctgcccaccatggcctcccaaagtgctgggattaacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctacctcagcatcccaaagtgctggattacaggcatgagtcaccatgcctggtcacacttctcattctttaaaccagacctcatttgtccacctcccccatcccccgccccaccccacggactgtcctataatgcccatacaacaggtcactgtttagaaagtgccacaaagttacaaacacagtcccttctgagcctcccaccaatgttggtgggtgcaaggtcaaaaaaaaaatctcatctatctaaggggcataggagactttttagttagagggcccaattatagtcctcctgaaaagatgccaaaagtccccttaaacacttagcaaagattcaagaaagatgaatctcacattctttgtatgggaaatgaggaacttgacatcttcaatataatagattccactaaaataagatgacgatcaataggaaccaactaaaaaaatacttgactagctgttattgaaaggctgaaattcagctgacataagcagtattaatattgagctagaaaataattcgcattgaattcagcccaacttttgttttctgatttgggtctcttctaaattttttttttcttctggacattgggaacaatccaatttgaaggcctcaatgcccaaatctacactcgttttattctatatccttggtttctttttttttttttttgagatggagtctcactctgtcgcccaggctggagtgcagtggcgtgatcttggctcaatgcaagatccgcctcccgggttcatgccattctcctgctgcagcctcctgagtagttgggactacagatgcccgcccccacgcccggctaatttttttgtatttttagtagagacggggtttctccatgttatccaggatggtctcaatctcctgacctcgtgatccacccgcctcagcatctcaaagtgctgggattacaggcattagccaccgtgcctggcccacacctgggtgatttttaaaattcttctagtagagacagggtctcactatgttgggtcaccgtgtttgatgtcagttttccctgacagaatctacaatctccttgatcaccattatatcccaacacagagctcagtacctggtacaaagcacatttgatcaatacttgctgaataaagaaataaaaatgaagaggcattccagcctgggcaacagagtgagatggtctcaaaaaaaaaaaacaaaaaaaaaaaaaacaaaaaatgactggaaaggagatgagggtacttgtgaagccatattatatgacacgctctgtgctaggacttttatataccttgtctcatctcttcatctcatataatccttacaagtatctcaaaagtggggaaatccccatataactgaagaggaaggcagttcagaagttcactgatttgccctaaggttcctcaatttgtaaacatcaggccaatgatccaaccccaggtatgtttggcagtgaaggaccagttgagtcatagctgcaagtaacaaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttatgttcagaacacaaaaataagtcttatgtcttcattaaaaatgggtgaagaatttgaacaaacatttgcaaactaaaatacaaatgaaatacactcaacatcattaatcatcaagaaaataaaattatgagataatcctaataatcactacatatgcaccacagtgattaaaatttttttaagttaagccacgtgacccaataaggtgcattcactcaagagaaacgcaaatatatgtccactcaaagacttgcacatgaatgttgagagcaggtttatactgaatagtgcaatgtgaaaaaaccccaaaatctagcaaagaatgaagggagaaataaactgtggtatatacatacaatagaacactactcaataataaaaaggattgtattcctgatacatgcaatatgggtgaaccttaaaaatatcatgctgagcaagagaagccaaacacaagagaacatgttgttatgatttcacgtacatgaaactttagtaaagacaagtctaatccatagtgacagaaagcaaatgagtaactgctgacagggccaaatgaggagatgatcccaagggaaccttctggggtaagacggtgttctgtatctcaatcgtattggtggtcacacaagtgaagacatgttagaactcatcaaaccatacacttagaatgtgtaatataaacctcaataaagcaaaatttaaaaaaaaaaacacctttaattttctcttacaaaaaaaaaaaggaaaaccacttaactttaatttttctccaacaactgattctggtacatagtataccttactgcctgcatccatggcctcacatcatgctgtttacatgaacgtaaagcttcaccgaagagtggaataagacagtcctgccagagaaaaaccaaaattactcaacgtaaaacaggctgttgatacgtttgcagatatatagcaagtcttaagtcaaagactgcaatatagtttggctacttcagattgattgcagtagttttatctattacactatacccttacatcatttatcttctactcacaagaggcaagcacacagtaagagaaagccttttgttttgaagggaaatcttcttcagaatattaagtctaatttatcaatatacttaataaagcacattacaaaaaaaaagtcacagcacatttactataaagcagactgcagaaaaacattacaactaatgctttataatgaagttctcgaagatcatcattcattcagaagcccccatctctggttgaactttaccccatttaggatgaagaggagagatctttgtttgcagcaaatctaaaatttacgtaatctgcctaaaggaactgtctttacatacaccacctcccactccaaaaatagaagaaaaaactgagcaatttgccatccttgcgattatctcaggttcttccatctgccccatgtacttcccaaatgaaagactgcctgaaaacagcatgttagatttctggatttaccagcttgcccaactacaaatcctatttcaaaaaactcaaaaaataaggtctttgttctacagtaatgaccattaatagtcataagaatgtgcttgtaaaaatatacagacctctgtttaaagtctgttagaaactgtgttctccaaagcaggtgagcaatacagctgcaaggtacttagaactggcaaagactgtgaaactgttaaagtagaaagtctcagaggtccaacagcgatgcgggatgtttgcttcaagtactttaccacatttctgaaacaaaatatttactgtcaattaataaaaattacaattcataaccactcaaagaataaagcaattgataagatgctatcaaactgacatccaaagttagggggcagtaagaggagcagcctgctctataataaaatgatattagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttatctccgtaagagtaacttactcagttatagactgccacttctgatcttgttctatcgggtttaaagcagttgccaaacaaacagaacttcttaacaattgaacttcaatggatttctgaggttcccttggatctggacttaacatgttacgaagcaggtttttcatgtctacagaagttaaatgaaatgtcattaattaatgtgcttttattataaattttgatttatgtttggcattattaaaaactaatcaccaatgaacagctcctttaatatttaaggcagttaaacactataagcattactgagagctatataaaaatcatacttcatacaaaattactgtacctcagacccctaaaaagcagttgccttcaaaggctcaaaaatcagtaagtcgaggccaggcgtggtggctcacgcctgtaatcccagcactttgggaggccaaggtgggtggatcacgaagtcaggagttcaagaccagcctggccaagatgatgaaaccccgtctctactaaaaatacaaaaaattagctgggcacagtggcagacacctgtaatcccagctactcaggaggctgaggcaggagaattgcttgaactcagaggacggaggttgcagtgagccaaaatcccgccactgcactccagcctgggcaacagagtgagactctgtctcaacaaaaaagaaaatcagtaagtcaatctactatttaagggaacaaatctagacctgcattagcaaatcttgctcaatccagaatactcattaaactttttaataacattttataaagtgttccatttgtgataaagaacttaatgagccacatcaagatgaaaatcaagaaaaatatttagctgaaacactactttgtcctttatcaaacaaaatggctagataaatctcaaagcattaaggtggtcatttttttatttgacttaattttaagtgcttttcatttcccaaatcaaacttaaatagggcagccctaaatttgttgcttcacatgggattctgccccccaaaaatgtaaaatgacttccagattttccagtaaaatatactaagccaaacattttgagcaacttgtccactaaaataactttaaaactattttctcaaatacctacctattttttcttttgatcctccagcaagtagattgatattttctcctggtaacaattctaattgctcagtacattcaacaaattttccagactcgaagctgcttaatgatctgtaattaaaatattggttagcttgtattcctacgcagcctgtggaaccattaaaaaaaaacaaacaaacaaaaacagaacaaatcctaggaagacagcaaagtacacagcatttttctgacaaaattccttccacgaggatgtcattattttggtttttatgttgaagatgtgactaccacttaattagtactcaaattggagtggcaaaccagaaagtcacagctacagactttcagtagagctgactcgcccctgtgtctccttcctgttttcatgtgttgcagcctgttctcttcagagcctaacacactgacagtagacctctgcaggacaactttgacacccagttctctccaagctgccagtgagctccttgtgcagcctcactcctcacctacagcatgagcccttgcagctctcccagcatcataatcttgtatctcagtcctggcttctttcactgctggcatccctccatctctccctttttcacctacttttcttttttcaaagaattcttctctttcatctgcttttatgaaaaataatgacacctctgaaattctttcctgtagtcctgcagcatcaatgccaggaagacaggcctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacattcgtcatttctgccattaaaaggtcctaagtcctctccagtgacaggttcctcaagtccccactatgctctataatgccctatgctttcagctaatgactcagtcctcagaaaaacaaacaaataaaaaaacacaggctttaatttcctctacccctacccccaatccaccatacactgccaaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatctccctccagcaatagcttcctatcctcgacttcaagaaaaactcactgaccaaataacttacctcaagcttttcattttcaaatgtctctaccactcaatagtattcaatctagcttcttctgtctctctacaaaactctttttccttataatccctagagcatctgacaaggctgactactcccatctggatgtcctatatctaggacacttcccttctcaatgtccctgtatttttttgaatggcttcctcttctatactttcacaaaaatgctaaactaggattctgacccaggccttccttcctcttcactcactattctccagaggcttctctctggtttggttgcttacaaaggctctagagtatagagactgaaaaggaaacagggccttttctgtgtactaatgatgtgcaaatctctcaagcttagactttctccttagttcaaaatccaattttttttttttaattgatcattcttgggtgtttctcgcagagggggatttggcagggtcataggacaatagtggagggaaggtcagcagataaacaagtgaacaaaggtctctggttttcctaggcagagtgtgtgtgtccctgggtacttgagattagggaatggtgatgactcttaacgagcatgctgccttcaagcatctgtttaacaaagcacatcttgcaccgcccttaatccatttaaccctgagtggacacagcacatgtttcagagagcacagggttggggataaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcctggacggggcggctggccgggcggggggctgacccccctacctccctcccagacagggcggctggccaggcagaggggctcctcacctcccagacggggcggcggggcagaggcgctcccatctcagacgatgggcggccgggcagagacgctcctcacttcctagatgggatggcggccgggcagagacactcctcactttccagactgggcagccaggcagaggggctcctcacatcccagacgatgggcggccaggcagagacgctcctcacttcccagacggggtagcggccgggcagaggctgcaatctcggcactttggggggccaagacaggcggctgggaagtggaggttgtagccgagatcacgccactgcactccagcctgggcaccattgagcactgagttaacaagactccgtctgcaatcccggcacctcgggaggccgaggctggcggatcactcacggttaggagctggagaccagcccggccaacacagcgaaaccccgtctccaccaaaaaagtacgaaaacccatcaggtgtggcggcgcacgcctgcaatcgcaggcactcggcaggctgaggcaggagaatcaggcagggaggttgcagtgagccgagatggcagcagcacagtccagcttcggcttggcatgagagggagaccgtggaaagagagggagagggagaccgtggaaaccgtggaaagagagggagagggagaccgtggaaagagagggagagggagaggagggagagggagagggagaggagggagagggagagggagagggagaggagggagagggagagggagagccaaaatccaattcttaacagcttacccaacaatctcatctgcacatttcattagaaatcttaaaacatagcttgttctctgtgtgctcctactccagttaatagcattgtttctcttccctctaccattgcccccacaaattaatggtctccatgcttccatacttgcccctcacctccagtctcttcaccatagcagaatgaaccaccaagtcagatcacaacacatctctgttcaaatcccacctgaaattttcagtcttactagaataacagccaaagttcttttctcagttcccagctacttctctgcccttatatcctactgtttaaggtgctcctaaacacacaggcctcccagctatttccagaacactccaagcccatcattctcacatcaggtctaggcccaaagggcatcctgatgggcatgccttgaccttgtgtcttccctccaaagaaggtcagctttacctaactgctttccttatggcacagaaaaggtgagtgaggtccaattaatccttctatcaataatctttatctaatctttgctttaaaaggttggaatttgtgtctgttttatgtgctgcctgggtcatagtatatgctcagtgaagcaattacacattaacccatttagcagtagaaagcaagggtatcagacaaagtctaatgacctttatcttcccagccaagtgtctgcaacagagtgagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaatcagtacaaatttttccttatattcactctggcataatcttcaaactctattaaggttttagaatgacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcatagttattggaaatttgttttataactggaaacagaaagccttactttatatagttgaattcagctttcaggttgagggaagtgctactggtactctttttcaagtcatggatagcattctgccattcctgcacagcagcgcaatcggcaattgagatgtagcactcacacatgctttatttcctaaataatttataacctcaggggaagagtcagtcggtttggacagcacagtttttctggattcacctgaaagtattttataaaataagaagagattcagatcaattagaaatatttcaaagagcacagaaacctaaaaacatgataagatcatcagtacaaaatatatcactataacttttgctttatttaaaaatactgaacgctcaccattcagacaatgtttcgggctggcactgttacacccagcattggctaaggtgagcaccaatttgtcaaagctggagatgcagcaatcaacacctgtcatggcacacaggtgctcctggtactccacagaggccttttcaaacctgaaaagcaaattgaagcagtcttatttctttatttatctacttacttactttcttttttgagatgaagttttgctcttcttgcccaggctggaatgcaatggcactgtctcagctcaatgcaacctctgcctcctgggtacaagtgattctcctgcctcagcctcctgagtagctgggattacaggcactcgccaccatgcccggctaattttcttgtatttttagtagagacggggtttcaccatgttggccaggctggtcttgaactcctgacctcaggtgatccgcctgcctcggcctcccgaagtgctgggattacaggcatgagccaccgcgcctggcctttacttacttacttacttattttttgagacagtcttactgtcacccaggctggagggcagtggcatgatcatggctcgctgcagccttgccctaccaggctcatgcaatcctccaacctcagcctcccaagtagctgggactataggcacccaccaacacacctggctaaaacaaggttttgctctgttggccagggtggtctcaaactcctggactcaagcgatccgctcacctcagtctccccaagtactgggatttcaggcatgagccaccgcgcccagccccaaaggaggctgttattttaaacacacatatctcatttcccccccccacaaaaaatggtgcaagaataaactgagctaaaacagtgagttgactatggtggggggaggtttgatgtcttcctcacaactgtgaaactaaatttaaaagtggttaaatgtttttaaaaaaatgtaagagtataaaagaactagtggaaaatattgataagtaactgatgtcagtgtgtggaaaggctttgtagaaggataaaatgcaagaaaagatgcacaagtaacagatctagatgcataatgctgaaatacaacactaaacattaaaaacaaattataaatcaagaaattggatagcatcaacaatcttagtatttaataaaatttcacagattaacacaggaaaaattgagaggccatgaagacatgatccatgttttaaaaaatcacaaaaggtcactatatggggcaacttctactattagtcattaataaatatagaaatgtaaagtacaataactattttcgctgatggtggtggcagcattcttgtttctcagtgactctcagtatccacaaagatgaagggaagggggtactctattattaagggtatacattgcagccatcttttctgtagagtaacttaccaatagaatatattataagacttatggtttggcagcctttcttctagtaaatcagtttatgagaatggattccaagaaagtaatcagaaatataagcaaagatattaagtgctatggtacatttagtaaaaaaaaaaatcagaaacaaccttaatgcccaacagtaagaaatattaaattatggtacactcataaatacaaacctttattaaaaataacactgtagaatatttaacatggcaatttttttttttttgagacagagttttgcttttgttgcccaggctagagggcagtggcacaacccgggctcacagcaacctccgcctcccaggttcaactgattctcctgcctcagcctcccaagtagctgggattacaggcatgtgccaccacaccccactaatatgttttgtatttttagtagagacggggtttcaccatgttaggctagtctcaaactcctgacctcaggtgatccacctgcctcggcctcccaaagtgctgggaatacagatgtaagccaccgaacccagcctacctaacacggaaaattttttttttttaaatattgagtgggaaaaacagatcataaaaccatgtgcctatgtacactgatgttttggtgaagaatggagaaaacgacatgaaagaaaaaagaattacaaagcatatggatatggaaatatgggactacaaaaggacacacaacagaagttactacaaagatatggaagtatgagcagttcttttatcttcctaaatttgcaagatttcattaaactaacataaatggacacagaatattatggtacaagctcctctacctggaggaagcaatgagtctgaatgtagagttcacaggactaatgagcaaatactctgacaataaagggtaatttgtatcagactctgagggggaaggagctcaactagggatcaagttcaaaagcgtttataaaacaactgacaggtcttgttttacagtgtgatttgccactaattcttaaataagaaaggcactccagtattgcggctaactaaagaacaaactgaagatgcctcctggtgaagtgatttatagcaagcttcaatgctgaaagcaaacaaagctgttttaagatttggctacaatgtcagtgagtaatacaaagaatttaaacataaagtaattctgtcacccatttccttccctccaacctacctcccttcagcctgttgagccactgagttaatccacagaagattttttccaacaatagatgatgaccagacagcaattccctgtatagcttcaggacaatgaagttcacatagtgcttctaccaccatcataatggttatttccaattcattcccctgaaaacgcattcagaaaagttagtcacccaataccattaaaacataaatccctataaaatttacaactgatcacagtctgtgcctgcttaaagccaaatgtatttaacaattattttcacaattttcacattatttagctcagaattctttaaaattttacatataaaatagccacaaagggtgactaacagaaccttagcagcacatggatgtttgtacccccaccccaaagttacccaaaaacatttaacctgtgacctctgtaggaataacacatggagtaaaaagaaagcaaaaattaaatataaataaacaggaattaaggaatgattaacttcatgtgtttgaatactgcttgacattacctgaattgctaaacattttgttatttttggattccagttatttattgtgagcccacttgcaagccaggaattactcaagcatttgtcatacgttataaaaacaatttctcctggccaggtgcagtggctcatgcctgtaatcccagcactttggaaggccgaggtgggcggatcacttgtggccaggagttcgagaccagcctggccaacatggtgaaaccctgtctctactaaaaatacaaaacttagccgggtatggtggtgggtgcctgtaatcccagggactgaggcaagaagaggcttgaacccgagaggcggagcttacagtgagccgagatcgcacaactgcactccagcctgggcgacagagtgaaactgtgtctcaaaaaaataaataaataaataaataatttcccccataaacaaattttcagaattacctttaaagttctaaactttgcacgtaagaaatatagttttaacgtgttctaacatgaatattgttttaacatgaacaaaaacatgaacattattttaacttctaacactgttttaacatgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggcaactggtatagaaaaaagctctaatgacctttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcccggaaaccaaccttgggaggtgaagttaatgcattagcacatccctcatatacattatacattaatttctccagattttccagatactgcagaagaagaacaagtctaagttggttgttaccatggccttcatcattgtctgcagttgtccactgactaacatcctgatcagggtttaatgtgtgagctgcgagacttcgaatgatacctgaaagcaaagacaacattctgaatttttaaaaatcttaaagttcctagaataagtgtgagttttttatgacaaattcacatttatcaagtatcctctgtctacccatcatttaaaaataaaaaatcccaacatgaaagatctttcattttaggggaaaaaatatatatatattttccacacaactcccataagttttggaaaaaaaccaaacatatttccaatgcaattattcaatgaaagcttattctaacaaacatacctgaaaattattgactttttttcaaaaaaaatcatatactctcaaatctttaacaaagatttaaaaatccattatttcttaataaggctttgaaagtattcacatcacaaagcttgagcgagttaccttcaattgtctggaaggtgtcttgagctctgcccagtggggttctcagcttagaaagaacagtgaattgtgcagcttcccatatggcccactgccaaaagatagcatctgtcttcaggagattgcgtggaattgttgactggtcacacttatccagtctctggcagctatagaacagtctttccaaccaattgtccttcctgggaaaagtagtttcatatttaaaagacaatgacaacttcattttaataatgaaaaaaaaaatgcaaggggaatgggaatacggaactgtaattttccctactccaaaaaaaggcaaaacctatgaaattgagaagcattatgtccccccctctcattttgaggtcttttatagttaacaggatgaggtacagtgtggaaggatgattagggtaaatggctcatgccagtcaggaatgaaactcattcaatgcaactaagcatctctagaatatctccacccccaccccactccccaaagtgttaatgacatcacatcagttaattgttaaccacatttcattactcaatttcaaagcccatttttgtttctacagatgctatcttcaaagcaattttcctattgatgaaaactgaaataacccatatgagaagaatgttacttgatactctgccacccccaaacatattttctcttcaaaactgcatgtaaagtcaagggaatcttaaaattatctttcccagataaaatagtcaaagaaatgccttaccctgttctatgagagttcccatacaaaataaaactaataacatcagagaaatcttgggggtggaatgtattacttggtgctttactcatgtgacttcttaatgctaaagaaatttcttgaatttctgtgtgattgttattgctgtagacagaaaataaagttgttgttatgcaaaatattttagcttaaaaggttagcacctactgtaagtggattatttacttattaactcactggaggtaaaaatatagtaaaatagagactttaaaatggatacagagatgtgattacaactttagatcctttttttattcacctcagatgggtaatgtgccgacatcataagaggatttgagggaggcatatcaaacatgtgaacataaaaacccaatcattatgcttatgtattacaaaaggatcaagtttaggctcttaaaagctcccaaatcaacttgatcaaaaacaatgaaagattactgtttagtttttcaaatatctgagctactaagaaacatattttggcactacatgagttattctatactaattattgtgagcctataaagctcattaaaaatttttaattttcttgcagaactgcaaaatttgattatttgacatcacttcaatcactggcaagcagggccataaaagatgtgtcattaatgctctaataggtgatctgtcttctcctaaagtagacaaccagtagaggctgtaaatataacagaatgtctttgctccaaaacaactgttataccttaggacaacatctaaaggaattgatttcaacagttttccaaatgcttgtcgaatacgagttccacggtgcactagttgaacacggcaaacatcaacacatctatgaaagaacgaaatagacaaagcaggtgtgttaacatttccaggttattagggttaatgtcaaaagacatgatcttaatttcatacctctgtaaaagatcatctggcaaggaagaggacagagcgtgtagactgctgcatgcctgcagacagatattcacatcttcaacgagagctattaaacattaaaagacagttactttcagctggccaaaagaaattatatcccagtttgtcataattatctgaatccattcattcattcaacaaagagtgagtgcctactacagactaggcactgttcttgtccagaatccttattgactgtcacatttggaaaaatgacacattcaacaaaacccatgtaatgtaactgatgggtcatcacacaaacctttttctgagagaaaatgtaaaagtatatgcaaaatataaacattcacataagcttaaaaatgtgacaatcacttcaaaacatttttctaatactaagaatgaaaaaaatcaagactgtgtatctgtcattaaaatgaggattacacatcttcaggtcaggaaaagagctcgattgatgaccatctcccattaccaaagacccttttaaggactgataaacaaaatagaaaaaaaaaaaacagagtcttactgttggctaaaaggcctttgcaaaatttatggaaagacggaagacagaataaaggtgcatatgtttcggacttcttcattaaaacagctacttccaaagcccaagtcattaacagtttcctgaaacacaaaatatacagttgactgtacacaaaaaaaacaacaacaaaaacaaaaaaacgttaaaagcctagtcttcttacattggttttctcttggtttttcaaacatctcaaacaataaaaaataaaaataaaaaatgaaactatagaaattactgtcaaaattgttgtgtgccttttaagaaaacctcccaacgcagcataatagcaaagaggccgggcatggtggcttacctgaggtcaggagttcaagaccagcctggccaacaacatggtgaaacaccatctctactaaaaatacaaaaattagctgggtgtggtggcggtcacctgtaatcacggctacttgggaggctgaggcaggagaattgcttgaacctgggaggcagaggttgcagtgagcaaaactccgtctcaaaaaaaaaaaaagcatagaatattaaaaatctatatatattcttctatgaaacactgggggtgagggattgaggtttttcatgtatttcttttcagaaagaataagaaagcctagattaaataataaaaccaaattataaggtgtttgacaataaagaagctgctctacctcacctctataatccacatttttttaaatgttttgtaatccacatttcttattctcaaattataaaggcaaattaacaaagttaggaatagttaatactatataatatctgttacctcgtgtcctggttaaggttatctttcttaagtaatattcccagaagatttaacataattgagaaatgtttctttgtggccgtagttacagtgctaatcacagctccatcaaacaaaggaggagaggaagaactgaggctactagagataaagtgatcatgcctgaaagacaaagcatagattatcttttcatctttaatcaaagaaagcaagcaagcccaaagttaaatcaacatacatctttaaaatctatccattaaaaaaataaaatgttttgtggggttcttttgttaagaaaaatttgtgaatacagtacctggtacaatgagaatacaaagtgtagagcacagcatactgaatggtagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggacatttttaaattaaaattacagactggaagggatctagtacactacacctgggacaaatactcttttgtgaagtcagtaaagcctttgcgtgcaatatagcatctctatgcaatgcagcaactcctcgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccgcatctctactaaaattacaaaaattagctgggcatggtggcgcacacttgtaatcccagctactcaggaggctgaggcaggagaattgcttgaacttgggaggcagaggttgcagtgacccgatatcataccaatgcactccagcctagatgacaaagttaagactctctctctcaaaacaaaacaaaacaccagccacatacaaaacacaggaatgagagtacctgtgttccaagaaaactttcttgagtcggagtctctcgctctgttgcccaggctggagtgcaatggggtgatctcagctcactgcaacctctacctctggggttcaagcaattctccctgcctcagtctcccaagtagctgggattacaggtgcccatcaccacgccctgctaacttttgtatttttttagtagagatagggtttcaccatgtgggccaggctggtcttgaactcctgagctcgggtgatctgcctgtctcagtctcctgagggattacaggcgtgaaccactgcgcccagcccgagaactttctttacaaaaacaggcactagtgttgtgatggttgtacacttctgtgaatatactaaaaatcagtgaattatacacttaaaataacaaacaaaaaacaggtgctgggctgtatttggcccacggaccatagtttgctgatctctgatctaaacagagccctttgtatgtgccttttgtggaagtagactgtatttcctcaattttccatatactgcaaatggcaaggtgccctgttcaataaggaaacaaaggcacaccctgccactctacaccttttccatccatctttttcctttacactgccaagacactccattccacctgactgccccatccccacccactttctccttatttctagagtacaggacataaacatctttgaatctgtaaataatgtgaataattttcctcaaaaatcaagctttcatgtttgaagaagagtttattgtgacttcaaacataagctgtaactggtaataagcgaagcagctatggaattatacaaggcaatccaatcaaacaacacggagcacattgaagcgcaaacatcaaattttaccttcttcctcctaaaaactttattccctaattacatccattactttctttctttgtttctttctttttttttttttttcttttgagacagagtctggttctgtagcccaggctggagtgcggtggtgtgatctcagctcactgcaacctccacttcctgggttcaagcaattctcctacctcagcctccaaagtagctaggattacagctgtgcaccaccacccctggctaatttttctatttttagtagaggtgagctttcaccatgttggccaggttggtctcaaactcctgaccacaagtgatcagcccgacttggccttccagagtgctgggtttacaggtgtcagcaaccatgcccagcctacacctattattttctattaaaaataatgtttttcaactctgtgtggtccaataggaagaagaaatacacaaaccataaacaataaatacaaatcaagagcagggccacgtcaaattacttaaaaaaaaaacacacacaggctgggcgcggtggctcatgcctgtaattccagcactttgggaggctgaagcgggtggatcacctgaggtcaggagtttgagaccagcctggccaacatggtgaaatcaagtctctactaaaaatacaaaaattagcccgtcatagtggcaggtgtctgtatctcagctactcgggaggctgaggcaggagaattgctggaacccgggaggcagaggtggcagtgagccgagattgcaccactgcactccagcccaggtgacaacagcatgactctgtctccaaaaaaaaaaaaaaaaattcccccccccccaaaagaaagactaaaggttgagtatcccttattcaaaatgcttgggaccagaagtctttcagactttgtatatgtttggatttgagaatacctgcatatatataaaatgagatatgtgggggatgggacccaagtctaaacacgaaattcacttatgtttcatagacaccttctattcatagcctgaagatcattttatgcaatattttaaataattttgtgcatacaacagtttggactcatcacatgaggtcgggtttggggttttccacttggggcatcatactggtgctcaaaaagtttcaaattttggagcattttagatttaggattttcagattagggatgctcaccagtaagtgttatgaaaatattccaaaatccggctgggcatggtggtgctcacctgtaatcccagcatttttggaggccaaggcaggtggatcacctgaggtcaggagttcacaaccagcctggctaacatggtgaaaacccatctctattaaatacaaaaaaattagccaggcgtggtggcgcatgcctgtaatccgagctacttgggaggctgaaacaggagaatcgcttgtacctgggaggcggaggttgcagcgagccaagatcgcaccattgcacttcagcctgggcaacaagagtaaaacactatctccaaaaaaaaaaaagtattccaaaatccaaaatcaaaaacacttccagtcccaagtatttcagataaggaatattcaacctgtatgaatgtttctagggaaaaagagacagccaaaatataagaccatgtataagaactaacttcagtagacagaaagaaaaaagtaccaggggaagaagaaagagaccgcattttaaaacaactatacaaatttgagctgtaagaaacactgacattttctataagcatgctagagcaaacaggagaaattcataagacattttctagaaaataaaactaatataaaaaaacttatcaagatttgtcaaggaaaaagaagaaaagttaaatataatggcaagaaaacattcctaccaattttatttatccaggcatgtcttaaatatggctgtttgttacatggagaaaccttaaatgcatactggtaagtgaaagaagccaattgaaaaggctacatactatatgactccaactacatggcattctggaaaaagcaaaatgatggagacagtaaaaagatcaggggttgccatgggcttaagatggagggagggaggagtggggagagggaatgaggaaggagtgggtagaacataaaagatttttagggaagtgaaactatcctgtatgatactggtaataggggatacatgtcattacacatgttaaagtccatagaatacataacacaaagtaaactatgaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacttattttacagttatcatgggcattttttcacattagcaaagagaggtgtaattctggcagaaatgctcagcagaatgtcatctagaatttgctttaaaataagccagttagagatgaaaggatagcaaagaggcctagatgaaaccagatgggccgtttgcttctaattatagaagctgagtgttaaatatgtacaaatttattatactatgctccctatttttatgtgcttcagaatgtccataataaaagtggggggaggatatttatggttaagaaattaaaggaggccagccgggcacggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcgaaagagtgagactccgtctcaaaaaaaaaaaaaaaaaaaaagaaattaaaggagaccaggcatgactgctcacacctgtaatcccagcactttgggagggcaaggcaggaggattacttgagaccaagaattcaagtccagcctagacaatgcagtgagaccccttctctccaaaaaatacaaaggttagccaggcatggtggcatgcatctgtagtcccagatagtcgggaggctgagtgggaggatcacttgagcccaggagtttgaggctgcagtgagctctgattgtaccgctgcactccagccaggggaatatagcaagatcctgtgaccaaaaaaaaaaaaaaaagaaaagaaagaaaagaaaagcaaaaaacaaagaatctggtgcgtagagcaatgtttcctcagaaaaaacgagtaaagctacactgagactagctatcaaccactaaaaatagaggcctggcagagtggctcatgcctataatcccagtactttgggaggccaaggcaggtggatttcttgagcccaagaattcaagaccagcctgggcaacatggcaaaactccatctctacaaaataatataaaaaattagccaggtgtggtggtgcacgcctgtagtcctagctacctggggggctgaggtgggaggatcacctgaacccaagaggtcaaggctacagtgagccaaaatcatgccactgcacttcatcttgtgcaacagagtgagaccctgtctcaaaaaaaaattgcattaaaaataaaagtaaatagacactaaaatgaaggcatagattataagactgatgaatgtactctaaaaaaataatataataaagcaaagcccttatgttttttcttttttggagacagggccttttttgtcaccttggctgagtgcagtggcacaatcagagctcacttcaacctcaagttcctgggcttaatcgatcctcctccctcagcctcccgagtagctaggactgcaggtgcacaccactacaccaagctaatttttgactttttgtacagatggggtctcactacattgcccaagctgtgccagaattcctggatgccagcaatccttctgctttggcctcccaaagtgctgggattacaagcataagccaccatacccagacaaagcccttaatttcttacatatcgatttaagggcctgaataaaccaacacattaaaaaggaaaagaataattcacataccagcatgagtaaattcaagactgagatgatataatcggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaatctgtaaatggggaaaacaagcagctttttaaaaaaattcacgtgcttccacaaagcaaggaaatactttttatttaatgcaatttcaactgaaaattaactgcttgccttgccagcagtctcttaatattctagttctcagtagctgaataatgatacctttactacaatatgtaaacatgatcttggctaaaaaatcctaaagtgctactatgacaggaaatggaatctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaactttctatctactgatggtctcttttgaaagataagcactctcatgcttaccacatagtatcttcaaaaatcatatgatttccaatacacacacaaacaaaatcccccacttaactataatggccaataattgtgtactaaatttctaataaaataggggagaaaacagagcaaatgttaaaaaatacttctataatatttaacaaccaatacatacaggattttatttagtctacccataattttcattaaaagtatccttggaggttgggcatagtgactcacatctatcatcctagcactttgagaggattagctggaaggttctcttgagtccaggagtttaagaccagccatgtcaacataacaacacctcatctctaccaaatttgtttttaaattggttgggcgtggtggctcacaccagtagtcccaccaactacttgagaggctgaggtgggaggatcacttaagcctgggaagtcaaggctgcagtgagccaagatcgtgccactgcactccagcctgggcaacagagaccagtggctcatgtctataatcccaacactttgggaggctgaggtgggaagactgcttgaggccaaaagttcaagaccagcctgggaaacactgagacgccatctctacaaaaataaaaaattagcaggagctatggtgggaggatcacttgagcccaagagatagaggctgcactgagtcgtgatggcaccaccccactttaaaaagaaaaaaaaaagagctgggtatggtgacacccgcttgtagggctgagtgaggtgggaagttcacctgggcccaagagttcaagactacagtgagctatgattgcactactacactccagcctgggtgagagagtgaggctccagctccaaaaataaataaaaataaaataaaaaaataaaaaccccaccattctaccattctcaaaggcctaaaagatcctcataaatcaatatacacctatcctataaattatgtcccttttattttatgtctgaattaacagctttttatttcaactctgtacagtcttcaaacaaccaccttttagacattaaaaatgaagcaaagatattaaaccattttgaaaccatattggtttaaaataccgatatgctggtttcatttatctttaagttctgacatttctgctcaagtacacaacttactatataatcaatatcctattttatttagcaacatgttcagcaaaagtatatgctcctaaaagcaagttttatcctaacggtaaaattttcatcagttagattaaattttttatgactgtatcacacatgcttctttctccttattcacagccgagtacaatgcctggggttcatttcttgtgtcttttccactgaaccctcattggatgtgctatatacagtgcagctaatgtttgaggctgctgaagtgtggcaatctatctacctcatttttaatttgtttatgttctttgatatcaggctatcaaagaatataaagatatacaagttttcatatgagttccatcttatgctcagagaagattactttctgaggcttctcctatagtgtgctattcgtaatatgttgaaaaactaaaaggaaacccaataatttaaaagtaaaattataagaaatattatttaaaaatgaaagaataagatttaaaaattcagagtggccttttgtcatgggagggtagggaagttggatgaaaggaggatgagatataaaaggattccctgcttttctggttatttaagaaagcagtcagacaatatatacatatacacatacatacatacatgctaaacaaatgaaggattaataacagttcacctggtaaagagaagcatttacaatgtaaaacaattttatttttgaatgacacttcaaatgcccaaaagcacttacatctgttacgtatgcctcagtaatcggaggacccgaattgggctgaagcgttccccaatgctcctcaccacagtactaaatacccggagaagcgcagtcagctttggtaatgacactgatggaggagggacgtcttcatccactgattccccagaggccacatggctgaggtcctagatgtgaattcacagcattcttaataagtagtacattgtttaaaaaaaaaaaaactctaaaatatttcaatcaattcattttagaatagatttttaggcttttagaaagagaactgtggcccatgagaatattcatgactctgaatataaaaatgggttttacctaattatttcaaaaagccaacattaaacccaatagacaacaaattaaggaaataatctcttaaatcaactcagaaagctgttggggaaaaataaattctagcacatatgctctagttatatgtaggtataaatgaagacggaagcttttgccactcctgaattagtttttggctaaaaatctcattctaggtattctttgagccactcagctcaacagtaagtcctccaaaccaagagcatgcacatgaagagcaaagggagattacaagacctggtctacagatgtgtaactgaagaagtacgatatatgaaaaggacaagattcgcaaaaactaggatactagaaccaatctatacatttacctaaaattaagcaccaaaataacagaagagaatgagatcttaaggataacaaggggaagcatctctacaaactagaatgtgtggcttatgagaggtagatcagctttaaacgtgggctgtgaaaaaagacattctaggtgtgggggcaaagaaaaaacaacacagaagcaaaacatttccttgcttttctaggaaagagtaaacacatcagtacagctaaaggtactgaattcctgttgactacaagcagcaaagatgataaaaacaagatgaggccaaaatctttatgggagccttgattggttgatctgaataggggagaaacacaaagagattcagataagagatagcacagagttaagccatgacagtggggccagaaaagccaagtaccagtaacagaggcttcagcagtgctcttaaagctcctatgctatattcgtacagccacaaaagctggctgaagccaaggcctgtcctccaaagtacgattcagatctcccgtacatatgtaagaggaaaatctttaggagcttttggtgttttgtgtttttttataacacaacatcaatttgctttaagactctgaagactgggaacaaaaaataaaaataaataacaaaaaatgtctttagaaaaataccagctaccaagagtatgtaaagctttgcgaaatacgaagcttgcaacgtttcttttagtctctccagtaattctcctggtaacttaaatacatctgaaataaatgtttaaaatactgactgagcacgggggctcatgcctataatcccagcatttgggaggccgacgcgggtggatcaccagtggtcaggagtttgagaccagcctggccaacatggtgaaaccccgtctctactaaaaatacaaaaattagctgggcatagtggcgggcacctgtaattccagctactcaggaggctgaggcaggagaatcatttgaacccaggaggtggaggttgcagtgagctgagatcgtgccattgcactccagcctgagtgacagagtgagactccgtctcaaaaaaaaatttttttttcaaaatattgcaatgggcttgtaatttctgcttaaatgtcaggaggtctgagccattttaaaataaatctagcacaatttaagattttttcttaaccaaaattttaagaaacagctttctatatactcacctcagcatatgcttccatgtcttctagaaaatgaccaagaagagtcgtagaaaatgcaagatcagctacccaaaatggctccaaactctgcaaccacccttggaatcgtataagaaattgtgaaagggtggggggagaaaaaacaccaaaaaatccaaattaaaaaaatataagaggcttgttttaaaaagtatccggttttcaagcagcataccctaaaacatgtcctatatcataaaattaagactgctaaacatgctgatcacgattaaccaatacctctttaattaatacctctttaatttctgcaaaaattaacatgtaaatgttatttccttactttttcagtaaatttcctatctatattgtcactacacatgacttaacactaaaatgccacaatctaccattggcctggctaatcccagggccacatctaaccattaaaggtgtatacttatctcctcagtgaaaatgaaacagaccactatcacctgaatatcctattttcaaaagtttattacaccaagtaagttacgagaaactatgacacttgaaacaagctgaaatgtgcaaatgagccatgctagtcattcacttaactccaaaaaaatgggaaacaaaaccatttctcatttatgacaattctccaaattaaccctatttccttttttaaaaaaataaccagaaaaacaataaaatgttacaaataacttggatcttccattgtccacttcagggtattgccactgcaatatattcttaccatatactttttcctaccagtacaaactacaaataacttgggtaagtcctgtctgtacttattctacccacctactagtaatttcttctgaaaatatatatttagctaacaagtaatgttcatttacaatataacatttctctgaattagttttcttgcattattaaagaaatgttattgatagatggtcactgggggaccactgctcctccccgacagtatttaaataactggtataggctgcaagacttaccagatacctgctgcgtgagcgaaggtttctgagtatgatctatatgccatccaactaatatatcaactgtatccttgatggaaacaaagagagagggggccaatcattttaagatattactgccattcacctgtggaccattccacagcaaaagatcctaaaaggagcatctatgttctacctactcaacattctagaaacttagaaaggggagaggggcaggaaaataaaagaactacatttctgacaacaatgaaatagtttattttcttcaaatattttaaggtacgaacgtcagaaataaaaatgcagcatttaaccctggaacctcaaatatcactgattatactcaaaggagcagaggcattgttttccatctgattcctcagttcctcacacacacaaccatccccctcaccccatgatctgaaaagcgaaatgaggaattcaccctaaaattagtgtggagaaaacaagcaaattaggttatttactaagtgactacataaaaaactgagtatgagaccaagaaaaatagattctgtagttttagttaaaaaaaaaattgacttgtaaatcccaactactcgggaggctgagacacaagaatcgcttgaacccaggaggcagaggttgcagtgagctgagattgcaccgctgcactccagcctggacaatacagccagactccatctcaaaaaaaaaaataattaataaataaataaaataaatatactgaaaatatttcactccactaagatgttaagctaaaaacaaatactgttttctcttcttcaatgtttgttaacattagtccttaataacatctgtttacaatatccctaaatgctctctttaagattccacctgtgattaaatttcaaatacaaaaaagtaaaacggatttgggaaacttttctataaagtacagcaattaatttgcaatccaaaatataaagcaaattttatataatttatgctttactatattagtacttgcttcacattaaaattaaagatcagtatggcaccacacatgaataacatgcaggctcaggttaccattatacataaatttttaaaataaatatatggcaaaaataataattgtcattccattgaaagaatatttattttgcagctgttaaaagacatttttccctaaaaaaagaaaagctgtgctttacatagcaatcttataaaagaaatgctagaatcagaaaaccatcattttaggctgggtgcagtggctcacacctgtaaccccagcactttgggaggacgaggcaggtggatcacttgaggtcaggagttcaagaccagtctggccagctcgatgaaactccgtctctactaaaaatataaaaattagcagagcacagtggcacctgcctgtaatcccagctactcaggagggtgaagcatgagaactgcttgaacctgggaggcggaggttgcagtgagccgagattgtgccactgccctccagcttggacaatagagcaagatttcgtctcaaaaaaaaagagaaaaagaaaaccattattttgcaatagccaatgttataatctacacaggcacagactatcaatgctaaaaatcatttaaaagacatcttaggggtaattacagaaatttgaatatagaacacatatgtaataaaattcattttcttaggtatgattacaatattcttgttatacagaagaaaaaccttattcttgggagatgcaaactaaaacattatgggttgaactgtcatcatgtgtatggttttcagatgctcaacaaaagtgtgtgagaaaataaaactggcaaaatattagtaactggtaaatctaggtgaagcatattattatgaaattattatcgtatttacaggtatttattttactggtgcatctatctttctatgaatgtgagaattttcacaagagctgggaaaatgttcataattatgcatgcagaataagcccaagctggtggcattctgttcagttacaggtaattttctgaatcttccctcaaatttttctcaaacctctataatcaaggggaaaaatgttttgttttgctttgcttttttgagatagggttgcctataatggagtgcagtagcttgaccatagctcactgtagcttcaacctcccaggcacaagcgatcctcctgcctcagccttcaagtagctgggactacaggtgcataccaccatgcctgacttattttttttccttttttttttttttttttttttttgatagaaacagggtttcaccttgttgcccaggctggtctcaaactcctggactcaggcgattcaccagcctcagcctcccacagtgctggggttacaggagtgagccaccatgcccagttaaaaatacactttttatttaaaaaaaaaagagaacactccttatatttcctttatattttgtaaactacatacccaaaataaagcatatcaaaaactgtaaaaaaaaaaaaaaaaaaccctaatatcagatattccagacacaacaataccataatttaatcacttaaaatcttactcaaaactaaatcaatgatcttttaggccaggtgtggtggctcatgatagtaatcacagtactttgggaggccaaggcaggaggatcacttgaggtcaggagttcaagaccagcatggccaacacaatgaaaatccatctctactaaaaatacaaaaattagccaggctaatggcacactcctgtaataccagctacttaggaggctgaggcaggagaatcgcttgaacctgggaggcagaggttgcagtgagccgagatcatgccactgcactccaggctggacaacagagcaagactccgcatcaaaaaaaaaaaaaagatattttaatatattcagatacacaaatatgaaataaaactaagtagagctggtattcatttacacataattatcttataccgtttggaataagaatttggggcacgttagcaaaccaaaaggctcagaaagacgtcgtgatatttagttcttgtctccctctacaaatgtgaagcactcttctatccggcattcctagtggagttcctattttcaaatttgcaaatcattctggtgctaagcaatctcaaaaaaaacatttactaaaaaccagaggaaaaaaatcttataactttgggaggctgaggcagatggatcactgagatcaggagtttgagaccagcttggccaacatgatgaaaccccatcttctctaaaaatacaaaaagttagctgggtgtggtggcaggtgcctgtagtcccagctattccagaggctgaggcaggagaatcacttgaacctctgaggcggaggttgcagtgagctgagatcgcgccattgcactccagcctgggcaacagagtgagactctgtctcaaaaaataaatataaaaaaataaaaagctgctattctccattaatacctgcaggcccgacaaaggcagcctaggaattctagatgaatggaatgaatacaacttgctggaagttcttaggaaacaaaatgactattcacagaaccaaataaaagccttccactagaaactaaaaataataataataataataatggttttatatatatgcatacacaagcaaagccagaagagaataaatagcaaatgaatgaaaactagaagcaaaaacaaacaggaaaccatctctacattttttttactcaatcgaccctgaatgctacagcattatccagggccgcagaaaacacacataatactttattcctgataaacaattcgatgtccttaagtccgccaatatcaccgtacattctgtgcaatcaagaaatttactcagctgggcacagtggctcacacctgtaattccagcactttgggaggccaaggcgggtggatcacctgaggtcaggcattcgagaacagcctggcccacatggcgaaaccccatctctactaaaaatacaaaaattagcccggtatggaggcatgtgcctgtaatcccagctacttgggaggctgaggcaggagaatggattgaacccaggaggcagaggttgcagtgagccaagattgcaccattgcactccagcctgggcaacagaacaagactccatcaaaaaaaaaaaaaaaaaaaaaagaaagaaagaagaaaagaaaattagccaggtgtggttgcatgcacctgtagtcccagcactttgggaggccaaggcaggaggatcaatcaaggctaggagtttgagactgcagaaagaaaccctgtctctaaaaaaaaggtccaggtaatttcagggtccagctccaccacaagcgcagctccaggggctgttgagttttgcctttatcattccaagtagtccctgctccagaccaagtcccaccatctggcagtcaggtcagtccaaccacagtcatatcagggcccttccaggaattctcgacgcaaactggaggccgatggcgcgggtcttttcgtggacggcggcagcacggtcctcggcttgcgtccgtagttgctcaggcttctggttcagggctgggcggcggcgcccctgcggcgggcggcccgcaccaggctctgctgcagcacggggtagaggcgctggcagccctcgaggcccaggcgtacggcctccgcccagctctctgtcaggccgccctcgccgctgcccagcagcccggccacctgattcagcacaggcatgagcgccacggtgaggccggcggcggcgcgctcttcctcgagccgcgtggggtccaggagccaggtgggcgcgggccccggcgcgaggctgaggccgcagcccaccaccaggtcgtacatctccacgcccgcgtcggccagggcgagcgcggcggcggtgagcgcggcggccagggccgagccaccgtcctccagcagcagcgccgacacctcgagctgcgcgcgcgggtagcggcccaggcgcacagccggctccagcgcctcctgcagcgccagcgccagctcacgctcctcgcagccgcccgggggagcgcggcgccggcggcccgcgaagggtgcgcggcggaagtcgcagagcaggcgaccgcgcagcgcggccggggcctcgccgcctgctccggccgggccgccgccgcgctcgccgccctcggcctgtcgcgggcccgacacggcacacagcaccttggtgcctcccgcctccaggtaggccgagcccttggcctggctcagcagcccggcgcgcgcgtacacgggccgtagccgcgttgggtcgcgggtgccgggcgcctcctcctcgtcggccgcgtacagctgcggcggctgcgattcttcagggccgcggatgcggcggtgatccccaggcatggcggttcttggcgtgcgaaccccttccgcccaacgccctgccgcatccactggttcttccgttgtttaaagacgcgcggctgcgcatgggctgtcgagagagcggcgggaggcactacagcgcccctggaggcccggagggagaacggcccggtcccagttgtgcagggtagccggatccatccatcttgctggaagggaggggggagagcagctccaagaaaggcttctctgcttccaactacctccacccctcatctactgaattatgaacgccttgctccaagtcaccccacctatttggcctccacctccacagacgtttgaggcagccctaggggctgttcccaaaattttgggttctggggctggactaggtgaacaccacagcagccagcaggagccacagcatttattctacagacgccaaaggctgtcaaaagagccagcccctattgggaagagggatagagatcatgcggcattaagtattgcacgtggtccttttattctctgcagcaaaaacgattcctacttgctgacgcggaaagctcaggtctggagagccgttatctatagatgcgagcgtgacgatcaacagcaatgcggggttagtggttctagaccgatggcactgacgtggagggctcagggcagaaatttaaggggcactgagacataggactgctcccaagtgtgttccagttactgctgggttaggaggggctctttaaaggtcccaagattcaaatgttcttgtagcagatgaagagctcttggctggacggatggatccagtgggagcctcctccttccccactcagttctttacatccccgaggcgcagctgggcgaaggaagtggccagctgcagcgcctcctgcaggcagccaacgttcttgcctgtggcctgtgcagacacatccttgccaccacctttaccgtccatcaagcctgacacctgctgcacccactcgctggcttttaagccccgattggctgcattctagaagacaggaagggaagggggagtcagcacagaagatgggattgagggaggaatgcagggaaagaaaggatggaggagccatcacccactccttgccctgggtgatactgctggaggccgagacagactttacggctggtacagggggcggccatggccactgccaggacaggacagagtggcaaagccaggtatcaaccagatgtcttcaccaataagaaggcctgggtaaggggtactggcaaaggtaaccaaccggtgggcagaaaggctgtttcgaatgcaggctgtacacacacaggcctcagccaacaaccttaagacctaacacttcccactggtgcgaggtggtgctgacctggggaacttgacacaggcacgtgatcttgccagcctcattgtccaccgtgaagagcatggcagaagtctgaggggagtgcatcttgaagagcttcaaggcttcattcagggcctgtggggaggacctggctcaggccacggtgctggagcagggaccctcactagtgtgagcatttgcagccctcagaaggcctgccacccacccctaccccttcccagagcaggggctgtgcccagggcctgtggggaggaccccagcgccgggccctgcccctaccctggcccaggtatgcctcccacatgcagggagctgctgctcctcccaatctcaatcccagaccgtgggcccttaggcaaccacttcgctcagagccacagaggccacatgtcagccaccagagagctgatgagccctaggggaggggaccctggcccctgggttgccttggctgaggcgccgctctccatctccaggatgacaagaggctggttggggttgctgtcgatgaactgcttcgtcttctctaacacctgcaagaaaaaagtccagaacagcagctcagaccaaaagcccaggccccgaacccctggctgttctgccagcctttgcctaggaaacactctggccactggtgctgccaggactcactcgtttctggacatcggctttgctggctcggtccaagtcatccatgaccttctttagggatttgagagtctcccgcaattcatccttctgccactgggggatgactgcagtggccagggcctggaaccaatagacgaccatctcaatctgggccacaacttgctgggatgtcagggtccagcccaccccacccgaacccaagtcctccctgactagtgtcctggaaaggaaagcaaggaaagctttgagaccagtccctttaggagcagctgtggcaggtgaaacaagcagggctagagagaaaggagcagcagaaagctgggctcccaaatcaggcccggtccttaccaggctgggaacagcctgtgataagcttcctggcagcttgaaatgcaaataaataccaggcaggcttggaagcaggggccagccttagcccattccccaaatccctccaccccagtgcccatacatgcttgggaagagctctcctgctagcagcactgggagcagcagggaatgtccagggtccaaggacaggatccatggggtccctgctacaaggctacaggacaacagaagtcagcccaaaggcccattccaccaagaaccagggcctgactgactacagatgatttcctgaagacggggcatgtttcatgcaccaggccctgaggacggagggagggaagccgcccctacctctccaaggtcagcgatctccctctgcacatccttgtttggagcagtctgagccttcactttggcttccatgacagagagacatttcttcaagctctctgctttcctgagggcctgggaggggacaccgggtcaaccccaagcaggaggtctgagtcagactcactatcctgtgtctgagcagctgcggaagccccggcggtaggccttgcagcaacataccccaacaccccaaaagtgtctgtggggagtaggtgctggcagccccaggccccagcaaggagcacagtgctcacaggcccattggcaaaggctgcacccaactcagactcaggggtgatcaagctcgagaatcaggagccccttcccccaggaagtggccacccctggggctttagcacaagtcagacacaccagttcccatgaaagagcacccatcctctactgcacggcctcagactaagcacgcccctaggagtacatggatcagcgctgggggccccgatgccacagcgaatctatgtcttaccctcctccacatggagacaggagggggtagatggccagattcacattttttttttttttttttttttggagacggagtctcgccccgtcacccaagctggaacgcagtggtgcgatctcggctcactgcaacctctgcctcccaggttcaagtgattctcctgccccagcctcccaagtagctgggattacagacgcgcgccactacacccagctaatttttgtatttttagtagagacagggtttcagtatgttggtcaggctggtctcgaactcttgacctagtgatccacccgcctcggcctcccaaagtgctgggattacaggcgtgagccactgcgtccggcctgattcacatatattttaaaagactaaacataggaaagctaggagatcttgtgtggtggcaggtttcttctgccactcaggggtaggacactggggcagggggagtggcccagcctgtactttcactctgactgcagcagccacgcagagcagtgtttgctctatggattcgcagactgggctcctcttgccttcttcagataagccacaaaccagcctgacctgctcaccttctgggcctcggcacctgtgacagccacaatcctccggatacccttggcaatggcttcttccgtcacgatcacaaaagctcctgcatgactcgagttccgcaggtgcctgaatggcagaacacaaagtccatagtgaaagaggccctggcagcccttggctggggggtcacactagcggacaagagaagcaggaatgggttgacagtcagggaaagcctgggcttgagagtattctgacaccaagcgggacaccagctcgctgagcctgagtgttctcagttctcaaatggggatgattctccccacacagttgctgtgaaaatcaaatgaggtaaacatgaaagtgctttgtggtccctaatatccaatacagtcttacccttaggctctacgtgacagttttggtcttgtagtggaacttaagctccatttttgtattctgctcactaggtgacaattttggaggattacttttaaaatcttaccacaaccccttaaacaggctttatttctcagttcagagaacctcaaatgttcattaattcatcctcattctttgaagatagtatagttttttttgtttgtttgttttgagacagagtcctgttctgttgttcaggctggagtgcaatggtgtgatcttggctcaccacaacctctgcctcccagtttcaaatgattctcttgcctcagccacccaagtagcttggatacaggtgcccgccaccactcctaatttttgtatttttagtacagacaggttttcaccatgttgcacaggctggtcttgaactcctgacctcaagtgatctgcctgcctcagcctccctaagtgctgggattaaaggcatgaggcaacatacccaacccttggtataaagtttttgaaagctgtttcctgtagtctaaagggtatgagcaaacaggtaatcaggcaaagtgggactcgtttgaaggcccaattcagctgggcagaaaagccttgaactcaatcccccaggcccctatcctactctctgcacatcctacttgctccctgcctgccagaggcctgcaggagaccctggagggtctcaaccatgacattaagaatgttcttttcagccgggcgtggtggctcacacctgtaatctcagcactttgggaggctgaggcgggtgggtcacctgagatcaggagttcaagaccagcctgaccaacgtggagaaaccccctctctactaaaaatacaaaattaggccaggcacggtggctcacacctgtaatcccagcactttgggaggctgaggtgggtggctcacgaggtcagaagatggagaccatcctggctaacagggtgaaaccccatctctactaaaaatacaaaaaattagctgggcgtggtggtgtgtgcctgtagtcccagctactcaggaggctgaggcaggagactcgcttgaaccctggaggtggaggttgcagttagccaagattgcgccattgcactccagcctgggcaatgaaactccgtctcaaaaaaaaaaaaagaatgttctcttcatggctgggcatgggggcacatgcctatagtcccagctacttgggaggctgaggcatgagaatcgaagccaggaggtagaggttgcaatgagccgagactgtgccactacactccaccctgcgggacagagcaagactccacttcaaaaaaacaaacaaaaaaaaccacaattcttttcacaaggcttcatttggaagcagaaactttccaggccaccatgaccttcccaaaaaggcccagagagatacagaggaatccaaattggcagaagtggctatcccaagccaaactgagctgagtcaaccacgtggcctgctcgggggctctgagacaatggagctacattccccagatgccgcccaagctgtcaaaggaaattaggtgagataccaggaatgggaagggctaggcccacatcaagagctcaacaagcactccaggccttgctgaatcccaaattcacacaagccttcttgctagtttcagcccagcaaacaacagcaagcaactgtgtggtaatgtgaatacaatgttttcccccttttcctcctgggaatgtttcgtcaggaaatgttaccttcagatacagggatctaatgagcatgctaggatgctgagattcttgggaacgctatttagcaacggcatttctgaggacttcacttcaaccttagacagacaagagttggtccagcctaagacctacatcctcagaggatgaaggtagatgacctgtctactctgcccctctgcagtactcacgttcccccacagaactcaacagaagtcagggagccagcaggcccagaggggtcatccagcaactcggacaccgggaccccaatggagacgactcgcacagggtcaggataggtctcatcaaacacagcccgtaggccctggatggctttcgctgctgccagggggcaatcctgggtatagacggcctgccagaccaagaagacagaaaagagctggaagagatccctggaggtgcggtacgacgaggcaggaaagcatggtcctgcaggcaggactcgggttccaacctggcttggcctagcacgtgccatgagcttcctcaatcacacgccacgtgcaaagtcaagggcatcagtatgggaatttccaactattttgttaaactgtggaccaaatctcatatgtgaacagacttaactagaacagctctggttctcccaaggtggggtgggacaaatgcctctccctctcccctccaccaaccaccaccactgcccccggcaaaagcacagatggagaatcactgctttaaacaaactttttttttttttgagacggagtctcgctctgtttcccaggctagagtgcaatggcgcaatctcggctcactgcaagctccacctcccgggttcacaccattctcctgcctcagcctcctgagtagctgggactacaggtgcccgccaccacgcccggctaattttttctatttttagtagagacagggttagccaggatggtctcaatctcctgacctcgtgatccgcccgcctcggcctcccaaagtgctgggattacaggcgtgagctaccgtgcccagcctgctttaagcaaatctacgtgcaggacgaatctgatacaacagagtgagagcaccgcactgctaagactgtggacagacagtgacggtgtggggagggggggcattcagccgtcgcccatcctaccttggctgcct

SEQ ID NO: 420 - DNA, 132088 bp, Homo sapiens
gtgcttgcattggttgcaattctgagagtcatctctgatggatggacatagataccttggccttggacaatttgtgctgactgtggagcatctgtgggtcctgtggctggcagtggaggcggtaaggagatgactagcagtgagctaccctaaggcccccttgtctaccgcctctcgtctcaaagtcctcatcctcctgtacacatgactgcatggacagccagtaggtgctttcttcttcagtttcttgaaacttgaacagtcatctgttttgctgatagattaagtttgttaaaaccctgccttgtccaagggcagtggttcatgcctgtaatctcaacactttgggagaccaaggtgggaggatcacttgagcctaggaagtcaactctgtttttcttataattctaccatccgctctccaccatggagccagactgacctttggaaaacatcccccaaccccccaccgccaaaaaaaacaaagaaaagaaaaacatcccagatcatttcattcccctgctagtgatactcccgcatgagtgattttcctttgtactttgaataaaattccaactcctgctgatggcacccaagggctgtgtgtaactggcttccgcctgcctctccagcattgtcttagatcatctccccacactccccgtgtcgtgtacatgccggcctcctttttgttcttggtctgtcttacctcagggcttttgcacatgctcgtctcagtgtctgccaaatgtatagctcgttccttatccttcaggtctgtttccaaatgtcacttccttggaggctgtttctgaccatcctgttttaaatatgcccctagttactctatcatgttagctttatttactgttttatttgtatgtttatttgtatattgattggtgttctcctcattcacacacgcaaactctcaaatgtaaatttcataaagacagggacttccccattcttgttcactgctagcagaatatctgaaactcagaatgccctcaaatatttctttttttgttttttttttgtttgtttgtttgttttttttttgagacggagtctcgctctgtcgcccaggctggagtgcggtggcgcgatctctgctcgctgcagcctccgcctcccgggttcaagcaattctcctgcctcagcctcctgagtagctgggattacaggcacctgccaccatgcccagctaatttttgtgtttttagtagagacagggtttcaccatgttggtaagactggtctcgaacccctgacctcgttatccactcgccgcggcctcccaaagtgctgggattacaggtgtgagccactgcgcccagcctaagtttttgaatttttagtagagacggggtttcactgtgttagccaggatggtctcgatctcctgacctcgtgatccgcccgccttggcctcccagagtgctgggattacaggtgtgaggcaccatgcccagccaccctcaaatatttgctgaatgaatggctatcgttctttgtcaaatccctttctcattaatcccatgcactgagtagaatggcatgaaatatgtttggtttctctgtctagtttgagttcctgagatctagttggtgagagacatgatgttctaccggttgctgtcgattgttggaagacaaagagccagcccaggatggcagaactggtcctctgcaagaaacagcacgtcagctgccgaggcgcgttccatggccctgcccacccaggcacaggtggtcatctgtggaggtggaatcacgggcacttctgtggcctatcacctctccaaaatggggtggaaggatattgtccttttggagcagggcaggtaaggatcagactgcatttggctcatggctgtgctgcactaatcgtataagattccctctcctttcagagatactgccccaccagtagctaatctaaatgttgctaagtagcatgagaagaagcaaggtggaatctcctgaattttgtttaaggatgactaataatgctcatgttctctggtttttagagagttggcaaatttcgttttccttttttttttttttttttttttttttggtggtggtgttttggtagacaggatctcgctttcttacccaggctgagcttgaattcctggcctcaagcagtcctcccaccttggcctcccaaagtgctgggactacaggcatgacccactgtacccagcaacattttagactttgacaaaaatttgcgtttgtaaataatgtggattgcatttaagcaaagtagacaactgcttgtgtttgcttaattgctaggttcttaatattgttctcattccccaagagaaatatgctctataggcttagtttctctgtgctcgccttcttttaggtcaagtattttctgctttattggcttgtaagctaagtccctttatattaatttgtaatagttacagagattacagaatggattcttataatccatcattaattaatattataccactatacaagtaatgttagattcatacaacaatattggccgggcatggtggctcacacttgtaatcccagcactctgggaggctgaggtgggcagatcacctcaggtcaggagttctagaccagcctggccaacatggtgaaaacctgtctctgctaaacatacaaaaattagctgggcgtggtggtgtgcacctgtaatcccagctactcagcaggctgaggcaggagaatcgcttgaatccgtgaggcggaggtggcagtgagcagagatcatgccactgcacgctagcctgggtgacagagcgagactgtctcaaaaaaaaaaaaaaagaatacaggcctttgactctgataattctcaacctgtgtttagctaatgttttcttattcccttttttttttttttttaagatggggtcttgctgtgtcacccaagctggagtgcagtcacactatcacagctgactgtagccttgacctcgtggattcaagcagtccttctgccatagccttccaagtagctgggactactgacatgcaccaccacatctggctggttgttgtatttttctgtagagatgggatctccctgtgttgcctaggctgttttcttttctttcttttttttttgaaatggagtctggctctgtcacccaggctggagtgcagtggtgcaatttctgctcactgcaacctccgcctcctgggttcaagcaattctcctgcctcagcctcccgagttgctgggattacaggcacccaccaccatgcccggctaatttctgtttttttagtagagacaggatttcaccgtgttagccaggctggtcttggactcctgacctccagtgatctacccaccttggcctcccaaagtactgggattacaggcgcgagccaccacacctggcctaggctgttgtcttgtgatcagacttgggttagagacttttataaccatcactgtattgagatacaatttgcataccatgccactcatccttgttaagtgctgaaatctgtttacagagttgtgcatccatcatcataaccaggtcatacatttttggcagtaagaccacagaaattaggctggactctcagcagtgcaccacatcaggaggtgtatggctgtcctgtctcacttctggtggtgataaacctggtcactcagttacattggtgtcctccaagcatctctagcacagagaccctgttttctccccttgtaatgggccagtgccctttgaggagagatggattctgagattatgccaatatcctgttcatatgagacctccacctaccgggcttagcatccattgacaactgttgcctgagtcagccaccaccgtgatggttgacaaatggtgattttttgatcatacttctacatttattatagttggcatattactgtcaggaagagatttccttctcccccatttatttactcagttatatatctgtatacacacatacacacacacacaccagtttagactcatggatttctattttatgcagtggatagttttttttttgagacagagtcttgctttgtcacccaggctggagtgcagtgacgtgatctcggctcactgcaacctgtgcctcccggattccagtgattctcctgccccaggctcccaagtagctgggattaatagttgcatgccaccacacctggctaattcttgtatttttagtatagatggggtttcaccatgttggccaggcaggtcttgaactcctgacctcagctgatccacccgcctcagcctcccaaagtgctgggattacaggcatgagccaccgtgcccggcccgcagtggatacttttaagagcaaaagtgggttttgtttttgttaatgtttttgagacagagtctcacgctgtcactcaggctggagtgcagtggttcaatctcagctcactacaacctctgcctcctgggctcaagtgatcctcccaccacagcctcctgagtagctgggactacaggcatgcactaccatgcctggctaattttttgtttttttggtagagacgtgatttcaccttgttgtccaggctggcctcaaactcctgggctcaagtgatccgcccacctcaacctcccaaagtactggggttacaggtgtgggccgccacacttggcctcataatgcttccttgatgtcaaagtctttctcctattttttgaaatccttttaaatttaattatcaggtatttccacaaaaagtgataaactaatcgcagtgtaaatgtttctaagtgggagaccctagggaggttcatttttggtttaatttgttgcttcaagattatataataccttagaattgatataaggcagactatttaaacctcacacttaaaaataattacgccagccaggcacgatcgctcacacctgtaatcccaggactttgggaggccaaggtgagtggatcaccggagatcaggagttcgagaccagcttggccaacatggtgaaacgccgtctctactaaaaaatacagaaattaactgggagtggttattcgcgtctgttaatctcagctactcgggaggctgaggtaggaaaatcacttgaatccaggaggcggaggatgcagtgagccaagatcgcaccattgcaccccagcctgggcgacagagcaagactcagtctcaaaaaaaaaaaaaaaaattatgcctcggccaagtgcagtggctcatgcctgttatcccacgactttgggaggccaaggtgggtggatcacctgaggtcgggagttcaagaccagcctgcccaacatggggaaaccccgtctctactaaaaatgcaaaaattagctgggcgtggtggcataagcctgtaattgtagctactcaggaggctgaggcaggagaattgcttgaacctgggaggcagagattgcagtgagccaagtttgtgccactgccctccagcctgggcaacagagtgagactgtctcaaaaaataatagttattattatgccttatccgtggcttgtgaaatggttttatactgccctttatgtataattattcctcttgtccatcttcactattgttctcatagatcaatgggtcttaaatctgtctgcacattagaatcagctggggagcttttaacaattaccagtgcccagacctctccccagaacaaaccagaatctctaggggtgaggccaggcatcaatatttttaaaagcttccccggggactctaatgtacctccaagggcgagagccactgtcaaagctgctcaaggagtgctatcccagcagagacgtcaccagagctataggtgctgaccaccagccagttaatggaactcccacctggggtggagctccacacagttacaaagatgatagaaaaatctctttagggagctgacaatcttatgtggaaaatataattattagagtaaatacagtaaactcaagtgacaggcatgctgacacagatgttagtttatttactgagtgataaataatttggggaaaatgaccttagaaccccccacctgctttcttgacatatgggtcccttgcaaaactgggtctttgggccctagcattactgtagcctttatattctgttgctaccacaaattagagaacatttttttcaatgtaaagtttatgtacttttgaataggcaatgtatttatatgattcaaaattgaaaatatgtaaaagaagctgggtgcagtggcttatgccggtaatcccagcactttgggaggctgaggcgggtggatcatctaaggtcaggaattcgaaaccagcctggccaacatggcaaaaccccatctctactaaaaatacaaatttagccaggcatggtggtgcacacctgtaatcctagctacttgggaggttgaggcaagagaattgcttgaacctgggaggtggaggttgcggtgagccgagattgtgccattgcactccaatctgagtgacgagcaaaactccgtctctaaaaaaacaaacaaacaaaaaaacaaaaattagctgggcatggtgacacacacctgtaatccctgctactcgggagactgaggcaggagaatagcttgaacccaggaggcagaggttgcagtaagccgagattgtgccattgcactccagcctgggtgacaagggaaactgcgtctcaaaaaaaaaaaaaaaaaaaaaagtatatatatatatatgtaaaagagtatacaggaaaaagactccccaatgttctttccttttctttctttttttttttaagatggagtcttgctctgtcacccaggctgtagtgcagtggtgcagcctcagctcctgcaacctctgcctcctgggttcaggcgatcctcctgcctcagccttctgaatagctgggattacagacgcctgccaccatgcccggctgatttttgtatttttagtagagatggggtttcgccatgttggccaggctggtctcgaacgcctgacctcaagtgatctgcctgcctcagcctcccaaagtgctgggattatagatgtgaaccactgcacccagccctcaatcttcacttctaacaaaaagctttctctctggagggaagttaagttctagttatattctctacttctataagcaattatgtgttggtaggtttgtgtatatgtgtatggatattcatttattatattttttctcttttttatataagtgggagcataccttacacactgttcttcaccttgctttttcattatgattgttccattttggtacataaagaccttttcattcttttttatagctgcataatattccattgtatagatgaattccaaaattttattttattttagagatggggtcttgctctattgcttagtctgaagtgtagtggcacaatgctagctcactgcagccgcaaacttttgggatcaagggatcttcttgcctcagcttcccaagtagcctggctaacttttatctttattttttttacttttttttgaggcggagtctcgctctgtcacccaggctggaacgccgtggcacagtcttgactcactgcaagctccacctcccgggttcatgccattctccttcctcagcctcccgagtagctgggactacaggcgcctgccacaatgcctggctaattttttgtattttttgtagagacggggtttcactgtgttagccaagatggtttcgatctcctgaccttgtgatccgcccacctcagcctcccaaagtgctgggattacaggcgtgagccaccgcactcagcctttatttttatttgtttatttatttttatttttatctttttttggtagagacacagtctggctatgttgcccaggccagtcttgaactcctggcctccagtgaacctgctacctcagcctgtcaaagtgctgggattacaggcatgagccactgtgcctggcctaaactatccagaattttaaatctgtcccatgtcattgaacatttttctcaccctgttgcccaagctggagtgcagagatgtgatcacagctcactgcaacctctaccttttgaactcaagcgctcctctggccttagcctcccaagtagctgggactgcaggcatgtgctaccatgcctggctaattttgttgttgttgttggtagagatgggttctccctgtgttgaccaggctggtcgtaaacccctgtcctcaagcagtcctcagtcctcctaccttggcctcctaaagtgctgggattataagtgtgagccactgtgcccagcttgtttccatcttttggtgttagaaacagtattaaatgagaaaccctgacctcgtattcacagatgacgtcaatctacctaatagcattttgcatccatcctgcaggctggctgctggctctaccaggttctgtgctggcatcctgagcactgccaggcacttgaccattgagcagaagatggcagactactcaaacaaactctactatcagttagagcaagaaacagggatccaaacaggtaagcaagtgtcttccatttattgctttgcctgtccctgagattgttatattcatttctgtatttggtcctctgccaggtgtgcctgctgctttggtaattaaaacttgggttggccgggcatggtggctcacgcctgtaatcccagcactttgggaggccgaggcaggcggatcacgaggtcaggagatcgagaccatcctggctaacatggtgaaaccccgtctctactaagaaattaagaaaatatgtaaattatccttactgtacttcttttgaaaataagataccaaattgcttcaactctttcttcataagaattaagagtcattgcattttaggagaattgtcattggcccaagtgtaattatggttctatatcaggtgtgttgattacagacaacaggaattggctctggccaacttggagcttgttgggaggagcttgggcctgtggagttggcaggaggctgccagctggaggcagcctggaagccaggatgtggggactgcaccgcaggcagtccctcagcgagaacaggagcagcctggcgtggctgatgctgcccttgagatggtgacctctagtcattcacctacgtgctcaagactgactcttccaggagggtctgattggataagcttaggtcacatgcccactgtttggctatactggggaagaagaagggagaatccgacccttggtagctgatgttattgtgagtggcctttgccagggattacactcccccaagactaggaggagaaagggtgaaactgcctaaaaggtgggaagaatagggatggtcgaatccctgcccaaaactgtcttttttttttttcttttttttaaagacaaagtctcactctgttacccaggctagagtgcagtggtgcaattttgacccactgcaacctccacctcctgggttcaagcaattctcctgcctcagccttcccggtagctgggattacaggcgtgcaccaccacacctggctaatttttatatttttagtagagacagggtttcaccatgctggccaggctggtctcaaactactgacctcagatgatccgcccccctcagcctcccaaagtgctgcgattacaagcatgagccactacacctggcctagaatctcatttgatcctcacaacctcacaaaactgtgagctgagaatgtttggtcagggcatggagccttagtgcatctgaagttcttaaaattttgcatagaagctcagagaagctgatttacctgcccaaggatattgagtggcagtcccaggattcatcacaggtcttctaacctataatctagtggattttccactctcctgtcctacatttggtctgatctgtctcatttgggctcatttttcttacaggttacacaaggacaggctcaatctttctggcccaaactcaggaccgactgatctccctgaagcgcatcaacgcagggctgaagtacgtaagagtctagaagcgtgtcctgactttaccacactggcctctgccaaagagcctgtgaatgtcattgtcccttgtgttctgtggcagtgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgagcaggtttttgcattttcttaagataggttagcagggaagacattacctaaggaagtgtctcacaataggaagtgacaccaactcaagtttggaaagattatcctctttggggtactcagcctccattttgaacacttataattttatttatctgttaatgagtgttttccctcagggccacatttttaaagttctaaagaactgcttttagtgctaattaatgccccttttttggagacagagcttcactcttttcgcccaggctggagtgcaatggcacaatcttggctcactgcaaccttcgcctcctgggttcatgtgatcctcctgcttcagcctcccgagtaggtgggactacaggcgtgccccactacacccggctaatttttttgtgtatttttagtagagacggggtttcgccatattggccaggctggtcttgaactcctgacctcagatgatccacctgcctcggcctccctaagtgctgggattacaggcgtgagccactgtgccctgccaattaatgccctttggacttaaggtaatattttccgccacaggacttgagaagctcaaggtgaaaacacaccttggaagtttaatccacacctgaaatcatgagcccagttgcattgaatgaggggaagacttaactagcgtccagggtatcatatccatggtatgagcaggttagcacttaaggcgcactatttacatcctctcctctctgctccatagtttatgattccaggaatttaattattgtgttccaaagtctgtttttaaactgagttgctattttcaatcttgaacaaggcccatttacatagtctcaggatgtgattctagggttttgtgttttttttaaatgaaagcattgagccgggcgtggtgtctcatgcctgtaatcccagcactttgggaggccaaggcaggcggatcacctgaggccaggagttcaagaccaggctgaccaacatggtaaaaccccatctctattaaaaatactaaaattagccgggcatggtggtgcatgcctgtaatcccagctacttgagaggctgaggcaggagaattgcttgaacccaggaggcagagagcgagccaagatcgcacgactacactccacccttggcgacaaagcaagactccatctcaaaaataaaataaaaaaataaattaaagcattgacttgactttgtcagtgtttcttctgggtggagaacctgctgcacatgccttcattctggaacatcagatgaaacaccaactctttctttaccttggaacaggtgttcagatctatgaccggacatctgttcttcatgtaatggtcaaaaaaggtcaagttactggagtggagaccgataaaggacagattgaatgccagtattttgtcaactgtgctggccaggtaggtcagcaccaacactgctgttcttatttaacgtttgtctccaagatttttttggtgtagagaagtaagattagtattgtgattggttatacagatatcagtaactacgctgtttcttgtagggtattctaaatcagaaacctacacttagtctgcaaatagaagcctgtgtgaccttgtccttcctccacactgggttgatgggtgctatcctggtcaggaaggccagcaaatggtcaggcattgacgtgaatccttggcactgggtcttgatgttacatttcattctataacctagcaaataacatattaggctattttattgtgtcaggaatgtggacactaatttccaggacactgcttcttttaaagcagattggctcttgccttccatgctatgatcccgaagtgaactaagaaatacttttgccatgtgaagttcatttagtgattgctatttggggtttgtagctgagcccaggcgttttatcaaaaggacctcctttggttcccatgagctcctttgactagctggtaaatatctcttcctttgatctcaaagtaatttttatgtcttaaaaaatgtagtattgctccccatccaaataattgaactaaagcaggctgacttcccacacctgacactgtagcaagagcacacataagccacttggaattaatctcaagaggctgaacttgctcatttttatttctgttcctcttcccacccacaaatcaacctgtccatttgtagtgggcatacgagctgggtctgtccaacgaggagccggttagtatcccgctacatgcctgcgaacacttctacctcctgactcgccccttggagacccctctgcagagcagcacaccaagtgaggacttgcacttttttaaaaaatcttgtttctttgccagtatcctgtcctctgaaaaggaaaactttctgctaaggacagcctgtgtctgaaagagtctttcatttctagagcatgttacagggaggtggacccaattctgacttttctttattaactctttatgaaaggatggccaaaatttccattaatacatttttttgtttttgtttgttttgcaagctaattttagtcctaaacagaggtcattgagaatatttggactgtcttgttgactttttaacttgaatgctatggatagtagaaatgtcataggtaaacaatagacttaggtgggttcgtggttccaagcactgtaggagagggttctcacatccttttgacggtcttcatgcctagaatgggctctgcaacccccctctctgttaaactttcgcttggcacagtgggagttacgtggtttgcttgtggggactagtcaaagcttctaggtaagggataatcagagaaacagtctccactgaaaggctaaatgggaggatcttcccccgtgacctcaaaaggtattttaaagctaatgaatgcctgtgttcattgaatgttctttcattaataaagccattaatgggtgtttttgtttggttgttctgtccatttagaaagctgacttgcctctaaacccttgttttttcttccactccccactccatgtcatttctccacctcagctattgtggatgctgatggaagaatttatattcggaactggcagggtggcatcctgtctgggggctttgagaagaacccgaaaccaattttcactgagggcaagaaccagctggagattcagaatctacaggaagactgggatcactttggtatgtgaactgcattataaccgtagtgccttatatttgtttaagatgttatatttttcaaagtattttgaagaatagttccttgtttaatgtttataacatcgccatgaggtacaacagtggttacagagggtgagtttgcctggtctgaggatggagttactaggtagcagattcaggggactaaaatcttagttaatagacatttgccttattcttttttaattttattcttagttttacttttttttttttatttcttgagacggagccttgctccgtgctcagactggagtgcagttgcacaattatagctcactgcagccccgaactcctggtctcatagctttttttttttcttctttttggtagagacatggtctcgccatgttgcccaggttgatctcgaactccaaggctcaagtgatccctttcaccttggcctcccaaagtgctaagattacagatgtgagccactgtacctagccctttgtgtgtgtttagtcatctctatcattttgtgtgtgtgtgagatggcgtcttgccctgtcacctaggctggagtgcagtggcatgatcatagctcactgtagcctcaaattcgtgagctcaagcaatcctgccacatcagcctcccaagtagctgggattacaggtgcttgccaccatgcctagctaatgtttaaattttttgttgagatggggtctcgctgtgttgcccaggctggtctcgaactcttgggctcagtcaatcctgcctcagcttcccaaagtgctgtgattacgggcatgagccatgatacccagctgctttttttttttttttttttttgagatgaagtctcgctctgttgcccaggctggagtgcagtggtgtgatctcggctcactgcaacctctgcctccccggttcaagtgattctcctgcctcagcctccagagtaggtggtaggtgggattacaagcgcctgccaccactcccgactaatttttgtgtttttagtagagacagggtttcaccatgttgatcaggctggtcttgaactcctgacctcaggtgatccgcctgcctcagcctcccaaagtgctgggattacaggcatgagccactgcgtctggcctttttttttttttgagataagagtcttgctctgtcgcccagactggagtgcagtggcacaatctcggctcactccaacctccacctcctaggttcaagtgattctcatgcctcagcctcctgagtagctgggattacaggcatgcatcaacatgtccagctagtttatgtatttttagtagagacaggattttaccacgttggccaggctggtcttgaaatcctggcctcaagtgatctgcctgccttggtctcccaaagtgctgggagtaaaggtgtgagccactgtgcccagctctgcttcttttttttgtttttttgtttttttttgagatggagtttcactcttgttgcccaggctcaagtgcaatggtgcgatctcggctcaccgcaacgtctgcctcccgggttcaagtgattctcctgcctcagcctcctgagtagctgggattacagacatgcgccaccacgcctggctaattttgtatttttagtagagacagggtttctccatgttggtcaggctggtttcgaactcctgacctcaggagatctgcccgccttggcctcccaaagtgctgggattacagacgtgagccaccatgcccggcccctgcttattctttattcacctaaaattattgctcagattttaggttttaggaggagacttctttcagtaggacttcatataaaattgaagagttctttagaaaacagaattgttttgttttgttttgtttttcagaattgttttgttagtgtagtattttattaaattttaaaataattttatttatttatgtatccattcattcattttgagatggagtcttgctctgttgcccaggctggagtgcagtggtgcgatcttagctcactgcatcctccgcctcctggattcaagcaattctcctgcctcagcctcccaggtagctggaattacaggcgcccaccacaacgcagagccagtttttgtgtttttagtagagatggggtttcactatttggccaggctggtcttgaactcctgacctcaagcgatccacccgcctcggcctcccaaagtgctgggattaccggtatgagccaccgcacctggcctttaaggcctgtaatcccagcactttgggaggccaaggcgggcagatcgcctgaggtcaggagttcaagaccagcctggccaacatggcaaaaacccgtctaaatataaaaattagctggatgtggtggcgcacacctgtaacgccagctacgtgggaggctgaggcaggagaattgctggaacccgggaggcagaggctgcagtgggctgagatcgcaccactgcactccagcctgggtgacagagcgagactccatctcaaaaaaaaaaaaaataataataataatatagttacctagttccaaatttaaaaagatgaaagagtctctaatgaagaatttccctctgacccttgatgggctttctttttttaataaattcttacggaaaatttcaaacttttaaaagtggatagaagctgggcacagtggcttacacctgtaattccatcattttgggaggccaagatgggaggatcactggagcccaggaagtgaagaccagcctgggcaacatggcgagactggagactatgtgtctactaaacaaacctggcgagagtagtatgatgagcccccatgtacccattatccagctctggtctggtttcatctttttctgctgtccactggattatgtcctgatggtagatttcctttaaagcagggtgaaagtctgtcttttgcagctattccaatgcagaacattgcctttttttttttttttcctgagatggagtttcactctattgcccaggctggagtgcagtgtcacgatctctgctcacttcaacctccgcctctcagattcaagcgatttttctgcctcagcctcccgagtagctggggttacaggcttccaccatcacgactggctaatttttgtatttttagtagagacgaggcttcgccattttggccataatgctcttgaactcctgacctcaggtgatccgcccaccttggcctcccaaagtgccggggttacaaatgcaagccaccatgcccagctcagaacatcaccttttattaaaatctctgtggccgccatttaagagcttttccactcacactggtcccttcaagattattatctgtagatacgttttacttgctgttctctgctgctttcctttctaaccaatatcttttttcctcagtctttataccaagtattttgcagctatatcctgtaattctaccaaggtttctgctttgtgataaatggcccagttggctcgtctttaaaaaaatctcttccagccggacgcagtggttcacacctataatcctagcactttgggaggccgaggcaggcagatcacttgaggtcaagagttcgaaactagtgtggccatcatggtgaaaccccatctctactaaaaatacaaaaaattagctgggcatggtggtgcacgcctgtaatccgagctaattggcaggctgaggtgagagagtagcttgaacctgggaggcagaggttgcagtgagccgagatcgtgccaccacactccagccggggcgacagagtgagactccatctcaaaaaaaaaaaaaaaaaaaatcaagaggttttctgaaaggggagagtgtaaaaaagtagaggggttgaaagtggtttaattccttaaaggtgagaactctatttggttttgttgtcattgctcagagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaagtctttctcactcaaagtcagctgtgaacataagtcaacttgctgggtctcttcccttctagaattacttgttattaacatggcgtgtggtatatttaatctagtatgttaagactaataagaagatacatgtaattttggagttgtccccttctaagtatgagaggctccccatgttccagaaatgtcatcgggcaaaatgtttttgcaactcatcttttggagttagccacagatcctgtgggatattcttttatattttttcagttataacaaatattggtcatttgagtgtgtatttgagtttggtagccaagtatgttgattgaggtaggtatttgaactaggtaatacacggtttgtttgtttttttagacagtcttgctctgtcacccaggctggaatgcagtgacatgatctcaggtcactgcaacctccacctcctgggttcaggctattctcctacctcagcctcccgagtagctgggattagaggtgtgtgccaagacatctggctaatttttctatttttagtagagacagggtttcaccatgttagccaggctggtcttgaactcctgacttcaagtgatccacccaccttggcctcccaaagtgctaggattacaggatgagccactgtgcccggccacaagtttttatttaaaaattagacactaggccgggcgcagtggctcacgcttgtaatcccagcactttgggaggccgaggtgggcggatcacaaggtcatgagatcgagaccactctggctaacacagtgaaaccccatctctactaaaaatacacaaacaaaattagccgggcgttgtggcgggtgcttgtggtcccagctactcgggaggctgagacaggagaatggcgtgaacccaggaggcagagcttgcagtgagccgagattgcgccactgcactccagcctgggcaacagagcgagactctatctcaataaaaataataataataaaataaaataagacactaatgaacattaaataagccagtcacaaaaggacaaataccgtgtggttccacttatatgaagttgctagagttgtcacatcatagagacagaaagtacaatggtggttgccagaggcgggggaggggagctattcttgaatgagcacagagttccagaaatgcaagaggaaaagagttctaggatggatggtggtgaaggttacaccgcagtgtgaatgtacccactgccactgaactgaatacttacaaatgggtaagatggtagccacgatgaaaagtttattttaaatttatgagaccagttctcttgagtgatttgtagaatggctctgaaaacagttacagaagaggagttagaaaaatgtttggagcaaaggagatgtggtcacgtaactgtataatctttaggtgacagaaaaaaacccattggatatttagagtatatttgtatgtgttttagtcttatttcttcatagatgaggcttataacttttttgaaacaagatcttactctcacccaggctggagtgcagtggcaccatcatagctcactgcagccgcaagttcctgggctcaagggatcatcccgcatcagactccagaagagctagaactaactgcaggcgtgtgccaccatacccagctcttttttttttttttttttttgaaacgaagttttgctcttgttgcccaggctggagtgcaatggcacaatctcggctcaccacaacctctgcctcccgggttcaggtgattctcctgcctcagcctcccgagtagctgggattacaggcatgtgccaccacgccggctaattttttttttttttttttttttttttttgagttggggtttcgctcttgttgcccaggctggagtgcaatggcgtgatctaggcttactgcaacctctgcctcccaggttcaagcaattctccttcctcagcctccgtagtagctgggattacaggcgtgtgccaccacactggctaattttgtatttttaatagagacagggtttctccacattggtcaggcttgtttcgaactcctgacctcaagtgatccgtctgcctcggcctcccaaagtgctgggattacaggtgtgagccacctggctcactttgaaacttttttttttctgtagagacggggtcttactatgttgcccaggctggtctcaaactcctgacttcaagcaatctcctgcctcagcctcccaaagttctgggattacaggcatcagccaatgtgtctggctggcttctatgttaaatacctcctagggaatcttatcatctggggtaaaatcctcatagtagtcttttgagagcagtacacagacccatgttcgtttcttccagaaaagttaaggaaagtgcccaaaactattcagctggtctatggcaatttaggatcttttgattctgtttgttctcgatttgtagaatattaattttctcaaatctcacacctgagccccaacacgtgccctctgtctatataggtaccttgccgaatggatggtacatggttatccctcagaaaacgtttgggaattggacctgaaacgttttggagccctccagagcagccgcacctttctgcgccaccgggtcatggaagtcatgcgtaagtgaagctttatcgcagttgctcctagttgcaggtatcttctcggtggcccgtgttgtcattcagaaggagcaaagttttcctcagttctttaacaagtgctttgagttgggcatttgatttgactgtttcaggcctgagttaaggggctttatgctcctcatgatatatacgtaacattttctttagtgcatcggaccttgtttcattctgagaacaagaaaatagaataggagttacagttggtacatagcagcttcataaatattctaagcaatgccttcttcccggtctgccttgagagaccgtatgtcgaagtgcgtgctttctgcagtctgccttgagagaccctgtgtcgaagtgaatgctttctcactcccacttagtttttgagaaaatgctttctcactccccacttagttttttctttccaagtcagagaatttgccgagttattctcagagcttcaggcttccgtgagtgactttcaccattaatccaccctacagcagcaagattgggagccacttcccatataaatacaaaacatacattcctgctctcactcccgtgttctcgccctgcttcaactttgaaggattggccacttcatcttaatttgttattctaccttgatctctgatttattttctaggaagcccttagaaagcttttgtatcaggaattgaaccaaaccacgtgggttcaagttgtaatttcattttcctgtactgaggagctgttctcagactttgccaaatggtatctaaatattttgggcatacttatgctcaggactaagtttctgtgttggctctgaccaccattcttggttgcaagtaaactgttagtttggtagttgaacaacattgttggtgaggactctggatggcctttaatgcctgagtgctcacttttggcctgggaagaggatgtacatccatggagatgaaggacctaacagcaatatgtttaactgctaaggttctttaattttagcaaatattttggttaaaatgttgaacttggctgggtgtggtggctcatgcctgtaatcccagcactttgggacgttgagggaggtaggtcacttgaggtcaggagtttgagaccagcctaggcaacgtagcgaaaccctgtctctactaaaaccaaaaccaaaaaattagccatgcctagtggcacacacctgaagtcccagctacttgggaggctgaggtaggcgaatcacctgagctggggaagttgaggctgcagtgagccatgatggtgccactgtgtactccagcctgggcagtgggactgagaccctgtctcaaaaaaataaaatacaaaatcaaagttttttgttttaaagttgaactattataagcctaaatttccctacccatagttactttggaacctgtacaaatcataattgagcttgagcttctgcttggtgatatgacacttttggtagccaattctcatgaaatagaagtggcaggcacatagaaaatggggaaggcgccaggcgcagtggctcaagcctgtaatcccagcatgttgggaggctgaggcaggcggatcacttgaggtcaggaggtctggcctgaccaacatggcgaaaccctgtctctactaaaaatacaaaaatttagccagatgtggtggtacgtgcctgtgatcccagctacttggcaggctgaggcaggacaatcacttgaacccgggagatggaggttgcagtgagccaagatctcaccactgcactctagcctgggtgatagagagggattccatctcaacaaaaaataaaaaaaaaatagaaaagaaaatgggggaggggatgatagaaccgaaagtactaggagatggagagattgtcaccatgcagagaaccccacctggcttccttctcctgtctcccaacctccccaagccttgatgtgccttttgtttgggatggtgtgagatcagggaccacagatcacactcttctggctttttttacttattgctgttgaagattagaccttaagggaaatgaattttttttttttccgagacagtcttgctctattgcccaggctggagtgccgtggcgtgatttcggctcactgcaacctctgcctcctgggttcaaacaattctcctgcctcagcctcccgagtagctgggattacaggcgcctgccaccatgcctggctaatttatgtatttttagtagagacagggtttcaccacattggtcaggctgatcttgaactcctgacctcgtgatccgcccacctcgacctctcagtgctgggtttacagacgtgagccaccacacccggcctaagagaaatgaattctgaccctagctttgttgtgtgaataatgtcattggtacaatacaatataacttctcagatttcagagccacctaatcaagctgcaatatgtaccctttcacttcagaagtgagttaattatcagggaggaaatgtctgtaacaggtctgagatcctaacacaggcacaatgaagaatcgaatgccattttttcacattttgttaccacctgtgtcccacttagtaaccttcttctctgctatgaagcttggtaaggtttaggaccctgacctttctgccatcatttctacctactaatgtggaatgctgaatgtgaatacaggccgagtcatgccgtgacacgtagctccagggagggacgatagcagcttggcaggattgtcttttccttctggagcatgcctgatacactgggtaattttgaaaattagactacattagcctggaaattgggccgggcagagtggctcacgcctgtaatcccagcacttcgggaggctggggcgggcagatcacctgaggtcaggagtttgagaccagcctgaccaacatggagaaaccctgtctctactaaaaatacaaaaattagtgtggcacggtgacacgtgcctgtaatcccagctactcgggaggctgaggcaggagaatcgcttaaacccaggaggcagaggttgcagtaagccgagattgtgccactgcactccagcctggacaacaagagcaaaactccgtcttaaaaaaaaaaaaaaactacgttagcctggaaagctcttttgaatagaaacaactccagagtctagtggacatgggctactcaggtctagaatctgtgtcttgggctttgatagactactcgtgtcttttctagctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaagggtaagaagtcacattctcatttttgcttcttttttttttttttgtcctgggaattaataaaacatattttcaaatgcataggctagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacaaagtttgagataacagtaagtatttgggaaccaaaaagtaatagattaggaaactttacatatttattgaatgccttttgtttttcatcttcaaaactgattcctgactgggtgcagtgggtcatgcctgtattcccagcactttgggaggccaagggggcgtggatcacctgaggtcagagttccagaccagcctggccaagatggtgaaaccccgtttctactaaaaatacaaaaattaaggccaggagtggtggctcatgcctgtaatcccagcagtttgggaggccgagacgggtggatcacctgagatcaggagttcaagaccagcctggccaacatggcgaaaccgtctctaccaaaaatacaaaaaattaaccaggcatggtggcgggcacttgtaatcccagctactcgggaggcaggagaatcgcgtgaactcatgaggtggaggttgcagtgagctgagattgcgccactgcactcagcctgggcaacagagtgagactccatctcaaaaaaaaaaacaaaaaacaaaaacaaaacactgatttcttaagaattctggtatattttagtgtttcatctgtattgtaacatttttctgaaattttagctccttgtttcaggtttttaatttgctagagaggcctgtttatcataagaatcaatagctagcgttccctggagcttcttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcaggtgagatgagctgccgtcccgctctgctccctccaacatgttgattccttaggggtgctgtagcagaggctctcaggcgcttctccgggaaccataaatcccagagtctaagaatcattacatgaaatcaaagccagtttattagcagtcctaaacaaaagaaatcaccaggaggaaaagaaaaaaaagcccaccagattatgtaccctactgggagaagatgccttgtcttttttcttttttttttttttgagacagggtctcactttgttacccaggctggagtgcagtgatgcgatcatggatccctgcagcctggacctcctgggctcaagtgatcctcccacctcagctttccaggtagctgggaccacaggtacacgccaccacacccagccagtttttgtatattttgtagagatagggttttgccacattgcccaggctgatcttgaacacctgagctcaagcaatctgcccaccttggcctccaaagtgctgggattacaggtgtgagccactgtgcccagccgatgtcttaacgttagtaaatctgtataatttcttggcattaacaggaagccagaattttgttttgttgttaggtggtgtatcctagaatggtgctactggccttctgtgaaagctaagaaatcatttcctagtatttgcctcattgctttgaaaccaaataagatttgattgcttcctgatccttttgctgctacctggttttgattattttggggtctcacttttcagtttcttcatgatctctccaaccgaccagcaggtccactgttgggcctggcttaagaaacacatgccgaaagacagcaacctgctcctggaggacgtcacctggaagtacacaggtacgggggttcgggctctgccacgtcgaaaaggccagcagatgcagatgtgtccacgtttgccttctttacatttgactctcaaaaatgaacattagagttagcataaaagaggctctctggtcatagaaaattgatctctaggggatgcggtggctgacacctgtaatcccagcacttttggaggccgaggttggaggatcactaggtcaggagttcgagaccaacctggactatatggtgaaaccccgtctctactagaaatacaaaaattagctgggcgtggtggcacacacctgtaatcccagctacttgggaggctgaggcaggagaatcacttgaacccaggaggcagaggttgcagtgagccccagattgcaccactgcactccagcctaggcgagtgagactccatctcaaaaaaaaaaagaaaattgagggctggacacagtggcttacacctgtaatcccagcactttgggaggctgaggcgggcggatcatgaggtcaggaatttgagaccagcctggccaacatggtgaaaccccatctctactaaaaatacaaaaattagctggacatggtggtgcatgcctgtagtcccagctactcatgaggctgaagcaggagaatcgcttgaatctgggaggcagaggttgcagtgagccaagatcatgccattgcacctccacctcccgggttcaagcgattcttctgcctcagcctcccaagtagctgggattataggcgcccgccaccacgccgggctaatttctgtatttttagtagagatggggtttcaccatgttggccaggctggtcttgaactcttgacctcgtgatccacctgcttcggcctcccaaagtgctgggattacaggcatgagccaccacgcccagtcccagagagtacctaatttttaaggatgacttggttccctgattttctcactctcagcagtctcggcttaacccctcccaccttcccacctaactgatcttgccccttggccccaccagcgtttgctctcccaggctctcattctcaattccttgtagtagcaaatatgatatacgtcctgctcctggattgggatactacagaatgttactgaacaaaagtcatgttctagcctgtcttaggatggatgacatgtaattagcacaagctgatgtcacaaacactggtgtccagaataatgctttccttatctagtaagcattaggatatgtttgaagtggatttagcttctctgaatttaaagtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggtaagtgctgataaagttctgtttcttaaatgggcagagaatgtgtctttcatagcggtggcaggtacatattcttactatggtgttagcacccacaaagagtgtcttggctgggtgaggtggcacatgcctgtaatcctagcactttgggaggccgaggcaggtggatcacccaaagtcaggagtttgagaccagcctggccaacatggtgagaccctgtctctgttaaaaatacaaaaattagctgggtatggtctcacgcacctataatcccagctacttgggaggctgaggcacaggaatcgcttgaactctggaggcagaggtcgcagtgagccgagaacacgccactgcactccacctgggtgacagagtgagactctgtctcaaataaaagagtgtgctggccaggtgcagtggctcacgcctataatcccagcactttgggattacatcttatatttataaataaatataaaaatacaaaaattagccgggtgtggtggcgcatgcctgtggtcccagctactcgggaggctgaggcaggagaatgacttgaacctgggaggcagatgttgcagtgagccgagattgcgccattgcactccaggctggcaacagagcaagactgtctcaaaaaaaaaaaaaaaaatgtgctgcccttcattagcaaagaagtgactaagtatatttatttatttatttatttatttatttattttgagacagagtttcactcttgttgcacaggctggcgtgcaatggtgcgatctcggctcactgcaacctccacttcccgggttcaggcgattctcctgtttcagcctcccgagtagctgggattacaagcgcccgccaccatgcccagctaactttttgtatttttagtagagacagggtttcaccatgtttgccaggctggtcttgaactcctgacctcaggtgaaccacccacctcagcctcccaaagtgctgggattacaggtgtgagccactgcgcccggccttatttgtttattttttacactccaagcttgctttatttaataagcattaggatatctttgaagtggatttagcttctctaaatgtaaagtctttatgctttttggtttctgtagcactggattaaaatttgaagttacaggattatgacacacacaaaaatgcctttcgaagttaggtcccttctctccatgcagtgtggcctcttttctgtacacagagtaacttctgtgtctgtggcatcttcagggaagaaatggcgtaggtgaatctctgaacttcctacataattttctttcctataagtggcaaccacagctgagtgaaacaaactgtaaccgaatgaaagcaatgacaacggaatcctccccaggaagctgctgattagagagggccaaacggacagacatcttggccacctgtaacgagcaacttccaggtggttactgatggagactctttgaagttcacccaaagtgggatccacctacaaattgtttcacagttttccttcttctccgaggcaaagtgaaagcaacagaaaactctccactgttagctatcagtggacccctcccagcgtttgctctgctgcttggaggagtgacccatacgctcaacacctggcgagtgctgcatcctgtcagcctcctgtggaagcggttcacttcggtgctgtccaggactttccactttcctttataggaacggtgattgcgtcagtggccgctgttagggaactgagctgctatgtaacgtgttctgagaatcagaagcccatctttgaccccaggatagcagattaattatgtctgtgggcatcgggcatcatcttttgtatggcaggcggccagggtttgtctgctgattcccccagagaagacactcgccttgtcctcattgtgcctgctaccctcgactaacacaaggacctggcaaagaggaatattttgtgcttgtcaaggactttcctccactctctaccatcagcttggctaaaactcctgagatggtaacagtagcaagcagagatgtcacataggcagtgctccattctctgtgcctcaggacctggaagttaaccactttcgggatgaaattcttgccttgacgtctgtctccctcaacagtaaacagagggtgcagcactaatgaaaggtttccccaggcgtccctcccttgacaagtaatgtgagtgcccaggctgactgctgcctttgtccctgcaggagatgagtgtgggctatgcaaatgggatccgggtgatgagcatgacgcacacaggagagccaggattcatgctctacatccccatagaggtgagagggcacccttcccttcccttcccttcacttcccttcccttcccttcccttcccttcccacaaccactgtggggtgccagtgctcccagcagcgcgttcaccagcactggcaggtttggagagctgtatctgattgggccttgggagctgaggtaggctgcattgaagagatttgaccatttttaactaagttatataagtttttttgaataggtgatacatttaaaaagtatttggcgccgtctgatctgttctcaccaactgtcaccaataatattagtattacttttatatgtcatttcagatttgtatgcatattgcaagcaaattcataattaatttttttttttttttgagacagggtctcactcttttgcccagggtggagtgcaatggcatgaccgtggctcactgcagcctcgacctcttgggctcaagccaccctcccacctccgcctcccgagtagctgggactgtaggcatgtgccaccatgcctggctaatttttgtatttttttgtagagacaggttttgccatgtcgctcaagctggtctcaaactcctgacctcaggtgatacacccaccttgtcctcccaaagtgctgggattataggtgtgagccaccatacccagccaagccccctttttaaaaacagaaatggaagcatactgctattcttcatcctgtttttttttttttcacttcacaattttttttttaattgaggcagagtctcactctgtcacctagggtggaatgtagtggcataatctcagttcactgcaaccttcgcctcccaggttcaagtgattgtcctgcttcagcctcccgagtagctgggattacaggtgcacgccaccacgcctggctaatttttgtatttttagtacagacggggcttcaccatgttgcccaggcttgtttccaactcctgacctcaagtggtccacacacctcagcctcccaaagtgctgggattacaggcatgagctaccatgcccggcctcacttcacaatttctcttagagctctttctttgttggtacctaaagcaaaagagcttccttgttctttttttctttattttttaacagtggcgtagcattccattgtggtacatcattccgatactaatagacatttatgttatttctagtcttttgctgttataaaaaggtctgcaggctgagttcagtctaatcatatgcaaatagtaatagtttcttccttctccagaaccttttttttgagacggagtctcactctgtcgcccaggctggagtgcagtggcgcaatctcggctcactgcaagctccgcctcccgggttcacgccattctcctgcctcagcctcctgagtagctgggactacaggcgcctgccaccacgcccggctaattttttgtatttttcatagagacggggtttcaccgggttaaccagaatggtctcgatctcctacctcgtgatctgccagccttggcctcccaaagtgctgggattagaagcgtgagccaccgcacccggccggcttttttttttttttttcttttttttttttgagatgaagtctcacacttgtcccccaggctggagtgcgatgacatgatctaggctcaccgcaacctctgcctcccgggttcaagtgattctcctgcctcagcctcccgagtagctgggattacaggcgcctgccaccacacccgactaatttttgtatttttagtagagacaggatttcaccatgttggccagcttggtctcgaactcctgaccttaggtgatccacccacctcggcctcccaaagtgctggaattacaggcgtgagccaccgcacccgggcccatagtctttcttcctataatttccttcctttgttctattgtgacaggtagcaatcaatgattgtaggcatgcttgttttcttcttgatgttagtcatactacttgtagtgataggttttctcttaattttttttttttttgtgagacagggcattgctctgtcacccaggctggcttactgcagcttgacctccgaggctgaagtgatccccctgcctcagcctcctgaatagctgggactacaagcatgtgccaacatccccagctaattttttaattttatttttgtagaggcagggtcttgctatgttgcctaggctggtctcagactcctggactctagtgatcctctcacgtcagcctcccaaagtattgggattacatgtgtgagccactaccccgaccttatttattactattttttagtgcagtgggatgatcatagctcactgtagccttgaacttctgggcttaagcagtcatcccacttcagcttcctgagtagataggaccacagatgcccagctatcttttatttttttgtttttagacggagcctcccactgtcgcccaggctggagtgtagtggcatgatctcggctcactgcaagccccacctcctgggttcaagcgattctcctgcctcagcctcctgagtagctgggactacaggcacacgccaccacactcggctaattttttgtatttttcatagagacagggtttcaccgtgttggccaggatggtctcaatcgcctgacctcgtgagccgcctgcctcagcctcccaaagtgctgggattacaggcatgagccaccgcacccggcctatttttttattttttgtagctttgagagtctcaatatgttgcccaggctggactctaactccagcctcaaatgatcctctcatctcagcctcccaaagtgttgggattaccggcgtgagccactgtgtctggccctgttttaactatttgagccactgtgcccaaccctttttaaatgattaaagcacagataatatcagcgcatgaaatttcatctgcttttccacactcagaagtattacaacaatatgaagatgaagagattgttcaagacttgggaagaatttaaacagatgcagctgccatggttggcctgtgcaggcaggttgattctgaagtgccacccagtggttcaggtgttgtcacctgggtgcttgtggtcaaacctcatcaggaaggggaggctctgtggctctagcagcttcatccttgcttggaggccttggtttcagctttctgatttccctgggctgttcccattcttatgatttttcaagagtctaagagattatttgtgccacgcttgggttctttataagctggcttttgtccaggaagcttatgtttgtctctctgagaagaggtcttccaaaacatgggggcagatggcagattctcgttttgttcacactaaatctctggtattttgtgagaaaaacgagtaaatggtggggaactactctttgagtaaatggtggggacccactcttctctttgattttcccagcattagtcacgtagttggatctggcccaacactagtcacctggttacatcgttcttccttggtcatcctcttacctaaaggaccgggcattgagcttgaggtgggagagtaccacattccctggagatgccagctgtgtattctcctcgtcctgccgcattctgtgggtctcctgcacccaccttggctgattcaggtgtttcccttacacacataccacaggcgagtgttgcatgcaatagcttggattccttttttccacatttaaagttgtcttcccggcacggtggctcatgtctgtaatcccagcaatttgggaggccaaggtgagtgaatcatctgaggtcaggagttcgagagcagcctggtcaacatggcgaaacctcgtctctactaaaaatacaaaaattagctgggtgtggcggcagccacctatagtaccagctactcgggaggctgaggcaggagattcacttgaacccgggagtggagatggcagtgagccgagatcgcgccacttcactctagcctgggcaaaagagcaaaactctgtctcaaaaataaataagtaaataaagttgtcttgatcatagtggtctgtttggtagatgcctgttcagctacagtggtgcagttcatagaaacatactgtgctaggataaagaactgcagtaccactgaagctggttctttgctacgtcttgctttggatttcattttacagttttaaaagcaaacagtgtagtctcatttttgttggactttaaacttaacagcgtatgttcagacagggattgaatatttgctttcagtttggaaaaccttctgttcactgatctgataacgtacatgtttctgaaaccaagaaaagagcagcttgagagcctgaatgctgtgggacatgagcaggcgagccctgccttcctggctcccccgccgtcatccgatgtgtgcacacgtctcgagtaacgtgtgagagctgggcctcacagcttgggccagtacgtgagggagtaacagtggttgggaaattggagcaaaagaacaaagccagaatcagatgaagaccatggagggttggtgggctgttttagaaatgatgatgagattggccatttaccaaatggtgagagagcttctataaattattatttaagaattgctgtaagctagaatcaccacacaagacattttagagaggtgaaaagacatggatcctgttgtcatggagcttaagtccaggctggggtgaccccagctcatcactcctgggctgtgccctgagcgtgtcaaggatgagacatcctgggagttttatacgcctcctctcttgtccatgttaatagtgtgagccatcagcgcttccagacatgctccatgcttaattctgaaggtctgctgcttatgaactttctgtctcttcctatagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaaggtactgtgtttacccagactccactttcactcagcatcccgagtagtgaatctgcactagactaggaagaagaactgatgtgacaggaaaagggggaaaagattgaggccttgatgttagcatcaggtaaatgaggacaagagtgccctgagaatgaaaactttataggataaaatatcttcaaatgaaaacataataatggtggctcacgcctgaatcccagcactttgggaggctgaggcgggtggatcacctgaggtcaggagttcgagaccagcctggccaacatggcaaaacccgtctctactaaaaatacaaaaagtaggccgggcacggtggctcacacctgtaatcccaacactttgggaggccaaggcgggcggatcacaagttcaggagatcgagatcatcctagctaacacagtgaaaccccgtctctactaaaaatacaaaaaattagccgggtgtggttgcgggcgcctatagtcaggagaatggcgtgaacccaggaggcagaggttgcagtgagccgagatcacgccactgcactccagcctgggcgacagagcgagactccgtctcaaaaaaaaaaaaatttacaaaaagtagctgggcgtggtggccagcacctgtagttccagctactcgggaggctgaggcaggagaatcacttgaacctaacaggcagaggttgcagtgagccaaaatcgcaccactgcactccagcctgtgtgacagggcaagactccgtctcagaaaaaagaaaacatagtaaatagatgacacttggtcaggtgcggtggctcacaactgtaatcctagcactttgggaggccaaggcaggaggatcacttgagctcagcctgggcaatacagcaagaccttgtctctgaattacaattgaaaaacaaacaaaaaaacccacttatttctagtgttctgctgtctaaaagactgagtgctttctgggaagctattctgagttaattatggtgatgcattaacatgccacgaatatttgtacaaactagtcgtcctatagtcagctgcctaatttttgtggtttttttcttttgtttttgattttgaggtggggtctcattctgtcacccaggttggagtgcagtggcgcgatgttggctcactgcaatgccctctcatgctcaagtgatcctcccacttcagcctcccaagtggctgggaccacagatgcacaaccatgcccagctaatttttttgtattttggtaaagacagagtttcaccacattggccagggtggtctcgaactcctgagctcaggtgatccgccctcctcggcctcccagagtgctgggattacaggcgtgagacagcacacccggcctaatttttttggtttttttgttttgggcggatcacctgagttcacaagttcgagaccagcccggccaacatggtgaaaccccgtatctgctaaaaatataaaaattagctgggcatggtggcaggcacctgtaatcccagctactcggtaggctgaggcaggagaattgcctgaacctgggaggcagaggttgcagtgagccgagatcataccattgtactcccacctgggtgacagagcaaggctccatctccaaaaaaaaaaaaggtaataacccattttggaaaatataaagaaggaaattaaaatcacccatattttgtctatttaatggtagtaactattttttttttctttcttgagacggagtttcgttcttgttgtccaggctggagtgcagtggcgcgatctcagctcactgcaatctctgcctcctggcttcaagcgattctcctgcctcagtctcccgagtagctgtaagccatccagctaattttgtattttttgtctttaccaaaatacaaaaaattaggtgggtgtggtggcgcatctgtgggcccagctacttgggaggctgaagtgggagaatcacttgagcatgagaaggcatttttgtattttttctttttttagtagagatggggtttctccaggttggtcaggctggtctcgaactcctgacctcaggagatccccccgccttagcctcccaaagtgctgggattacaggcgtgagccaccgtgcctggccataatcaccgttaatagtttattctagtcttatttgttgtacatatgtgtatatatgtgtgtatgcattgaatatagatgtgcatggtcttgttgggattatataaaaaagtctttttttttttttttttgagacagagttttgctgtgtcaaccgaggctggactgcagtggtgcaatcttggctcactgcagcctctgccacccaggttcaaacgattttcctgtctcagtctccctagaattataggcacactccaccagaatcttggctcactgcagcctctgcctcccaggttcaagtgattttcctgtctcagcctcccaagtagctagaactataggcacactccaccacacccagcttatttttgtatttttagtagagatgaggtttgcctcatctctgttcaaggcgtgagccaccacgactggccaatataaaaacatttttctaaagtactggactgataaggtattttattaagtgagtgagttttcttcctaaacgtttttgttctatctggtcttgtgactttatgtttataaaataggaaacaaaatgcgtacctctgttgttacaaaaattaccgcggcgtcttttatatttcacatgcagtttttcacatggtagaaatcgcacagtttcccaaaagctggcagggttgtgggaggaggcggctgtgccccattgcagtgacaccaggggacccttcccacggtgctgctctctgtgccgagggtctgagtgtcgctggatgactcggcgtttcctttctttcttagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcaatttgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactactcttgcacggctgcttgtgaaatgttcttcatctgtagtgacttaaatgtgtttgccaccacaaagcataaacagcgtgcagaggagagtgtgtacctccctgtgtgtaccagtgtgagggaggatttggggacgggggtagagaagatgtaggtgtttatcttaccctccctgcagcgctggagtggctgggggtaaaagcttcccgcctcctgaaattccgaccggccttctgcctacagctgacctcaggaggaacctgccacctgatgttccacacgggcacgtgtgcactcaggtttgtgtggaaagcaaggggggtcgtgttctcaccctgtggaaacaaccctgagagaaacaaccagtgctctttttctacaccagcttccatccacaagttggtccctggacttgacctgttcactaatttttttttttgaggcagagtcttgctcttttgcccaggctggagtacagtggtgtgatcttggcttactgcaacctccactcccaggttcaagtgatttcctgccttagcctccagagtagctgggattacaggcacgcgccaccatgcccagctaatttttgtattttcgtagagacggggtttcgccaggttggccaggctggtctcaaacccccaacctcaagtgatccacccaccttggcctcccaaagtgctgggattacaggcgtgagccactgtgcctggcccaaagtaatttttgagtagtttttttttttttaagtatttgtacttttgagaatctcataggttaacatgtttacaacaatctcttcatcttgtcttctaaatcagccccttctattccagttccaggaatagtcaaccacgccagaaacctgggactcacctggtctccccactcgcctctccctacacctcccgctcattacccagcctcacagggctgtctcctcagtgcctctcctctgttcggacctcactgtccccaccactgctgctgtggcagagagggttgtcagccctgacttcgagaacaatctcttactgattttcctgcttctcatgtcatcccccctccctctgcagggttgtctttgtaaaacaggggaggtcaatttactcactgccttgaaaccctcaagggactcccctttgtcgtgagacaaagctctcagtccttagcctggccagccagggtctccagggtgtggcaggccacgctgccccagggctccggcctgcgctgcgtgtgatgtgggtcctgcagccgagtgcgtgctcgccatccacagctggatctcacctcgaatcctgctttccagtcacactgagaggtctcccactcccatatttgctcactaaaatgcctcctggcagccctcccctgtgcttgtggaaagtcgcaaattgaggatcacatggacccccactcccccaagttgtcctgacagagacctcctgtctttcatttgattgattgattgagacggagttttgttcttcttgcttaggctgctggagtgcagtggcgagatctcggctcaccacaacctccgcctcccaggttcaagcaattctgcctcagcctcctgagtagctgggataacaggcatgcgccaccatgcctggctaattttgtatttttagtagagacgaggtttcactatggtggtcattggtcaggctggtctcgaactcctgacctcaggtgatcaacccacctcagcctcccaaagtgctgggattacaggtgtgagccacagtgcctggcccctcctgtctttcaaaagctctgcccaagaccaccatcatcccacagtggagcctttccttccccaagagaatggcccctttggggtcctcacacacccgtttctgatgtgtctttatttggttatctgccctgctccttctgtaagtccctcggagaaagactcgaattctcccaaactccaacacctcacatggtgtttggtgtttaacagatgattaaatgaatgggcaaaaagtggagggcaaaatctttaaaatgtcttttaagatttaaggattttaggccaggtgcggtggctcacacctgtaatcccagcactttggaatgccgaggcgggcggatcacctgaggttgggaattcgagaccagcctgaccaacatggagaaaccttgtctctactaaaaatacaaaattaggcgtggtagcgcatgcctataatcccagcttcgcgggaggctgaggcaggacaatcgcttgaactcaggaggtggaggttgcagtgagccgagatcacgccattgcactccagcctgggcaacaagagcgaaactctgtctcaaaaagaaaaaaagatttaaggattttaaatgtttgatttttttttcttgttgagatagagtcttgctttgtcgccaggctggagtgtagtggcgtgatctcggctcactgcaacctctgactccctggttcaagggattctcccacctcagcctcccgagtagctgggattacaggcacacgccaccacgcccagctaattttttgtatttttagtagataccgggtttcaccatgttgaccagcatggtctcgatctcctgaccttatgatctgcccacctcagcctcccaaagtgctgggattacaggcgtgagccaccgcgcccggcctgaaaatttttaaatgattgtttgccgactttacaacaggacgatgttgttgttcgcaggccagtaggtggcgctgtggcacgtgatctgagcctcctggattcacacaactgttcatgtggagaacccagtgccgggacccattagcaccccagtcaggctatgcgtctccctcccaagggtgctcacctggtgtggccttcatggcacagggggagtgagatgaggctcctttagtacaccctcccctgagaagagcgacgtgtgcttaccctccagtggcttgttctcatgaaaggctccacagttagggaccttcagatgcttagatctggggtgtcacctgactcaagcagctcagaatcccagattgttgtggtgggtcaagggcatggggctttgggtttactggcctgggtctgaatgccagcattgcctcttccttggtgtataggaccttgggtggttacttttcctaggcctctgtttacttgttttaaaatggacagtgatgcctactttatagggttgttatgaaactcaactaatgaatataaaatactcgacccagactggcatggtggttcacgcctgtaatcccaacactgggaggccaaggtgggaggatctcttgagcccaggagttcaagaccagcctgggcaacttagggagaccccgtctctaccaaaaataaaaaaattagccaggtatagtggtgtgtgcctgtagtactagctacccgggaggcagaggtgaaaggatcgcttcagcccagaagttcaagactgcaatgagccgtgatcatgccaccgcactccagcctgggtgacagatcaaggccctgtctcaaaaaataaattaacaggtcgggcgcagtggctcacgcctgtaatcccagcactttgggaggctgaggcaggaggatcgcttgagcccaggagttcaagacaagcctgggcaacttagggagaccccgtctctaccaaaaataaaaaaattagccaggtagagtggtacgtgcctatagttccagttacccgggaggctgaggtgaaaggatcgcttcagcccagaagttcaagactgcaatgagccctgatcgcgccactgcactccagcctgggtgacagatcaaggccctgtctcaaaaaataattaattaaatacttgacccattgcacgatctttccatgcacgacagctgctcttctattattcttccaggatgagctgcacagcctgcccccttgggtttccaggttgtgggagatgagcaaaactgaatgacctcagtaggccaagagcaaaggatgtgggtccggacctggtggccagttgcttgtgacaggagctgggctggagtccccaagtgccactagtgctgacatcttttaactgtgttcattgtgacttgtttatttctaaaagtaaccactggcgccttggtgcagatggaactccaggtgcatgcggtgagttaaccatggtctggggagctttgtttccacgcctaggacatgcatctgtgtgcatgatatgtgagctgatatagccatgcctctggtgatttgaacgcctgcgcttcccagctgcttcagggccctgaacatcgctggatgtttgtacttcattccctcctcagcccagctggtcccactccgcagctgtgctctaggcatttcatctcaactgggtgatatatttgaatacagcaattataagaacagcaacctcagaagaacatctggcatccagacctccccagcctagttccacaaggtaccaacttccgtaagccttgaagagctaagtaagacatccgggccgggtgcggtggctaatgcctgtaatcccagcactttggaaggccaaggcgggcagatcacttgaggtcaggagttcaaaaccagtctggccaacatggtgaaacgccatctctactaaaaatacaaaaattagccgggtgtggtagtgcatatctataatcccagctacttgagaggctgaaggaggagaatctcttgaacccgggaggcagaggttgcagtgagccaaggccacaccactgcactccagcctgggcaacagatcccttggtatagatacggggagcttgggtggtctcatcacagcagaacctcagctcttggcatgttctttcctttgctaccagcttttgaaactgaagtgtagcagagtcatgaaccagactttgaaacatgaaccagacagagaaacattttaagaagtagcggctgaccaggagttggagattgcagtgcactatgattgcacctatgaatagccactgcactccagcctgggcaacatagtgagacccctatctaaaaaaaaagaaaaagaagggccaggcacggtggctcatgattgtaatcccagcactttgggaggccaaggcaggtggatcacaaggtcagatcaagaccatcctggctcacacagtgaaaccccttctctactaaagatacaaaaaattagcctggtgtggtggtgggcgcctgtagtcccggctactcgggaagctgaggcaggagaatggtgtaaacccgggaggcggagccgggcgcggtggctcacaactgtaatgccagcgctttgggaggccaaggcaggaggatcgcttgagcccaggagttttagaccagcctagacaacatggcaagaccccgtctctaccaaaaatacaaaaaattagccgggcatggtggtgcatgcccatagtcccaactacctgggacgctgaggtgggaggatcacctgaaccccggagccgtgagcacaccactgtactccagcctgggtgacagagtgagaccctgtctggaaaaaaaaaaaaagtagctgggtatggtggcacgtgcctatcgtcctacctgctcaggaggctgaggcatgaggatggcttgagcccaggaattcgaggctactcagcaattatggtaccactgcactccagcctgggtgacaaagtgagaccctcaaataaaacaaaataaattggccataaatgtaagagttttttcctgtattgttcattctgttccttgatctatatgtcttgtcctttttccatatcttatagatgtgattactagaagtttcatagcaagttttgaaatcaggtagtatacattctccagttttattctttttcaaatgtgttttggttattctaattcctttgcgtttccatgcaaattttaagatccagttttcaaattttttttgagatggatcttgctatattgcccaggctggtctcaaactccagggctcaagggatcctcttgcctcagtctcccaaatagctgggattacaggcacatgccaccaaacctggcctctcaattgctttaaaatacaacaacaacaaaaatcttttggaagtttgatgggcattgcattgaattaatagacaaatttggggagaattaccatctatcttaacaatattgagtcttcccctggccaacatggtgaaatctgtctctactaaaaatacaaaaactggccaggtgcagtggctcatgcctgtaatttcagcactttgggaggccaaggtgggtggctcacttgaggtcaggagttcaagacctgcctggccaacatggtgaaaccatgtctctactaaaaatacaaaaattagccgggtgtggtggcgggcgcctgtgatccaagctacttgggaggctgaggcaggagaatcacttaaaccgaaggggtggaagttgcagtgagcccagatcgcgccactgaactccagcctcagtgacagagtgagactctgtctcaaaaaaaaaaaaaaaaaaagaaaagaaaaaaaaagaaattagctggacatggtggcaggtgcttgtaatctcagctacatgggaggctgaggcaggagaatcacttgaacccaggaggcggaggttgcagtaggaagagatcacgccactgcactccagcctggacgacagagcaagactcagtctcaaaaaacaaacaataaaacaatattgagtcttctattccatgaaggtgaaatgtctatgcatttttttagatctttagtttctctcagcaatgttgttttacagttttatgtgtatggattttcttttttttttttttttttttgagaatgagtcactctgtcgcctagtctggagtgcagtggctcaatctcggctcactgtaacctccgcctcccgggttcaagcaattctcctgcctcagcctcctgagtagagtagctgggattacagttgcccaccaccacgcctggctaattttttgtatttttagtagagatgaggtttcaccatgttggccaggctggtcttgaactcctgacctcaagcaatccatctgcctcggtctcggaaagtgctgggattacagatgtcagccactgtgcctggccatgtgtggaactgtttcctcaatttcattttcagattgtttattgccaatgtgtagaaatgcagtggattttggtatgttaattttgtattctgagacctttattctagtagggtttttttttttttatacattcctttggattttctacagtagaattatgtcatctgcaaatgaagatagttttacttctttcttttcagtgtggatgcctttaatgtctttttcttaacttattgcacaaattgcgcattcaatagtacaatgtttagtgggaccggtgagaaaagacatccttgccttgttttgatcttagggaggaaagtctttggtctcactgttaagtgtgatattagctgtacgttttgcgtaagggctgtattcgtttgctaggactgccatacaaggtaccacacactgggtggcttaaaaaacagaatgtattttctcagagttctggaggcataaaggccaggatcaaggtgccggggggttggttccctctgaggacctctctccttggcttgtctacagccgccttctccctatgtcttcacaggatcttccctctgtgtgtctcttcttataatgaggccagtcagactggatcaggacccaccccagtgacctcatttaactttaattacctctttaaagaccctatctctaaatacagtgacacggaggtaatggaggtaggacttcaacatactaatttggggctggttgtggtggctcacgcctataatcccagcagatgacttgagctttgagaccagcctgggcaacatggggaaggcccatctctactaaaaatacaaaaattacctggcatggtggcgcacacccacagtccagctactcaggagcttgaggtaggaggatggcttgagcctgggatgtggaggtcaaagccccaggagcagaggtcacagtgaaccaaaattgtgccactgcattccagctgggcaacagagccagacttcgtctcaagaaaaatttaaaaatcaaatagacatgatttttttttagacagagtctcattctgttgcccagcctggagtgcagtggtgtgatctcagctcactgcaacctctgtctcctgggctcaagtgattctcatgcctcagcctcccaagtagctgggattacaggtgtgtgccaccatacccagctaatttttgtatttttagtagagacgggattttgccatgttggccaggctggtctcaaactcctgacctcaggtgatccgcccacctcagcctcccaaagtgctggtactacaggcatgagccactgcacctggcctaatttttttttttttcttgagacagaatcttggtctgttacccaggctggtgtgtagtggcacgattacagctcactgcagccttgacctccctggctcaggctatcctcccacctcagcctcccaggtaggtgggactatggacacgtgctaccacgcccagctaattttttgtattttttttagagacggggtttcaccatgctgcccaggcaggtctcaaactcctgagatcaagcagtccacccagcttggcctcccaaagtgctgggattataggtgtgagtgagctactacgcctggcctggacatgtaatttttaaaagaaaatgtggccacaactctcctagagttaaatgttttttttgtttgtttgtttgtttgttttttgagaccatcaacaagatttcaaggctttaaagaaaggagctgcttcaggaagagataaaatgactcaaacgctataaccttcaaatgtagactgggagaagaggtatcagctatgcatgagctggagaggggtgggatagatagagacacaggtgataaagaaaatatagcaaaatgtgaatcctacaatctgggtggtggatgtaaaccctgtagtagcctcacctggggaaagctgccttgcaacaatgaggctgcccattctccaaacccaccccagccaccgagcaggctccactaaaaagtctgaacccaggagggagtaccatggaaaccaagttgcaatgccctggttaggggcccagcagaggggtcatcccagctctacgccattggatactgagtttcaggagtgggagtgccatcctcagggtcacacagcgtgtcggttccagcctaggtcttccagtgtctcattaatcttttatccactcagcttctcttctggcccatgaaccttgctctcctgggactcttttttttttttttgaggggtcgggggtgggacagagtctcgctctgttgcccaggatggagtgcagtggtgccatcttgcttcactgcaacctccgcctcccagattcaagcaattctcctgcctcagcctaccgagtagctgggactacaggcacccaccaccctgcccagataatttttgtatttttagtagagacaggatttcaccatgttggccaggctggtctcgagctcctgacctcaagtgatccgcctgccttggcctcccaaagttctgggattacaggcgtgagccatcacacccggcctgggactcttcttgcagtgagccagggccatgggacccttcaaaagttgctccaccctaatccccaaaatatctttttctcccgcctgtcccaagtgcctggcatcatactatatgggtcaactggccatgtttgccatggaagcccaattgtaggaagtgggtcttttatcacccggcatagcagagctgtggaaactgcactgggaaagatcaggatgtgaattaaagcgttgggaatgggaaggcagagaccttggattagctgggatgctccatgcactcgctgagtgaccttggacaagccccttagacacactaagcccgtttcctcatctacacgacgggcatcccatctgctactgcaccaggttcttgtggcaataacttgaactcacacatgcaaacaggctttgtgagctccataaacacaggtggctcggccaggtgtggtggctcatgcctgcaaccccagcactttgggaggccaaggtgggaagatcccttgagcccaggagttggagaccagcctgggcaagacgatgaaatcctgtctctaccaaaaaaaataataataattagccaggcatggtggcacacacctggtcccagctccttgggaggctgaggtgggaggatcacttgggcccaagaggtcaaggctgcagtgagctgagattataacactccaacctgagtggcagagtgaaactgtctaaaaaataaaaataaaaatacatcaaaaaacaggtagctattaagcattgctaggacccacacgcagtgaccctgagggtgctgggtttctgtttgagggagaagaaactcctgagcccctaggtattgtgggggacatgcagttccagaccgccttcatggcctgtatgcctggcctcatccccatccctggcacccatgacgatagccacattccactggtgtttccccaggaaagccaaccctacctgcatctcagcagagcttccacggagttggaaccccgctccgagagggtgtgggctcaggggccaggggtcacacaaactccagaaggaggacgtagttggtttgcaaggctgtcctttgccctggttgaataacctttggtcttccccgagaggaacgtgggcattaggctgcagcccacaggaagctatgtattttctgagaaacttggcccatggtgcagatctgctccagctcactctggtgggatcacgccagccacggccgggccacggcacatcatggcaacgtgctgcccacctgctacgccacctgtttttctagaggcggacgtgatcccagcaggactggagtcagcccagggcatcacgtgctctggtccccgcctgctttgactcctcctgcctcactccccccctggcctgtagtcacgttggtgagggtggtgggcaccggggctgggcccagcccccgaccctgcccagacagactttcctaaggcacccttttcctcgtgcaggtgcggcctcagcccacccccctttgagcccacagattgcacccctctggtgtgcggttacctcttgcctatgtttaattcatggctggggggttgggacgagcttcccaagaaaggaaagaactcccctggggtcttgcccagtttctgctcaccagaaggaccatagccgaggtcctcctcccagggcccggggctggggagcggaagccatcagtgggctcggaggacactgtcccagccaggacacggccatcggtcactaatctgcagcactggaatgtccgcaggccaatcagcggggtctctgggggctccccaagggtgctaataatcccacaatgattagcaggggccgcgggtcagtgcacgccactctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggaggtaagggacacctggtgaggaggtaggtggaggcaccattatgagctctgaggagtgggtgctaggagacttctggaagcccggtcccaggcctgagccccaggccgtgcgggtggtttaatgaggaagccctgggacagcccgggggcggtgaggggtggatgctggactggggaggaaggaggaggaaggaggaccagggctggggtcaaggaggaacgccgaggagcgctgtggctggggcctggagaaatccgtggcccggaggagccccagacaggggcctgcgggagccagggctggcccctacacccagcccgcaccgctgttccctcccgccaccccaaccccagcactcagcccacgcctgctgtacctggtctctctctcagcctcgctccattgctatgccccacgtcccctgcacccaccacactcctctcccatcttgttttccaagggcagggacacatgcttattctgccgtgtgttgggttcaggtccccccatcctcgggctgcctgaccttctctctccaccccagccctgaacaggaaggagagtttcttgctcctctccctgcacaaccgcctgcgcagctgggtccagccccctgcggctgacatgcggaggctggtgagtacccgacccagctgggctctgccaggggggtggccggaggcgcggaccccagagggcggctcaggaggccacgcctgtccaggtgcccttccacttgaccagggtgggcaggcacagccagccaccttgcccctgagggacggaggccctggttgctgggggtctctgcagtttcttaaccccccaccctcagttcaggaggtcgggccccttggctcccactcgcctgaagggcaggaccttgggccttccctggcatcttgttgccacagagaccaggagccacaggaggagccggatcccctcctccagggaaggggagcttcacgaggagccctgcaggatgggcggccgggccagggagggagaaggtcgtgctgggctggggaggggcttctgtgcggcaaggacccagcgcctcctcctgagcttatctgagccacgaggacgggccttgcccatgttctctgctcactcactcgtccacattttccacattttcagcaggggccgggggtcgggggtatagagttccccaccagcccggctggggctgcggggttgggactgtcatctggaggctcagaaacgctgccctccattgtctgggaccccagcagccccagcccatgttagcaggccagggagccagggcagggtggtgggggcgggagggttccccatggctgcttcccatgaactcctccaaggcaggtggccacagtggcgaccttgagcactctagggtcagtttcccaggaggtgggggtggggtggctaaatgcggggggtcgcttctcccccattcccagccctgagtggctctgcctctcctcaggctcagaccctgggcaaccaggggtgctcccagctgtgacctccgtggttgggtactcctgcctgggaccccaggaggggctgcggtggtcgttggctggcagctggcaccctttccagggcccttttgtcaaagtcttagaaaacttcatttccataaaggtgcaaatggagctccatggctcagcctccctcgtggcccggccccgagcaccctccgggcctctagggctccagggcaccccttctttggacacagtggagactgaaggtcttgtgggggtggagggctgctgagggaccccggggagcccccagctcctggccccagccttcatcagaggtaaaaccccgatggacattagtgcaggatgaagttggcttggggtgcagccccgaggggcccccctccctgcatccactcagtgcttgtgagtcctatcctgcaggcacctccctgctccgtttacagatgagctcagggagtctcgggagatcaggggactgcaccaagtcacccaggggtggtgattgccaggcccacttgtttaagaagagggagggggctgggcacggtggctcacacctgtaatcccagcactctgggaggctgacacaagcagatcacctaaggtcagcagtttgagaccagcaatggccaacatggtgaaaccccgtctctactaaaaatacaaaaattagccaggtgtggtgtcacatggctgtaatcccagctgcttgggaggctgaggcaggagaattgcttgaacctgggaggcggaggttgcagtaagccgggatttctccactgcactccagcctgggcgacagggtgagactctgtctcaaaaaaaaaaagaagagggagggggcggggtcagctgtgcgtggtggggagcatatgaggccaggctcctgggggcaggagactagggcagagaggcgtggctgtagggctttttgcatcacaggagggcagcatggccgggtgggagcagtggagcctttctgacaatggccagggcccaaacacagaaccagtctgcaacgcgtgggcactgctcacatgaccagatgggagaaagacagcaggagcgggtcccactgcctgggcagggccgaaggatgcccacgacaggatttggagatggaggctcagtcgtgagaggagctgggctcctcctggagggacatcagacaacaccagtgcttcctccagcaggactcctcatccagtgctctctttgccacctgacctggcacccggtggatgctcagagatggcaggggagttgaatctttgaggcctggcccagcagtcaaaggcctcccacagatgtctgtttgtgctgcccccaggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcaggtgagtgtgctgcaggtgaggccagcgtgccagctcccagatacagacttccactggtccatctcagaagaggctacagtttgtcctaaatgttgggattccttttcctccaattggtttagttttactttttttttttttgatacggagtcttgctgtgttgcgcaggctagagtgcagtggcgtgatctcggctcactgcaacctccgcctcctggactcaagtgattcttgtacttcagcctcctgactagctgggactacaggcatgtgccaccaggcctggctaatggctttatacttttagtagagatagggttttaccatgttggccaggttggtcttgaactcctggcctcaagtgatccacccacctcagcctcccaaagtgctgggattacaggcgtgagccactgtgccccgccacattttttctttttttggagacatggtctcagtctgtcaccccaggctggagtgcagtggcgtgatctcagcttactgcaacctccgtctcctagattcaagcgattcttgtgcctcagcctcacaagtagctgggattacaggtgtgcgcctctacacccagctcatttttttgtatttttagtagagacagggtttcaccatgttggccaggctggtctcgaactcctgacctcaaatgatctgcctgcctcagcctcccaaagtgctggggttacaggcgtgagccaccatgcctggcctaagccactttttttcaatctgaaatataaataatttcaaacataaacgtatttatttatttatttgagacgaagtcttgttctgtcacccaggatggagtgcaatggcttgatctcggttcactagaacctctgcctcccagattcaggtgactgtcctgcctcagcctcccaagtagctaggactacaggcacgagccaccacaccccactaatttttgtatttttagtagagatagggtttcaccatgttggccaggctgggtctcaaactcctgacctcaagtgatccacctgcgtgggcctcccaaagtgctgggattacacgtgtgagacaccgcacccagcctcaaacgtaaatttaaaacggccccactcttacccactacctaggtttagaagatgctactaaactaaagccctgctcctccccttttcccgctgtccctccctggagggaatcttcccaaagttcaggagcatcactgccaagcaagtttccattttttctcttcattcaacaaatatttgttgagggtcttctacacacacctggtgctcttcagatgcactgaaaaacacaagcaaaatcccaggaaatatttaatacctccactacctgtgcaagtgggttgtgcatgtttaaatattacacaaggctgggtgcggtggctcacgcccgtaatcccagcactttgggaggccaaggtggcaggattgcctgagcccgggagttcgagaccagcctgggccacatggaaaaaacctgcctctacaaaaaaatacataaattacccaggtgtgatggtgtgcgcctgtagttccagctacttgggaggctgaggtaggagaattgctggagcctgggaggtgaagattgcagtgagctgagactgcgccattgcactccagcctgggcagcaggagtaaaaccctggcttagtaaaaagaagaacatgtgcccctacaactaggtgctgccaaagtgcttacgccaactgtgcagaccagcaaaccagttcccacttcccgaagatcttctggctccttaatttttttttttttttttgagacggagtcttgctctgtcgcgcaggctactgtgcagtggcgcgatctcggctcactgcaagctccgcctcctgggttcacaccattctcctgcctcagcctccctagtagctgggactgcaggcacacgccaccacacccggttatttttttgtattttgtttagtagagacagggtttcaccgtattagccagggtggtcttgatctcctgacctcatgatccgcctgcctcggcctcccagagtgctgggattacaggtgtgagccactgtgcccagccttggctccttaagttttgtcagactcaaaggtgtgaaaaacctaactctgttttgttgttggtggttgttttttgtttgttttgtttttgtttttgttttttcgattcagagtcttgctctgttgcccaggccagagtgcagtggtgcgatcacagctcactacaacctccgcctccccagttcaagagattctcctgcgtcagcctcctgagtagctgggattacaggcgcctgccaccacacctggctaatttttgtatttttagtactcctgacgtcaggtaatccacctgcctcggcctcccaaactgttgggattacaggcttgagccaccacgcccagcctctattattgtttctaattttcttgatgtgaatgtttagatcattaattttaaatcattttttgtttctactatatacatttaaagctataaatttccctttaaacgatttcagctgcatccaataagttttgatgttttttctatttccaatcatgatgttgtttttgtttgttttgagacatggtctggctctgtcgcccaggctggagtgcagtggtgcaatctcagctcactgcagcctcaatttcctgggctcaggtgatcttctcacctcaggtccggagtagctgggactacaggtgtgtgccaccatgcctggctaattttttgtatttgtaatagagatggggttttgccatgttggccaggctgatcttgaacttctgaactcacatgatccacccaactcagcctcccaaagtgctgggattacagatgtgaaccaccacacctggccatgatgttgttttagattttgaagtgtatctttaagtttctaaactatgttatcttctctatttacttgtaaattatttactttaaatttcattgcattgaattcatagaatgtgggctgtaggatgtgctgattctttgctatttgttgaaacttgcttagtggtctaatgtatggtcctcctttctggtttgcaaaagtcccatgcattcctaaaaacgatacatattctttaagtgttggatacatgtatatgatcacatgttcacatctgcctgctacaagccagtcttgtacatgtcatttttagtctctactggagagtttgtttcactcttcttatatattgcccatttgtgctatttccaagctgttgctgattctaagactttaaactggtttgcagacctgtatccattaggttttattgcatgacatactaccccaaaatttagcagcttacgattctgcaggtcagccacttgggttgggctcagcagggaggttttctggtcttggctgggcccactcatacacctgcaatcaactagggggccggctgggagctggctgtgcaaaaaggcctctaatggttcatctctgttccatgaggccttccaaactcctatactgagtttgttcatgtggtgactgagcatggttctatgagaatgagtggaaatggcaaggtctcttaaggcctaggttcaaaatcggctcagtatcacttctgtggcattctggtggccaaaccagttacagagccagccagattcaaggagcaaggaaagagacacctctctttgctgcaaaaagctgcagagtcacatttaaaggagtggcctggtgcaagaaatgaatggttgtggtcaccatgcagtcacaaggcccttgatgttccagtctttttttggctactcccctccacccatcaacaatctcccctcatttcaggtacctcccctctccatccccctctcaactaagaaagccttcctaggccgggcacggtggctcacacctataatcccagcactttgggaggccgaggcaagcagttcacctgaggttgggagttcaagaccagcctgaccaacatggagaagccctgtcgctactaaaaatacaaaaaaattaaccgggcctgtaatcctagctactcgggaggctgaggcaggagaatcacatgaacccaggaggtagaggttgtggtgagccaagatcaggccattgcactccagcctgggcaacaagagcaaaactccatctcaaaaataaataaataaataaataaataaataaataaataagccttcctgaactattcccacccatgcttctacccctgcccaggacagctgctgctcctgagccctcgaggaggtaagggagccctctgttcacctggatgatagcgaaagctgtgtccccctccccaggggtggttcacaatagggtttctgatcccctgtgtctcctgtagctcgtgtgggccacctcaagccagctgggctgtgggcggcacctgtgctctgcaggccaggcagcgatagaagcctttgtctgtgcctactcccccaggtaagccctgctacaccctctgctgggatgtctgggagacagggaggggtgctttcaccgagggtgagattcccacacatccacccgaaagtagagtccctgatgccttgctctgcacccttggtgggagaggggaggagaggaaaggcagagggtgctaaagattctggccacgcagaaggtgctgctctgcggatgtcccttcctggatactggtcctggtatcagggagtttgtccaggattggtttggaggccatctcttctctcccagggaatctccctatctcacccagctccctgactccctggcctggccgcaggagctgaaggggccaggggggcaggcagcagggccctgcctctgccttgcccaaggccaggccctcccacaccctgtggtgcctgctcgtcctcacagaggcaactgggaggtcaacgggaagacaatcgtcccctataagaagggtgcctggtgttcgctctgcacagccagtgtctcaggctgcttcaaagcctgggaccatgcaggggggctctgtggtgagtgcatgagggctcagtctggtgaccctggggtgggggtggtagcatcctactgggctgtcccagaagccctggcccttagcacccagggaggctcctgcccggcctgctgggaggagacccttttctcagagtcccctcctcctctgaccagaggtccccaggaatccttgtcgcatgagctgccagaaccatggacgtctcaacatcagcacctgccactgccactgtccccctggctacacgggcagatactgccaaggtgagggcactggagcctgggtgtgcccagccctgctctcgtggcaggtcctagggctgctacacttcctgagagtctcaagggtgtcagaggtgctgactgtgtactccctgagtctgcccactgcatacattctttcaacaagcattcactgagcactagctgtttgccagaccctgagctgtgcaggagattcaaagtgaaatcaggttcagccccttaggctctgggaggaggacagaattaggacccagaagtggattcttgccctactgcccctctaccctaacccactctgtgaccatgggcaggtcacctcccaaactccaatatgcctcactctgcaatggggaccaaaccaaagacaccaggcgtgccagcaatcggaagccttggtgggttctgtctatgggaggggtattcttgctgtggttggcattccctggatgttcgaggcctctggggggcagcgtggggtccagaaggctgggggctgagcctctgccccactgccctgccctggcagtgaggtgcagcctgcagtgtgtgcacggccggttccgggaggaggagtgctcgtgcgtctgtgacatcggctacgggggagcccagtgtgccagtgagtcctgccccagggcccccaaagagccagctcctctcaagaccccccttcaatggggcatcagctcccaggagcccgctgtgtgcctctctttccaactcattcagtgacaacacgttgagatcttgaaactggccacagcatggatatttacaccaaagaaattggcaaatgctataaaccatggatttttttttttcttttgagagagagcaagctcaatattccaacttaccagctcgctcctgaccctcaccacccactcttttggagcaggtggccagaggaaggggcaccctgagcttagctccccggcagggcaggaaagggcagggattctgaagtccacacacaaactcaggctcccctaccccagccaaggtgcattttcccttccacacctgtgacctgaggatcgacggagactgcttcatggtgtcttcagaggcagacacctattacagagccaggatgaaatgtcaggtgacagtcacccctagcttcctaggaaccccctagggcctcaagtgagggtcttaatgcagggaccctggagtgagaggtggttccttccacgtctctgacctcaccctattcatcagcataaagcaggggtcgtggactccaaggctcatagaagccaggaggtcacttattgacctgaggggccaaggtcaagaccaacctccatctaagggagttccagccactggttgccttgcaggaatgcaaggtcagggtggccagagctcggggttgttcaagaaaaccagcaacccagacttccactggcaactctcgaaaccacaattaattactggggttggcaatcaacttggatatatttaagacactgtgcaggtgaaacagaacctcctcaggggccagaccttgcctgggcttgtgggctgctggtcgcgcccccgtgcacagggagaagagaagcagacgggagcagaagggacccctgctcttggaagggaggctgtgcgggctgggggtgatgatagcccggccagcacacacacgtggcatcttaggccatgggcaggggtggcaggaaggggcagcctgggctctgggagccttgcctgtgtgacccagggtggggttacagaggaaaggcggggtgctggcccagatcaagagccagaaagtgcaggacatcctcgccttctatctgggccgcctggagaccaccaacgaggtgattgacagtgacttcgagaccaggaacttctggatcggtgagtgcccagctgattgggggtatggcgagtaaggggttgtgatgccccaccctgctgcaggaaccctgggccatggcggctgccagcagatggcaagggtgtgttgagggcctggagcccagagcggggccagctgctcaccccctttcccgggaagggcccaggtagggagcacatgggggctgccagcgctgggaagaggggccagaaaggcagctggcagcagactccagggtctgagtgggccaaccttgactaccccggcccagggctcacctacaagaccgccaaggactccttccgctgggccacaggggagcaccaggccttcaccagttttgcctttgggcagcctgacaaccacgggtaagtgtggggtgcctccctcccctgggcctccttctcacttgggcctgcctggtggagccccccatcccgctgcctggctgggccctttgagggtctgatccttccctggtgcctgcccaggtgccagagagttgtgggcacagctggtgtgggccggtggtggggtgagggagatgcaagccggaaggcacgtcacgtgggggagagagggacccaggaagcctccatccatctgtccatccccagtgtcccctggtgtgactccatccctccaattctcatccactcacccctccgtctgcatgccctctgcctgcatcagttacactgatgccagcattccttagctgtcacccacctgcactcattcacaatacaaccctgcacctgcagacccaccagccatcctgtagcaagaaccctctggtcacgtggccccaccctgctcttcaaagcccagcaatgcccagggccagggtggaggtggtccggctgcgaggccaccaagggctccagcgatttcagccagccctccttgccaacagccggcctgtgcccctggcctcttgcctggaggaagtctgggccttgttgggttcccaggtgtacctctcaagtgggctgtctattccagtccccaccatccccacaggctggtgtggctgagtgctgccatggggtaggcagagctgttaccccaggaaggggcttccctgagaagtggagcagggctgggggcttggggacgggcctggctcccggcagccccgtcggcaggtgggggcactggagcccctgagatgcagggtcctgatgggtggagggcttaggcctctcccggatccctgacttcactcttgcctcctgaccaccacaccatggcctgcaggtttggcaactgcgtggagctgcaggcttcagctgccttcaactggaacaaccagcgctgcaaaacccgaaaccgttacatctgccagtttggtgagggacttcctgaggctccccttctctgatctctgaccctgggggtgctgctgacccggtccagcctgcaagggtatctaggtggcaggttcagagtgggtctgggcacacggggccatagaggatgccctgttgatggccttgtacctgtgggctcctgagcccagaggggcaacgacgggcccagcttcatacagcaaggccacgcaggaaggactagagctacagctctgcaggggatttctccaaggaccctctcctgtcatgaaagctgctgcctgggaacctgttgggttccttggtgttcccgggagccccatgaactgtggtggaggcggaggtgaaacctagcatggcaccagctcccagcagcctctgctaggaaggcctggagcgccacagggaccacggccatgggcacttccagaccgagtgcaacagggctgccatcttgggactgcctgggctgccatcgagccctgctctcttctgcttccttccagcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcagacatcacccacaaggggttatcactgtcccagtttacagcggaagaaatgaaggcagagagattgagtaacttgcataagatcatacagctgggagtcaaacccagtgagtctggctgtcatttatttattttttttcttttcttttcttttttttttttttttttttttttttgagacggagtctcgctctgtcgcccaggctggagtgcagtggcacgatctccgctcactgcaaactccgcctcccaggttcacgccattgtcctgcctcagcctcccgagtagctgggactacagacgcccgccaccacgcccggctaatttgttttttgtatttttagtagagacggggtttcaccgtgttacccaggatggtatcgatctcccgacctcgtgatccacccgcctcggcctcccaaagtgctgggatgacaggcgtgagccaccgctcccggccctatttttttcttttttgagacagagtctcgctttgtcgtacaggctggagtgcaggggtgcaattggggttcactgcagcctcgaactcccaggctcaagcgatcctcctgcctcagccacccaagtagctggaaccacaggtccgcaccaccacgccccgctattttttgtgttttttgtagggacggggttgcaccatgttgctcaggctggtctcgaactcccgtgctcaagcgatccgccatcctgggcctcccaaagtgctggggttacaggcatgcggcccggcgccggcccagtctttccctctcccactgcttcccagggcttcgcctgtctaaccgggcgcgggcagttgtcctgtgtcctggctcagcgcggacctacgcggggtggtcacacagatgcccccagctctctctacctcccgcgaaggcgctgagccccctgatccctgcccgggcactggcgcaaggtcgcctgcgagcgccaggccttcctgcccggtgggagacgggagggcccgctctccggctcggtctggttcccgggtcagccagcagccgcgcctcttcctcccagacccgggacccgccccttggccggggccgcggccgcagcgcccggaggggccgccctgcgcatgcccgcgggaggtgggtgacccgggagcgcgctgcccgaggccggggggcggtggggacagcacaggcggggcggccgaaccgagaccttcccaccccgccccacgcctggttggggacctgacgcgccgtcgtgagtggggcgggtgcaggtgtccctgggggccgggggcagacactggtgcgggacgacctgctcccgagggggtccgcaggccacacccagagaaactggggcgcctccagtcaccgccgcggtccgccccgccggaggctttgaccccctgaatcagcgtcggggcagggatccgcgtggggtggaagaggctgggaaacttgggagtcccgggcctcctctggagccgcccgcccttggctggctggtccttctcttcctcggctcccgccgggctgggccctgggccgccctcactccctcccctctgcagcctcccttgcgtttgtcattcactctgccaggctctccttctgcctccgcatgcccaacgatccggagaaaaacacggaccatgacatcaaaaggccttggccaaggaatcgtgattattgtgatacaagattctgcacctcaaaggggatccctgtagtgagttttggaaaacgtacaaagcctgacttacaatatgcctgttatctgtggcgtttcatctggggaacttacttttccttgatagggtaaactattctcatccagagtatgtccctcagtctgtaaaagtccatggtgccctacatctattaggggagtgaggaagggcagtgggcattggatctgcttctttgaaagcccccacctgtgtttagcttctgttagaggcctttgaaccagagcaactccatcttgagtaggcgctgggtaaaatgaggctgagacctactgggctgtgttcccaggtggtggaggcattctaagtcacaggatgagatgagaggccggcacaagcagtaaagaagccgcggccaaaacccaccaaaaccaagatggtgatgcgaatgacctctggtcgtcctcactgctacactcccaccagcgccaagacagcttacaaatgccatggcaacgccagaatgttaccctatatggtctaaaaaggggaggcatgaataatccaccccttctttagcatataatcaataaataaccataaaaatgagcaaccagcagccctcggggctgctctatggagtagccattgttttatttctttactttttttttttttttgagagggagtcttgctcttgctcaggctggagtgcagtggcgtgatctcggctcactgcaatctccgtctcctgggttcaagcgattctcctgcctcagctttcgagtggctgggactacaggtgcccaccaccatgccggctttttttttttttgtacttttaatagagacggggtttcaccacgatggccagggtggtctcgaactcctgtcctcagatgatctgcctgccttggcctcccaaagtgctgggattatatgcgtgagccaccgcgcccagccctattcctttactttttttttttgaggtggagtctcacacctggcctccaatatgtttattcatattgctgaggcaggggattgcttgagcccaagagtttgaggttgcagtgaaccatgatcataagctgtatttcagcgtgagtgagagattgagaccttgtctcacaaaataaaagttaaaaagcccttatctggaggtgagaaagccaaatacaaaggtcttctcagttggttcccagtcttcccagtccagcagcctcagcatcaccagggagctggttaggcaaattctcggcggccccaacctactgaattggagaccctgaagatggggctatctgaattttaacaaggcctccaggtttgcatgctcaagattgagaaccactggcaaaagcaaacaatttgaatctgaagtcagcccacctgcatttgaatacaggccctgccacttaataactgtgatttagagcaagttagttacttaacagctaggttgaccaattgtccgagtttgcctggcactatcctgatttcagcactgaaagtactacattatcgctgtggctcacgcctataatcccagcttctcaagctgtccctgtggaatcctcaatatcggtacattcatccctatctagcatccccttcctccctcacccatcctgcaccctcagaattcattctcagatcagcttcccagatttttgccaatatcaattaaaaaaattttttagccaaccatgtactgtgagtaagccaatatcaattagcaaaatctttaagtttcttttggtgattcagtatcttccccctggagttttttgatgattcagtaccctcctagatttggcccctggggcctgcggggatgtgacttgtcatttaattctggagaaaatgaggggtagggcttataaggagactccttcggggcagggtcattacagggtgtgttacatagggaaatgctagctgctggctagctctcgctcttgaaaggctcttcctccctcaactgaaatggggaagggggaaccccggccgactgaggtcctgacatctttagcacatggcttcttaggtcacccagggcatccaggttaccagcttgggaaacaggagatgtaggttggaggaagaggctacagcccaccctggaaataactgccatccgtcccacccatatggttaggctttgtgtccccacccagatctcatctcgaattacaatccccacgggttgagggatggaccaggtggaggtacttgcatcctgggggcagtttcccccatgctgtgctcgtgacagtgagtgagttctcacgagatctgatggttttaaagcgtggcagttcctctttctcgtgcttacatcctcgtaactatcctgtggagaaggtgtctgctttcccctacctccatggttgtaagtttcctgaagcctccccagccgtgtggaactgtgagtcaattaaacttctttataagttacccagtctcggtgtttgcttttttgagatggagatttgctcttgttgcccaggttggagtgcaatggcgtgatctcggctctttgcaacctctgcctctcgggttgaagctattctcctgcctcagcctcccaagtagctgggattacaggcgtgaaccaccacacccagctagttttgtatttttagtagagagggggtttcattatgttggtcaggctggtctcgtgctccaagcctcaggtgatccgcccacctcggcctcccaaagtgctgggattacaggcatgagccaccgcacccaaccttggatgtttctttatagcagtgtagaaacagactcagccgtcgctgcaggccatacctcagctacatagaacacctaactgcccgcaagggagttcctgctactaggatcttcagagtgacaaagaggaagctttggctggcaagggtggtggggaggggaggggctaggtacctaaggcttccctatctttccacacagcctaattttcatagcctctggtctccacatttcactctttcccaaataaagaccttttaaggtgtgggtccccttggtcattctgtaaccattggatcaagttttcagttttttctgctctctcagctgcaaaataacacattcgagttttggtttttttttttttggagacaaagtctcactctgtcgcccaggctggagtgcagtggtgtgatctcagctcactgtaacctctgcctcctggatataagcgattctcctgcctcagcctcccaagtacctgggattacaggcacccgccaccacacctggctaatttctgtatttttagtagagacggggttttgccattttggccaggcacactcgggttttctaaccataccttgagccaagaatttggattctgagcttgtcttttcatttaagctatgtggcgctgttagcatgaccgccctgcccagcagatcttgacttcagtgtaatctttattctcttctatggcaggagccattaggtcccccaaagccttgcctttgatgggtactttgttcccggggacaatgggattagctgtcttgccagggcgtgccatggggctgctggtgtcctgtcccttaataccagctggattttcactgtcctctgaccactttccagccttcaattgctcctgtttcctttggggcttcttgctctgtccagtcctggtcctatttttgtgagaatcaaggttcttagttttaaccaacagaaactaattctggcaactctaaacagaaagggacttggtcagaggtcctggctagttcccaggagctcaaaagggtcagaaaatcaaatcaggaagaggacattgggcaaagctggccaggtgaagaccccacagcctctgctggcacagaagctacaattggcaccaccgaagtgggacagaagctgccacctgtgcaagctagatgtagtcgctgccgctgtcaccatcaatttttgagatgatgcttcttcctgcctgccactttaattcaaagcgaaggccaggtgcagtggctcatgcctgtaatgccagcactttgggaggccaaggcaagaggatcgcttgaggacgggagtttgagatcagcctgggcaacagggtgagaccccgtctagccaaaaaatacaaaaaaaaagagctgggcagaaagaaaatggctcatgcctgtaatcccagcacttcaggaggccgaggcgggtggatcacctgaggtcagaagtttgagattagcctggccaacacggtgaaacactgtctctactaaaaatacaaaaaattagtcaggttgggtggcgcacgcctgtaatcccagctactcaggagactgaggtaggagaatcgcttgaacccgggaggtggaggttgtagtgagctgagatctcaccattgcactccccgctgggtgacagagcaagactagtctcaaaaaaaaaaaaggggccacgtcgatggaaggacaagaataaagaaactgaggccgggtatggtggctcacgcctgtaattccagcactttgggagtccgaggtgggcggatcacctgaggtcgggagttcgagaccagcctgaccaacatggagaaaccctgtctctactaaagatacaaaaattagccaggcatggttgcgcatgcctgtaatcccagctattggcgaggctgaggcatgagaatcacttaaacctgggaggcggaggttgtggtgagccgagatcgtgccattgcactctagcctgggcaacaagagcggaactgtggctcaaaaaataaataaataaaaaatagagacattgggccaggcacagtggctcgtgcctgtaatcccagctctttggaagaatgaggtaggaggattgcttgagcccaggagttcgagggtgcagtgatcacgtcattaaactcccacttgggtgacagagtgaggagctgtctccccacccccatcccccaaaaaaagaaggtaactgggcaaagaagttatttttagtagagactggctttcatcatattggccaggctggtcttgaattcctgacctcaggtgatccacccacctcggccccccaaagcgctgggattacaggtgtgagccacggtgcccaacctcctcttctcatttaatcctcaaaatcatctcacaaagcaggtgctattaatacccgcgtcttacagaacggttaacagatgtgtccagggccgcatggagaacaccttgagagagcaatgagatctcgctctcctgcctcatgaccgatacacggtttcaagaagttagatgacatcacagatactcagggcacccagctccaggccttactgccttcgcacaaggccgctctctactagcttcaccccgcatggaatgcaatggtcaatgaggccctggtcagaacatgggactgacaaagccagcacttgtaggctgagtctcagatcacgtggcttgtttgttttgtttgtttgtttttgggagatggagtttcactcgtgttgcccaggctggagtgcaatagcaccgtctcagctcactgcaacctccgcctccttgttcaagtgattctcctgtctcagcctcccgggtagctgggactacaggtgcatgccaccatgcctggctagtttttgtatttttagtagagatggggtttcatcacattggtcgggctggtttcgacctcctgacctcaggtgatccacccaccttggcctcccaaagtgctgggattacaggcgtgagccactgtgcccggctggcttttttttttttttgaggagtcgcactctgaaatccaagctggagtgcaatgatgtgatctcccaccatgctagttgtgtttgttgttgttgttttttctttagtagagatggagtttctccatgttggtgaggctggtcttgaactcctgacctcaggtgatccaccccccacctcggcctcccaaagtgctaggattacaggcgtgagtcaccatgcctggcctcaatttcttgaaagacaaagaaaaaagacagaaagagagaaagaaagaaaaagaaaaaaaagagaaagagaaagagaacaagaaaaagagaaggaaagctccatgggtttaaatgcaagagtcagcttcaaggagggctgggaagtcaggtgacgccacccttgtgcttcccgcagccagatcacctggtggaggtaccgttggttttgggcccctctctcagcacttgctaccagagaggacagctctacaccagagagtgagggtgggaacctgctcactgctgtctgctcagggctgggcatgaggcaggtgctcagtaggggtctggagaataaatgaatgaaccatcacggggccaagcacctggaagcgggctggagatgcttgctctggactcctggctcaggagtggactccccaggtggacttcctcctgcatcaccacagctgagtgcatggagcacaggtagggcagctaatgagcagggtcatcatgaatgacagcagatgacaccaggacaggggaggtcagtagccagatgggaagaaagcagaatgaaacaggtcacccgggtgcagtggctcatgcctgtaatcccagcatttcgggaggccgaggtaggcagatcatgaggtcaggagatcgagaccatcctggctaacacggtgaaaccctgtctctgctaaaaatacaaaaaattagccggacgtggaggcgggtgcctgtagtcccagctactcgggaggctgaggcaggagaatggcgtgaatctgggaggtggagctagcagtgagccgagatcgcaccactacactccagcctgggcgacagagcgagacagtctcaaaaaaaaaaaaaaaaaagttctggcggagagtgtgggtgagcactagggtactggaaagattccatgcctgggaatcgtgcgtggattgattacatccccacttctggcaaaatgcttcatggccttgtgcaagttaactttgtctccctgggcctctgtttactcatctgagaaacggggtaaagacatttgctcttcttaggtcacagggctcctgtacacgatgtgaaaggactttggaaagtatcctccggtgtgcaaatttctctgagaagtgctgtggctgtttatccttagactggaatgagaagggggagatgtgacttttgtgactttcagggtgggccaggtgttgtaggtgacaggacaatctcaggctggtagcagtggctcatgcctgtaatcccagcactttgggaggctgaggtgggtggatcacttgaggtcaggagtttgagaccagcctggataacatggttaaactccatctctactaaaaatacaaaaattagccaggttggggtggtgtgtgcccggagtcccagctactcaggaaggtgaggcaggagaatccttgaacccgggaggcggaggctgcagtgagccaagattgctccgctgcactccagcctcagcaacagagtgaaactccatctcaaaaaaacaaagacaatctcagatgtgcagttcacaccctggggctctccgtgggatcaggctgagggtcgcatttaactgaaatcttcaggagttcagcgtcggggtagatattccctgagaagcagctgagaggtaaagcttcctccgggaagtactcacttgctccttgttgatttcatggggtctcaggtttcaggaggaaagtaaagatgaaaagcccttgctctggcatcttggaggacttctgggtgagagccaggaaggggaaggcgtttggactcattgccctcccaggcctggagtctgattttcctgctctgtctggttttggaggtggaggctgcgaagccgaagcagtgctggtcctgccagctcctcccagctcctcccctgccctctgcttccctggccttgcacagggacaaggagctccaaagagcggctctgtcctgtctcagcctgggagggaagagggaggtggcatagatggttccacaaacagttcagtacgtgccaaaggagggcctgggaagccccaggtcaggagagggtgcctgcccttcccgtgaaggccagggctgagctgcttcctgccagcatccagttttgctcagagcacccagaacgccgtcttggaggaacgggggcaggcgctgccgcagaaccctggagctgtgtctcctgcctccagggctggccgtagctgcaaagaccagctggcaggtggaggactcaggaagactctccctgtgttggccctgcagccccatgtccccttctctgcttcttgggaacaggaggcctgtgtctgcctgtcctgagcatctcaaaaggaaaagctattctagggatgatgagagggaatcagggcctgaggcacttggaggaacatttgctgagctccctgtgcaacagcccattccaaggccaaggttgcaaaggtggcttagatgctgtccctaaatggccatcgaggttccaagcctggcaggaagggctcgagtggtggggccacagcggagacaaggccaagcagcctgattcttgggagtggaggttaatgagcagcgtttgcacttggctttctatagggtcaggctgtagtgcaacatcctgaggtgcgtggctgcccacaggtgctcagccagcccagcctctgccaaggcagacagagcctgggctgggaagcgggggatcccactgcttggggagtccccttttcttctgcatagtggggatgccaggagcagtgaacaagctcagcaaagagttctccagcccgacccgaggtttccttcctcctgactttgtcacctcactgggagaatatacagctctgtctgaaacaagtttcctgcggggcaccctgtgcaggggaagctcgggcagcccaacctaccagatggaagggaaagatagaggctgtgaggttcttctgggcctgtctacagcctcttctacctggctgccctttgttcagagtaaaggatgcagttcccaagacataagcaccgcgggcttcagagtatgaaggatccttccaggtcagccactttgggcaactggtgagcaaggcgggtgtgcagggccggctacatcatttgtggggcctggtacagaatgaaaatgtggggcccttattcagaagttactaagaatttttttttttttagatggaatctcactctgttaccccggcgggagtgcagtggcacgatcttggctcactgcaacctctgcctcccgggttcaagtgattctcctgcctcagcctcccgagtaggtgggattccaggtgcccgccaccacgtctgggtaatttttgtatttttagtagagacagggtttctccacctggctggtctcgaactcctgacctcaggcgatctacctgccttggcctcccaaagtggtaggattacaggcatgtgctaaaaatttcaagatgaggacagcagagcataagtgaagcgcaggacccttgcaagtgggtccgtctgggtgtgactgcatttggggagaaggggatggggtcctgcctgtccctgcagtcacagcataccacgagtcctggggcagaggagcctggattcaggcccttggtgctcagcggtcctggctcacggacacccctcgttcagcagccagggggttcctcactgtgtcccagatgtcactctaaagattgcttcagaggctccctccccgaatcgttggagggactctgccagttccaatgaccagccagctgccttcaggtcacaaaagaatctggggctggtctgagaccaggtgtacccccagaccccatctctgtccagatcatgagagggggtccagggtcccccgcctcccacagttgggcttcactgcacagctggaactcagccaggcctgttccgggaagcagggctgtgagtgtgagcagtccaggaccttggcattttgaacaaagaattgaacaaaacccacaaagtaacatagcaatgaaacatgggaaggaagcagtgaaagcaggaatttatgaaacagataaagcactctgcagggctggagtgggcctaagcaagcggctcaagagcctggttacaaagtttcctaggtgttttgttagtttgtttttgtattttattttttttattattattatttttgagaagtctcttacccaggctggagcgcagtggcatgatcttggctcactgcaatctccgcctcctgagttcaagtgattctctggcctcagcctcccaagtagctgggattacaggtaagtacccaccacgcccggctaattttcatattttttgtagagatggggtttcaccatgttggacaggctggtcttgaactcctgacctcgttaatcggcccacctcggcctcccaaagtgctgggattacaggcacgagccatggcacccagcctcctgggttttaagtactgcttttgaggttctattggctaccccttatctggatgaaggatttggtctgtggctcataaaaggctaatgtgaactggcgccctgtgcagatgaagggatgacccatgcttcgcctgcggctaatccaggacactctcccttcccatctaagatgtggtggagacaggagggtgatagggtgtctctatattaaaaacacacacacacacacacacacacacacacacacacacacacacacacacacacaaaggcagccagactatgcactaggaactgccctgggaatcccgttgcgttctcacaacaatcccacttcacagataaagaaaccaaggcacagaaatattcagtaacgtgtccagatgcggtggctcatgcctgtaattccagtattttgggaggctgaggcaggcagatcacgaggtcaggagttcgagaccatcctggccaacatggtgaaaccccgtctctactaaaaatacaaaaattagctgggtgtggtggcaggtgcctgtaattctagctactcaggaagctgaggcaggagaactgcttgaacccgggaggcggaggttgcagtgagccgagatcacactactgcactccagcctgggtgacagagcaaaactctgtctggaaaaaaaaaaaagaaaaaagaaatactaagtaacttgtctgaggccacttagttaccaagacgtgggagctgggacttgaacccaggcagtctggctggattcatgcctgcagcctctgcactcctgctacttcctgtgtgagaagcgcctgttctgtggaaggttgtgggctgagatctttccatgacttccactcatttacccccaaggctgttcttaaagacgggcatgacagttatgcccattttacagatgggaccctgaggctcacaagggcatgccactcacccatctccacaaagctatagctcgtcagcagagggcagaattcggccgcctctcccctagctcgaaggctgtgattgacacagaggtttttttgttgttgttgctgttgtttgttcctttttcttttttttttgagacagggtcttgctctgtcatcccggctggagtgcagtggtgcgatctcagctcactgcaaactctgcctccaagatgcaaatgattctcgtgcctcagcctcccaagtagctggaattacaggtgtgcactaccatgcccagctgttttttgtagagatggggttagtagagatttgtttaatagagacgaggtttcaccatggtctctactaaaccctgtctctactaaaaatacaaaaattacccaggcgtggtggcacatgcctgtagtcccagctactcaagaggctgaggcaggagaatcactcgaacctgggaggtggaggttgcagtgacccaaaatcatgcactctggcctggggtctcgcttttgcccaggttagagtgcagtggcacaatcatagtggcttactgcagcctcaaactcctgggctgaagggaatcctcccacctcagcctcccaagtagctaggactataggcatgtgccatcatggcgagttaattttttgtgtgtttttattttctcgagacagagtcttgctctgttgctcaggctggactgcaatggcgtgatcttggctcaccgcaacctccacctcctgggttcaagcgattctcctgcctcagcctcccgagtagctgggattacaggtgcgtgccagcatgcctggctaattttgtatttttagtagagacagggtttcgccatgttggtcaggctgctctcgaactcctgacctcatgatccacctgcctcggcctctcaaagtgttgggattacaggcatgagccactgagcctggcctggggagctaatttttaaatttgttatagagacaagagagacaagagtctctcttatgttgcccaggctggtctcgaccccgtggcctcaagtgatcctcccacctcagcctcccaaagtgctgggattacagatgggtgtcaccgcagctggcctctgaggagggtttcattataaacctgccctgaagggagggaatccaattttacgagagggtgtagcctggtgaggcctggatgacctccgcaggcaggggcttgtgcctgggctgaggcctaagggacaatgggcagacatgaagttgccccaggcagagggtacagtgtgggcaaagtcaggaagtggcagggcttggatcactccaggaagagagaggactcacgtgtcacaggagctcgagacccagagagagagtgaggcaggcaggcagggaccaagcttgggcacagccaggaaggcaggacagggcatggtggggccaatggaatcattacccaagacgggcattttcagggaaacagcttagataaggccaggcgtacagtagctcccacctgtaatcccagcatttggggaggctgaggtaggaggactgcttgcgcctgggagttcgagaccagcctaggcaacatagtgagaccccatatccacaaaaaatttaaaaaaggagtttgtgttcctgtagtagcatacttgggaggttgaggtggcagtatcacttgagcccgggagttcaaggctaaagtgagctgattgagccattgcactccagcctgagtgacagagagatacgctgtctcaaaggaaatacaaattaaaaaaccagccgggcatgctggtgtgtgcctgtagtctcagctacttgggacactgaagtgggaggatcgcttgagcccaggagttcaaggctgccgtgagctatgattgtgcctgtgcactccagcctgggcgacagagaaagaccctgtctcttaaaaaaaaaaaaaaaaaaaaaaaatcttagaggatgctgtgcctccctgggggtcttcagtcacccatggtcctggcagcagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcaccaccatgccacccaccccgagtatcccctgggcatcctggcatagccagatgacttccgtgcccgttgcaataaccactgcttccaactctctatagaccaccccttgggtatatctaatgtaagtgatatttattttatttattttttgagtcagagtctcgctctgtcacccaggctagagtgtgctgatgtgatcttggctcactacaacctctgcctcctgggttcaagccattctcatgcctcagcctcccaagtggctgggactacaggcatgcaccatcacgcccagctaatttttgtatttttttcagtagaggtggggtttcaccaagttggccgggctggtctcaaactccccacctcaagtgctctgcccgcctcggcctcccaaagtgctgggattacaggcatgagtcgtggtgtctggccctaatgtgagtgatctttaacaatgaagacttgaaaaagaaaaccctgaagaaacctaattctttgatgtctggacgacaaggaagaagatagatagaagtggcatcagataataaacagtgtaaatgtttatcagaaagaggctggtggttgggaccagtaggaggatcgcttgagtccaggagtgcatctctacaaaaaagttaaaggattttttaacattggccaggcatggtggcacacatctgtgatcccagctacttgggaggctgaggcaggattgcttgaagcccaggaggctgaggctgcagtgagctgtgatcgagccactgcactccagcctgggtgacagagcaaaacccagtctcaaaaaataataataatattttacataaccaaccacttctaaagactaaaaaaaaaccctacaattaaaaacctcaggtccctcaggcaatcataccagatattgaaacaaagcaataacataaggactgcagtatttattttatttttatattatttatttattctttgttagtttgtttttggagtgtgggttttgttttgttttttgatttttttcttttgttccacccacagatttcttcttattgcccaggcttgagtgcaatgacctgttctcagcttactcaacctctgcctcttgggtttcagtcatttttctgcctcggcctcctgagtagctaagggaggagtcttgagattatcatccacggagggtggaagaggagagggtggaaggggaataagaagacactccagtgaagcacttgccttgcgtgcaaaaatgtaagggggcctctccctctccctctccgtctccctctccctctccctctccgtctccctctccctctccctctccctctccctctccctctccctctccctctccctctccctctccgtctccctctccctctccctctccctctccctctccctctcactctccctctcactctccccacggtctccctctcatgcggagccgaagctggactgtactgctgccatctcggctcactgcaacctccgtgcctgattctcctgcctcagcctgccgagtgcctgcgattgcaggcacgcgccgccacacctgactggtcttggtggagacggggtttcgctgtgttggccgggccggtctccagcccctaaccgcgagtgatccgccagccttggcctcccgaggtgccaggattgcagacggagtctcgttcactcagtgctcaatggtgcccagactggagtgcagtggcgtgatcgcggctcgctacaacctacacctcccagccgcctgccttggcctcccacggtgccgagattgcagcctctgcccggccgccaccccgtctgggaagtgaggagcgtctctgcctggccgcccatcgtctgggatgtgaggagcctctctgcctggctgcccagtctggaaagtgaggagcgtctgcgcccggcagccatcccatctaggaagtgaggagcgcctcttcccagccgccatcacatctaggaagtgaggagcgtctctgcccggctgcccatcgtctgagatgtggggagcgcctctgccccgccgccccatctgggatgtgaggagtgcctctgcccggccgagaccccgtctgggaggtgaggagcgtctctgcccagccgccccgtctgagaagtgaggagaccctctgcctggcaaccaccccgtctgagaagtgaggaggccctccgcccggcagctgccccgtctgagaagtgaggagcctctccgcccggcagccaccccatctgggaagtgaggagcgtctctgcccggcagccaccccgtccgggagggaggtgggggtggtcagcccctgcctggccagctgccccatccgggagggaggtcgggggtcagccccccgcccggccagccgccccgtccgggaggtgaggggcacctctgcccggccacccctactgggaagtgaggagcccctcagcctggccagccgccccgtccgggagggaggtgggggggtcagccctccacccggccagctgccccgtctgggaggtgaggggcgcctctgcccggctgcccctactgggaagtgaggagcccctctgcccggccagccgccccgtccgggagggaggtgggggggtcagccctccgcccggccagctgccccgtctgggaggtgaggggcgcctctgcccggctgcccctactgggaagtgaggagcccctttgcccggccagctgcccagtctgggagggaggtgggggggtcagccccctgcccggccagctgccccgtctgggaggtgaggggtgcctctgcccggccgcccctattgggaagtgaggagcccctctgcccggccagccgccccgtccaggagggaggtggggggggtcagccccccccgcccggccagccgccccgtccgggaggtgaggggtgcctctgcccggccgcccctactgggaagtgaggagcccccctgcctggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaagaaaattaaaaaaaaaaaaaaaaaaaaaacaggctacctacaatttgtgttgaagatatgaatgaatgaagtttccacacccttatgtggagttctgataagtaagcaacaataaggaagggtccccaggttggggagaccccaagttgagaacaataatgaacaattattgtatgaacaattgttagagacagctaatcacaaacaacctgcgggcacaatgaccccattccacacgtagcacccttcagcaggaccctataaaactctcctccagcccttgcctctttgcaggtagccccttctgtgctgagctgcccattgcaacatattttcataatttctctaataaatctgcccttctttacctacaactatcttggtaaatggctttaccacctgcaaaactgaccctaggttgttgctacccgatatggtttggctgcatccccacccaaatttcatcttgaattgtagttcccataatccccatgtgtcatgggagggacccggtaggaggtaatcgaatcatgggggcaggtttttcccatactgttctcgtgatagtgaatacatctcactaaatctgatggttttataaagggcagtttccctgcacgtgctctcttgcctgctgccatgtaagacatacctttgctccttctttgccttccaccatgattctgaggcctccccagccttgtggaactgtgagtacattaaacctctttttctttataaattgcccagtttcgagtatttcttcatagcagtatgaaaagtaactaatacactacctgagacaccttaggagatttgtaatagctgtaatgccaggtccaccatatttttagcataaagcaaatgtttacccatgatatgactgcacaggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccgtctctacaaaaaatacaaaaattagctgagtgtagtggcacacacctgtagtcccagcaccttgggagggtgaggcaggaggatctcttgaacccaggaggtggaggccgcagtgagcagtgatcatgtcagaggtgtgtgaaccagagcaactccatcttaaataggagctgggaaaaatgaggctgaaactgctgggctgcattccctgatggttaaggcattctaagtcacaggatgacatagaaggtcagcacaaaataccagtcgtaaagaccttgctgataaaacaggttgcagtgaaggagctggccaaaacccaccaaaaccaaaatagtgacaagagtgacctcccatcatcctccctgctacattcctacaagcaccatgacagtttacaaatgccatggcaacatcaagaagttaccctatatggtctaaaaagaggaggcatgaaaaatccaccccttgtttagcatatcatcaagaaataaccataaaaatgggcaaccagcagccctcacggctgctctgtctatggggtagccattcttttattcctttactttctctttttcttttgagatggagtctccctctgtcacccaggctggagtgcagtggtgcgatctcggctttctacaagcttcgcctctcgggttcatcccattctcctgcctcagcctccagagtagctgggactacaggcgcccgcaaccacacttggctaatttttttgcatttttagtagagacgaggtttcaccatgttaaccaggatggtcttgatctcctgacctcgtgatccacctgtctcggccccccaaagtgctgggattacaggcgtgagccaccccgtgcccctcctcctttactttcttaataaacttgctttcacttcacactgtggcatcaccctgaattctttcttgcacaaaatccaagaaccctctcttggggtctggattgggacccctttcctgtaactatcatgccactgcactccagcctgggcaacagagcaaggccctgtctctcaaaaaaaaaaaaaaaaaaagtaacgtgacttaatacattcattttggagggtaagtctctcaaaataggcctttcactgggggaaaatggtaaaaatactccctggtaattcaagaattggagactcctgagatgctgctcatattagctgaacacttatcaatacttcactttcttccatatatactcaaggaacaagtgctatttaaagtgtttcactctgctgtgctaggtgcaagactataaagaggtgtgaggatcaacacttttatgaaaaccaatgtcattctgaatatagtttcagatgctagtgcaaaggaagctcttggtatacggaaaaagtattcaacaataaattaggcatggttgcttccattttctgcctcacatacctttttttcatggttaaagtgatataaagtctatgatattttagattggcagttgcaaactagtggtcctcagcgtgctttttatgacacctacaaggtttgaagactctgatttcatattaaaaatctgggtttcaggctgggtgtgatgttgcatgcctgtaatcccagcactttggaaggctgaggcaggagaatcgcttgaaccagggaggtggaggttgcagtgagccaagatcacgccactgcactcaagcttaggcaatagagcaagactccatctcaaaaaatgaataaataaataaaatctgggtttcaggccaggtgtggtggtgcactcctgcaatcccagcactttgggaggctgagatgggcagacagcttgagctcaggaattccagactagcctgggcaacgtggcaaaaccccatgtctacaaataatacaaaaaaattagctgggtgtagtggagtgtgcctgtaatcccagcaacgtgggaggctgaagtgagaggactgcttgagcctgggaggttgaggttacagtgagctgagatcaccctcctacactccaacctgggcaacagagccagaccttgtcttaaaaaaaaaaaaaaaaaaaaaaaaattctgggtttctggcatctcaaaaaaaaaaaaaaaaaaaggaaaggtcagggcacatggctgctacagtcctctattaagcaatgtgccacagcaggggtccctgacccctgggccatggacatgtactggtctgtggcctgttaggaactgggccacagagcaggaggtgaatggtgggtaacaattgaagcttcgtctgtatttctggctgctcctcattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagttccctatagactttgcttcctaccgtcttacgttctgccttataggcatctcagtttgcaacccttgtttttgtcagtatgctacgctggtgacattgaccaaattgaccacacattaatgataagcttagttggtgatgacctcaacggaataacgtgacataagtattgtgacaatacttcttgcatgtatctacaggtggaattgtaaacctggtggtccgagatggtctaattcgatcttcctatgtatctccttatattaatagtggtaacatttgtggtggtgattcagcgtttcaatgcctcttctcacggcaacaacaaacgttttccttctgaatcaacattaacctagatgttactgcagatcaaaattagtatctacattttcaaccacagaaatattgggcagtaaaaatttttcttaatattgattgcctacataggttgtgtaattagcatatgtttatagttctatgatttgtgcctggctgctacagagctggagggggtaaagcaacagtgttttctcagttgtgtgagcagcattacattataataaataggtaatattaaactgggctgatgagagttgcaaaagactactttaatgttcatatggaaccaaaaaagagcccgcattgccaagacaatcctaaacccaatgaacaaagctggaggcctcatgctacctgacttcaaactatactacaaggctacagtaaccaaaacagcatggtactggtaccaaaacagacatatagaccaatggaacagaacagagccctcagaaataataccacacatctacaaccatctgatctttgacaaacctgacaaaaactagaaatgtggaaaggattcccgatttaataaatagtgcttggaaaactggctagccctatgtagaaagctgaaactggatcccttccttacaccttatacaaaaattaattcaagatggattaaagacttaaatgttagacctaaagccgtaaaaaccctagaagaaaacctaggcaataccattcaggacatagggatgggcaaggacttcatgtctaaaacaccaaaagcaatggcaacagaagccaaaactgacaaatgggatctaattaaactaaagagcttctgcacagcaaaagaaactaggatcagtgtgaacaggcaacctagagaatgggagaaaatttttgccatctacttatctgacaaaaggctaatatccagaatctacaaagaacaccaacaaatttacaagaaaaaaacaaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaacacttttacactgttggtgggactgtaaactggttcaaccattgtggaagacagtgtggcgattcctcagggatccagaactagaaataccatttgacccagccatcccattactggatatatacccaaaggattataaatcatgctgccataaagacacatgcacacatatgtttatcgcggcactattcacgatagcaaagacttggaaccaacacaaatgtccatcaatgatagactggattaagaaaatgtggcacatatatactatgcagccataaaaaaggatgagttcatgtcctttgtagagacatggatgaagctggaaacgatcactctcagcaaactatcacaaggacaaaaaaccaaacaccgcatgttctcactcacagatgggaattgaacaatgagaacacttggacacaggaaggggaacatcacacactggggcctcttttgtggtgggggagggggaagggatagcagtaggagatacacctaatgtaaatgacgagttaatgggtgcagcacaccaacatggcacatgtgtacatatgtaacaaacctgcacattgtgcacatgcaccctataacttaaagtataatttaaaaaaataagtaaataaataaaaaaagaaacaattgctggctttgcaattctctttcctccaaaatcaccaaggcctcaatttactcattgctgaaaaaggacgactgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccacttcttagtcctttaatacctgtttttctccttctcttattcagaccgtgtgtcttctgtttagtttctcaattcatacaaaaccatatccaggccatcaccaataattctatatgacaaatgctccttctaacaaccccacagtatcagcccttaccccaaaatctttcttcagttgaatctctcccactgtaggttcccatgccgcccctaatcccgctcgaagcagccctgagaaacatcgcccattatctctccatatcacccccaaaaattttcgccaccccaacactttaccactattttgttttatttttcttattaacataagaagacaggaatgtcaggcctctgagtccaagctaagccattaagccatcatatcccagtgacctgcatgtatacatccagaaggcctgaagcaactgaagatccacagaagtgaaaacagcctcaactgaagacattccaccattgtgatttgtttctgccccaccctaactgatcaatgtactttgtaatctgccacactcttaagaaggttctttataatctcccccacccttaagaagtttctttgtaattctcctcacccttgagaatgtactttatgagatccacctcctgcccccaaaacattgctcttaactccaccgcctatcccaaaacctataagaaccaatgataatcacaccaccctttgctgactcctttttcagactcagcccacctgcacccaggtgaaataaacagccatgttgctcacacaaaacatgtttggtggtctcttcacacagacacgtgagacaggagttcgagaccagcctagccaatctggtgaaactctgtctctactaaaaatacaaaaattagccgggcatggtggcgggcacctgtaatcccagctactcgggaagcggaggcacaaaaattgcttgaacccaggaggcagagtttgcagtgagccaagatcacactgtctggcatctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactgttcaatatactttgtaatctcccccacccttaagaaggtactttgtaatctccccaacccttaagaaggtcctttgtaattctccccacccttcagaatgtactttgtgagatctacccctgcccacaaaacatggctcttcaccccctatcccaaaacctgtaagaactaatgataatccaccaccctttgctgactctcttttcggactcagcccgcctgcacccaggtgaaatgaacagccatgttgctcacacaaagcctgtttggtggtctcttcacacggacgtgcatgaaacacacgactgcacttcaggctgggcgacagagctagattccatctcaaaaaaaataaaaaggagtcacctcccctgagaggcctctggaccaacccatctgagcaggccactcttccttctctatcttaccatcttgtttctgtcccagtagttagggctacctccagtaatcctatttgtccctttactgtttagtgcgtctcacttgactagaagctccatgaaagcagagatcctacctacctccttcaccactagacccccagggcctggtatgtggtgatcgctcagggcccattttcttcctttcctcctcctccaagggtggggaaagagcatcagaaggtctaggtggccccaggcccaaacaatcctcctttaaaaggaaaccagattgttacaaaggtcagaggctgaaaagttatttccgccttttatccctctaaattcttcacttcctgaaaaaacaaacaaaaaaaagccactgagggcccttggactaaatccaggcctgagttgctgggcagaggtcagtcttgtccagacatgggaaaaaaataactcgagtcagacaggtgggtcaccagagaacgaatccagcctgcaaatggtgtgtgcaatcttcagctctgtccagacctgcctccctctggggatgcctttaaaggtgatgaatgacctggatgaatgggcttagaagagggaaaaacaaatatcacaggtcaaatcattatttgtcttcaagtttaacaccgtctactggactgaaagatgtccaaagaatagttgttcaactatgtaaattcctttttttttttttttttgagacagagtctcgctctgttgcccaggctggagtgcaatggtatgatcttggctcactgcaagcaacctctgctcctgggctcaaaccattctcctgcctcagcttcccaagtagctgggactacaggcatgtgccaccacgctcagctaattttagtattgttagtagagacagggtttcatcatgttgaccaggctggtctcgaactcctgacctcaggtgatccacctgcctcggcatcccagagtgctgggattacaggcatgagccactgtgcccagccaactacataaattcctaacaacgtatctccagaaagtataggcacaacagcacatgcagtcattcctgtaatcaggtgctccgggaggccaaggcaagaagatcccttgagcccaggagtttgagaccagcctggacaacatagcaagactgtgtctctataaaatatacaaaaattgggctgggtatggtggctcatgcctgtaggcccagcactttgggagaccaaggcaggaagatcgattgaactcaggagcttgggaccagcctggacaacataatgagacccagtctctactaaaactcaagaaaattagccagatgtggttgcatgtgcctgtagtcccagcactttgggaggccaaggtgggtggatcacctgaggtcaggaggttgagaccagcctggccaacatggcgaaaccccatctctactaaaaatacaaaaattagcccggtatggaggcatgtgcctgtaatcccagctacttgggaggctgaggcaggagaatggattgaacccaggaggcagaggttgcagtgagccaagatcgcaccactgcactccagcctgggcaacagaacaagactccatcaaaaaaaaaaaaaaaaagaaagaaagaaagaagaaaagaaaattagccaggtgtggttgcatgcacctgtagtcccagcactttgggaggccaaggcaggaggatcaatcaaggctaggagtttgagactgcagaaggaaaccctgtctctaaaaacaaggtccagctaaaatcagggtccagctccaccacaagcgcagctccagggtctgttgagttttgcctctaccattccaagtagtccctgctccagaccaagtcccaccatctggcagtcaggtcagtccaaccacagtcatatcagggcgcttcccggttctttcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaagcaaagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaggctaaggcaggagaatcgcttgaacctgggaggcagatgttgtggtgagccgagatcacgctaccgcactccagcctgggcaacagagtgagactccatcaaaaaatagtaataataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagaaacccaacaggaaaaggaagagactgctctatggccaggcacggtggctcacacctgtaatcccagcactttgggaggcccaggcgggcggatcacgaggtcaggagatcgagaccatcctggctaagacggtgaaaccctgtctctactaaaaatacaaaaaaattagccgggcgtggtggtggatgcctgtagtcccagctactcgggaggctgaggcaggagaatggcgtgaacccgggagacggagcttgcagtgagccgagattgcgccactgcacttcagcctgggtgacagtgagactccatctcaaagaagaaaaaaaaaagaaccaagaggagtccaggagaagagaacagcagatgcaaaggccctgaggcagaaacaatcttggtatgcgggaggaataggaaggcagccagtgcagctggagcaggataggttaagagaggatcaaggtgatgagggcctggaaagaggggctggggtcaaatcaccagatcctgttggttgcaatggaagagcctggagtttattctcagggcagtgagaagccactggaaagttgttttttgtttttctgtttttgagacagagtctagctctgtcacccaggcagactgcagtggtgcaatcttggctcactgtaacctctgcctcccaggttcaagcgattctcctgcctcaggctccccagtagctgggattacaggcacaggccaccacacccatctaatttttttttttttttttgagacagagtctctgtcacccaggctggagtgcagtggcacaatctcagctcactgcaacctccacctcccaggttcaagcaattctcctgcctcagcctcctgagtagctgggactacaggtgcatgccaccatacctggctaattttttgtgtttttagtagagacaggatttcatcacgttagccaggatggtctcgatttcctgacctcgtgatctgcccaccatggcctcccaaagtgctgggattaacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctacctcagcatcccaaagtgctggattacaggcatgagtcaccatgcctggtcacacttctcattctttaaaccagacctcatttgtccacctcccccatcccccgccccaccccacggactgtcctataatgcccatacaacaggtcactgtttagaaagtgccacaaagttacaaacacagtcccttctgagcctcccaccaatgttggtgggtgcaaggtcaaaaaaaaaatctcatctatctaaggggcataggagactttttagttagagggcccaattatagtcctcctgaaaagatgccaaaagtccccttaaacacttagcaaagattcaagaaagatgaatctcacattctttgtatgggaaatgaggaacttgacatcttcaatataatagattccactaaaataagatgacgatcaataggaaccaactaaaaaaatacttgactagctgttattgaaaggctgaaattcagctgacataagcagtattaatattgagctagaaaataattcgcattgaattcagcccaacttttgttttctgatttgggtctcttctaaattttttttttcttctggacattgggaacaatccaatttgaaggcctcaatgcccaaatctacactcgttttattctatatccttggtttctttttttttttttttgagatggagtctcactctgtcgcccaggctggagtgcagtggcgtgatcttggctcaatgcaagatccgcctcccgggttcatgccattctcctgctgcagcctcctgagtagttgggactacagatgcccgcccccacgcccggctaatttttttgtatttttagtagagacggggtttctccatgttatccaggatggtctcaatctcctgacctcgtgatccacccgcctcagcatctcaaagtgctgggattacaggcattagccaccgtgcctggcccacacctgggtgatttttaaaattcttctagtagagacagggtctcactatgttgggtcaccgtgtttgatgtcagttttccctgacagaatctacaatctccttgatcaccattatatcccaacacagagctcagtacctggtacaaagcacatttgatcaatacttgctgaataaagaaataaaaatgaagaggcattccagcctgggcaacagagtgagatggtctcaaaaaaaaaaaacaaaaaaaaaaaaaacaaaaaatgactggaaaggagatgagggtacttgtgaagccatattatatgacacgctctgtgctaggacttttatataccttgtctcatctcttcatctcatataatccttacaagtatctcaaaagtggggaaatccccatataactgaagaggaaggcagttcagaagttcactgatttgccctaaggttcctcaatttgtaaacatcaggccaatgatccaaccccaggtatgtttggcagtgaaggaccagttgagtcatagctgcaagtaacaaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttatgttcagaacacaaaaataagtcttatgtcttcattaaaaatgggtgaagaatttgaacaaacatttgcaaactaaaatacaaatgaaatacactcaacatcattaatcatcaagaaaataaaattatgagataatcctaataatcactacatatgcaccacagtgattaaaatttttttaagttaagccacgtgacccaataaggtgcattcactcaagagaaacgcaaatatatgtccactcaaagacttgcacatgaatgttgagagcaggtttatactgaatagtgcaatgtgaaaaaaccccaaaatctagcaaagaatgaagggagaaataaactgtggtatatacatacaatagaacactactcaataataaaaaggattgtattcctgatacatgcaatatgggtgaaccttaaaaatatcatgctgagcaagagaagccaaacacaagagaacatgttgttatgatttcacgtacatgaaactttagtaaagacaagtctaatccatagtgacagaaagcaaatgagtaactgctgacagggccaaatgaggagatgatcccaagggaaccttctggggtaagacggtgttctgtatctcaatcgtattggtggtcacacaagtgaagacatgttagaactcatcaaaccatacacttagaatgtgtaatataaacctcaataaagcaaaatttaaaaaaaaaaacacctttaattttctcttacaaaaaaaaaaaggaaaaccacttaactttaatttttctccaacaactgattctggtacatagtataccttactgcctgcatccatggcctcacatcatgctgtttacatgaacgtaaagcttcaccgaagagtggaataagacagtcctgccagagaaaaaccaaaattactcaacgtaaaacaggctgttgatacgtttgcagatatatagcaagtcttaagtcaaagactgcaatatagtttggctacttcagattgattgcagtagttttatctattacactatacccttacatcatttatcttctactcacaagaggcaagcacacagtaagagaaagccttttgttttgaagggaaatcttcttcagaatattaagtctaatttatcaatatacttaataaagcacattacaaaaaaaaagtcacagcacatttactataaagcagactgcagaaaaacattacaactaatgctttataatgaagttctcgaagatcatcattcattcagaagcccccatctctggttgaactttaccccatttaggatgaagaggagagatctttgtttgcagcaaatctaaaatttacgtaatctgcctaaaggaactgtctttacatacaccacctcccactccaaaaatagaagaaaaaactgagcaatttgccatccttgcgattatctcaggttcttccatctgccccatgtacttcccaaatgaaagactgcctgaaaacagcatgttagatttctggatttaccagcttgcccaactacaaatcctatttcaaaaaactcaaaaaataaggtctttgttctacagtaatgaccattaatagtcataagaatgtgcttgtaaaaatatacagacctctgtttaaagtctgttagaaactgtgttctccaaagcaggtgagcaatacagctgcaaggtacttagaactggcaaagactgtgaaactgttaaagtagaaagtctcagaggtccaacagcgatgcgggatgtttgcttcaagtactttaccacatttctgaaacaaaatatttactgtcaattaataaaaattacaattcataaccactcaaagaataaagcaattgataagatgctatcaaactgacatccaaagttagggggcagtaagaggagcagcctgctctataataaaatgatattagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttatctccgtaagagtaacttactcagttatagactgccacttctgatcttgttctatcgggtttaaagcagttgccaaacaaacagaacttcttaacaattgaacttcaatggatttctgaggttcccttggatctggacttaacatgttacgaagcaggtttttcatgtctacagaagttaaatgaaatgtcattaattaatgtgcttttattataaattttgatttatgtttggcattattaaaaactaatcaccaatgaacagctcctttaatatttaaggcagttaaacactataagcattactgagagctatataaaaatcatacttcatacaaaattactgtacctcagacccctaaaaagcagttgccttcaaaggctcaaaaatcagtaagtcgaggccaggcgtggtggctcacgcctgtaatcccagcactttgggaggccaaggtgggtggatcacgaagtcaggagttcaagaccagcctggccaagatgatgaaaccccgtctctactaaaaatacaaaaaattagctgggcacagtggcagacacctgtaatcccagctactcaggaggctgaggcaggagaattgcttgaactcagaggacggaggttgcagtgagccaaaatcccgccactgcactccagcctgggcaacagagtgagactctgtctcaacaaaaaagaaaatcagtaagtcaatctactatttaagggaacaaatctagacctgcattagcaaatcttgctcaatccagaatactcattaaactttttaataacattttataaagtgttccatttgtgataaagaacttaatgagccacatcaagatgaaaatcaagaaaaatatttagctgaaacactactttgtcctttatcaaacaaaatggctagataaatctcaaagcattaaggtggtcatttttttatttgacttaattttaagtgcttttcatttcccaaatcaaacttaaatagggcagccctaaatttgttgcttcacatgggattctgccccccaaaaatgtaaaatgacttccagattttccagtaaaatatactaagccaaacattttgagcaacttgtccactaaaataactttaaaactattttctcaaatacctacctattttttcttttgatcctccagcaagtagattgatattttctcctggtaacaattctaattgctcagtacattcaacaaattttccagactcgaagctgcttaatgatctgtaattaaaatattggttagcttgtattcctacgcagcctgtggaaccattaaaaaaaaacaaacaaacaaaaacagaacaaatcctaggaagacagcaaagtacacagcatttttctgacaaaattccttccacgaggatgtcattattttggtttttatgttgaagatgtgactaccacttaattagtactcaaattggagtggcaaaccagaaagtcacagctacagactttcagtagagctgactcgcccctgtgtctccttcctgttttcatgtgttgcagcctgttctcttcagagcctaacacactgacagtagacctctgcaggacaactttgacacccagttctctccaagctgccagtgagctccttgtgcagcctcactcctcacctacagcatgagcccttgcagctctcccagcatcataatcttgtatctcagtcctggcttctttcactgctggcatccctccatctctccctttttcacctacttttcttttttcaaagaattcttctctttcatctgcttttatgaaaaataatgacacctctgaaattctttcctgtagtcctgcagcatcaatgccaggaagacaggcctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacattcgtcatttctgccattaaaaggtcctaagtcctctccagtgacaggttcctcaagtccccactatgctctataatgccctatgctttcagctaatgactcagtcctcagaaaaacaaacaaataaaaaaacacaggctttaatttcctctacccctacccccaatccaccatacactgccaaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatctccctccagcaatagcttcctatcctcgacttcaagaaaaactcactgaccaaataacttacctcaagcttttcattttcaaatgtctctaccactcaatagtattcaatctagcttcttctgtctctctacaaaactctttttccttataatccctagagcatctgacaaggctgactactcccatctggatgtcctatatctaggacacttcccttctcaatgtccctgtatttttttgaatggcttcctcttctatactttcacaaaaatgctaaactaggattctgacccaggccttccttcctcttcactcactattctccagaggcttctctctggtttggttgcttacaaaggctctagagtatagagactgaaaaggaaacagggccttttctgtgtactaatgatgtgcaaatctctcaagcttagactttctccttagttcaaaatccaattttttttttttaattgatcattcttgggtgtttctcgcagagggggatttggcagggtcataggacaatagtggagggaaggtcagcagataaacaagtgaacaaaggtctctggttttcctaggcagagtgtgtgtgtccctgggtacttgagattagggaatggtgatgactcttaacgagcatgctgccttcaagcatctgtttaacaaagcacatcttgcaccgcccttaatccatttaaccctgagtggacacagcacatgtttcagagagcacagggttggggataaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcctggacggggcggctggccgggcggggggctgacccccctacctccctcccagacagggcggctggccaggcagaggggctcctcacctcccagacggggcggcggggcagaggcgctcccatctcagacgatgggcggccgggcagagacgctcctcacttcctagatgggatggcggccgggcagagacactcctcactttccagactgggcagccaggcagaggggctcctcacatcccagacgatgggcggccaggcagagacgctcctcacttcccagacggggtagcggccgggcagaggctgcaatctcggcactttggggggccaagacaggcggctgggaagtggaggttgtagccgagatcacgccactgcactccagcctgggcaccattgagcactgagttaacaagactccgtctgcaatcccggcacctcgggaggccgaggctggcggatcactcacggttaggagctggagaccagcccggccaacacagcgaaaccccgtctccaccaaaaaagtacgaaaacccatcaggtgtggcggcgcacgcctgcaatcgcaggcactcggcaggctgaggcaggagaatcaggcagggaggttgcagtgagccgagatggcagcagcacagtccagcttcggcttggcatgagagggagaccgtggaaagagagggagagggagaccgtggaaaccgtggaaagagagggagagggagaccgtggaaagagagggagagggagaggagggagagggagagggagaggagggagagggagagggagagggagaggagggagagggagagggagagccaaaatccaattcttaacagcttacccaacaatctcatctgcacatttcattagaaatcttaaaacatagcttgttctctgtgtgctcctactccagttaatagcattgtttctcttccctctaccattgcccccacaaattaatggtctccatgcttccatacttgcccctcacctccagtctcttcaccatagcagaatgaaccaccaagtcagatcacaacacatctctgttcaaatcccacctgaaattttcagtcttactagaataacagccaaagttcttttctcagttcccagctacttctctgcccttatatcctactgtttaaggtgctcctaaacacacaggcctcccagctatttccagaacactccaagcccatcattctcacatcaggtctaggcccaaagggcatcctgatgggcatgccttgaccttgtgtcttccctccaaagaaggtcagctttacctaactgctttccttatggcacagaaaaggtgagtgaggtccaattaatccttctatcaataatctttatctaatctttgctttaaaaggttggaatttgtgtctgttttatgtgctgcctgggtcatagtatatgctcagtgaagcaattacacattaacccatttagcagtagaaagcaagggtatcagacaaagtctaatgacctttatcttcccagccaagtgtctgcaacagagtgagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaatcagtacaaatttttccttatattcactctggcataatcttcaaactctattaaggttttagaatgacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcatagttattggaaatttgttttataactggaaacagaaagccttactttatatagttgaattcagctttcaggttgagggaagtgctactggtactctttttcaagtcatggatagcattctgccattcctgcacagcagcgcaatcggcaattgagatgtagcactcacacatgctttatttcctaaataatttataacctcaggggaagagtcagtcggtttggacagcacagtttttctggattcacctgaaagtattttataaaataagaagagattcagatcaattagaaatatttcaaagagcacagaaacctaaaaacatgataagatcatcagtacaaaatatatcactataacttttgctttatttaaaaatactgaacgctcaccattcagacaatgtttcgggctggcactgttacacccagcattggctaaggtgagcaccaatttgtcaaagctggagatgcagcaatcaacacctgtcatggcacacaggtgctcctggtactccacagaggccttttcaaacctgaaaagcaaattgaagcagtcttatttctttatttatctacttacttactttcttttttgagatgaagttttgctcttcttgcccaggctggaatgcaatggcactgtctcagctcaatgcaacctctgcctcctgggtacaagtgattctcctgcctcagcctcctgagtagctgggattacaggcactcgccaccatgcccggctaattttcttgtatttttagtagagacggggtttcaccatgttggccaggctggtcttgaactcctgacctcaggtgatccgcctgcctcggcctcccgaagtgctgggattacaggcatgagccaccgcgcctggcctttacttacttacttacttattttttgagacagtcttactgtcacccaggctggagggcagtggcatgatcatggctcgctgcagccttgccctaccaggctcatgcaatcctccaacctcagcctcccaagtagctgggactataggcacccaccaacacacctggctaaaacaaggttttgctctgttggccagggtggtctcaaactcctggactcaagcgatccgctcacctcagtctccccaagtactgggatttcaggcatgagccaccgcgcccagccccaaaggaggctgttattttaaacacacatatctcatttcccccccccacaaaaaatggtgcaagaataaactgagctaaaacagtgagttgactatggtggggggaggtttgatgtcttcctcacaactgtgaaactaaatttaaaagtggttaaatgtttttaaaaaaatgtaagagtataaaagaactagtggaaaatattgataagtaactgatgtcagtgtgtggaaaggctttgtagaaggataaaatgcaagaaaagatgcacaagtaacagatctagatgcataatgctgaaatacaacactaaacattaaaaacaaattataaatcaagaaattggatagcatcaacaatcttagtatttaataaaatttcacagattaacacaggaaaaattgagaggccatgaagacatgatccatgttttaaaaaatcacaaaaggtcactatatggggcaacttctactattagtcattaataaatatagaaatgtaaagtacaataactattttcgctgatggtggtggcagcattcttgtttctcagtgactctcagtatccacaaagatgaagggaagggggtactctattattaagggtatacattgcagccatcttttctgtagagtaacttaccaatagaatatattataagacttatggtttggcagcctttcttctagtaaatcagtttatgagaatggattccaagaaagtaatcagaaatataagcaaagatattaagtgctatggtacatttagtaaaaaaaaaaatcagaaacaaccttaatgcccaacagtaagaaatattaaattatggtacactcataaatacaaacctttattaaaaataacactgtagaatatttaacatggcaatttttttttttttgagacagagttttgcttttgttgcccaggctagagggcagtggcacaacccgggctcacagcaacctccgcctcccaggttcaactgattctcctgcctcagcctcccaagtagctgggattacaggcatgtgccaccacaccccactaatatgttttgtatttttagtagagacggggtttcaccatgttaggctagtctcaaactcctgacctcaggtgatccacctgcctcggcctcccaaagtgctgggaatacagatgtaagccaccgaacccagcctacctaacacggaaaattttttttttttaaatattgagtgggaaaaacagatcataaaaccatgtgcctatgtacactgatgttttggtgaagaatggagaaaacgacatgaaagaaaaaagaattacaaagcatatggatatggaaatatgggactacaaaaggacacacaacagaagttactacaaagatatggaagtatgagcagttcttttatcttcctaaatttgcaagatttcattaaactaacataaatggacacagaatattatggtacaagctcctctacctggaggaagcaatgagtctgaatgtagagttcacaggactaatgagcaaatactctgacaataaagggtaatttgtatcagactctgagggggaaggagctcaactagggatcaagttcaaaagcgtttataaaacaactgacaggtcttgttttacagtgtgatttgccactaattcttaaataagaaaggcactccagtattgcggctaactaaagaacaaactgaagatgcctcctggtgaagtgatttatagcaagcttcaatgctgaaagcaaacaaagctgttttaagatttggctacaatgtcagtgagtaatacaaagaatttaaacataaagtaattctgtcacccatttccttccctccaacctacctcccttcagcctgttgagccactgagttaatccacagaagattttttccaacaatagatgatgaccagacagcaattccctgtatagcttcaggacaatgaagttcacatagtgcttctaccaccatcataatggttatttccaattcattcccctgaaaacgcattcagaaaagttagtcacccaataccattaaaacataaatccctataaaatttacaactgatcacagtctgtgcctgcttaaagccaaatgtatttaacaattattttcacaattttcacattatttagctcagaattctttaaaattttacatataaaatagccacaaagggtgactaacagaaccttagcagcacatggatgtttgtacccccaccccaaagttacccaaaaacatttaacctgtgacctctgtaggaataacacatggagtaaaaagaaagcaaaaattaaatataaataaacaggaattaaggaatgattaacttcatgtgtttgaatactgcttgacattacctgaattgctaaacattttgttatttttggattccagttatttattgtgagcccacttgcaagccaggaattactcaagcatttgtcatacgttataaaaacaatttctcctggccaggtgcagtggctcatgcctgtaatcccagcactttggaaggccgaggtgggcggatcacttgtggccaggagttcgagaccagcctggccaacatggtgaaaccctgtctctactaaaaatacaaaacttagccgggtatggtggtgggtgcctgtaatcccagggactgaggcaagaagaggcttgaacccgagaggcggagcttacagtgagccgagatcgcacaactgcactccagcctgggcgacagagtgaaactgtgtctcaaaaaaataaataaataaataaataatttcccccataaacaaattttcagaattacctttaaagttctaaactttgcacgtaagaaatatagttttaacgtgttctaacatgaatattgttttaacatgaacaaaaacatgaacattattttaacttctaacactgttttaacatgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggcaactggtatagaaaaaagctctaatgacctttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcccggaaaccaaccttgggaggtgaagttaatgcattagcacatccctcatatacattatacattaatttctccagattttccagatactgcagaagaagaacaagtctaagttggttgttaccatggccttcatcattgtctgcagttgtccactgactaacatcctgatcagggtttaatgtgtgagctgcgagacttcgaatgatacctgaaagcaaagacaacattctgaatttttaaaaatcttaaagttcctagaataagtgtgagttttttatgacaaattcacatttatcaagtatcctctgtctacccatcatttaaaaataaaaaatcccaacatgaaagatctttcattttaggggaaaaaatatatatatattttccacacaactcccataagttttggaaaaaaaccaaacatatttccaatgcaattattcaatgaaagcttattctaacaaacatacctgaaaattattgactttttttcaaaaaaaatcatatactctcaaatctttaacaaagatttaaaaatccattatttcttaataaggctttgaaagtattcacatcacaaagcttgagcgagttaccttcaattgtctggaaggtgtcttgagctctgcccagtggggttctcagcttagaaagaacagtgaattgtgcagcttcccatatggcccactgccaaaagatagcatctgtcttcaggagattgcgtggaattgttgactggtcacacttatccagtctctggcagctatagaacagtctttccaaccaattgtccttcctgggaaaagtagtttcatatttaaaagacaatgacaacttcattttaataatgaaaaaaaaaatgcaaggggaatgggaatacggaactgtaattttccctactccaaaaaaaggcaaaacctatgaaattgagaagcattatgtccccccctctcattttgaggtcttttatagttaacaggatgaggtacagtgtggaaggatgattagggtaaatggctcatgccagtcaggaatgaaactcattcaatgcaactaagcatctctagaatatctccacccccaccccactccccaaagtgttaatgacatcacatcagttaattgttaaccacatttcattactcaatttcaaagcccatttttgtttctacagatgctatcttcaaagcaattttcctattgatgaaaactgaaataacccatatgagaagaatgttacttgatactctgccacccccaaacatattttctcttcaaaactgcatgtaaagtcaagggaatcttaaaattatctttcccagataaaatagtcaaagaaatgccttaccctgttctatgagagttcccatacaaaataaaactaataacatcagagaaatcttgggggtggaatgtattacttggtgctttactcatgtgacttcttaatgctaaagaaatttcttgaatttctgtgtgattgttattgctgtagacagaaaataaagttgttgttatgcaaaatattttagcttaaaaggttagcacctactgtaagtggattatttacttattaactcactggaggtaaaaatatagtaaaatagagactttaaaatggatacagagatgtgattacaactttagatcctttttttattcacctcagatgggtaatgtgccgacatcataagaggatttgagggaggcatatcaaacatgtgaacataaaaacccaatcattatgcttatgtattacaaaaggatcaagtttaggctcttaaaagctcccaaatcaacttgatcaaaaacaatgaaagattactgtttagtttttcaaatatctgagctactaagaaacatattttggcactacatgagttattctatactaattattgtgagcctataaagctcattaaaaatttttaattttcttgcagaactgcaaaatttgattatttgacatcacttcaatcactggcaagcagggccataaaagatgtgtcattaatgctctaataggtgatctgtcttctcctaaagtagacaaccagtagaggctgtaaatataacagaatgtctttgctccaaaacaactgttataccttaggacaacatctaaaggaattgatttcaacagttttccaaatgcttgtcgaatacgagttccacggtgcactagttgaacacggcaaacatcaacacatctatgaaagaacgaaatagacaaagcaggtgtgttaacatttccaggttattagggttaatgtcaaaagacatgatcttaatttcatacctctgtaaaagatcatctggcaaggaagaggacagagcgtgtagactgctgcatgcctgcagacagatattcacatcttcaacgagagctattaaacattaaaagacagttactttcagctggccaaaagaaattatatcccagtttgtcataattatctgaatccattcattcattcaacaaagagtgagtgcctactacagactaggcactgttcttgtccagaatccttattgactgtcacatttggaaaaatgacacattcaacaaaacccatgtaatgtaactgatgggtcatcacacaaacctttttctgagagaaaatgtaaaagtatatgcaaaatataaacattcacataagcttaaaaatgtgacaatcacttcaaaacatttttctaatactaagaatgaaaaaaatcaagactgtgtatctgtcattaaaatgaggattacacatcttcaggtcaggaaaagagctcgattgatgaccatctcccattaccaaagacccttttaaggactgataaacaaaatagaaaaaaaaaaaacagagtcttactgttggctaaaaggcctttgcaaaatttatggaaagacggaagacagaataaaggtgcatatgtttcggacttcttcattaaaacagctacttccaaagcccaagtcattaacagtttcctgaaacacaaaatatacagttgactgtacacaaaaaaaacaacaacaaaaacaaaaaaacgttaaaagcctagtcttcttacattggttttctcttggtttttcaaacatctcaaacaataaaaaataaaaataaaaaatgaaactatagaaattactgtcaaaattgttgtgtgccttttaagaaaacctcccaacgcagcataatagcaaagaggccgggcatggtggcttacctgaggtcaggagttcaagaccagcctggccaacaacatggtgaaacaccatctctactaaaaatacaaaaattagctgggtgtggtggcggtcacctgtaatcacggctacttgggaggctgaggcaggagaattgcttgaacctgggaggcagaggttgcagtgagcaaaactccgtctcaaaaaaaaaaaaagcatagaatattaaaaatctatatatattcttctatgaaacactgggggtgagggattgaggtttttcatgtatttcttttcagaaagaataagaaagcctagattaaataataaaaccaaattataaggtgtttgacaataaagaagctgctctacctcacctctataatccacatttttttaaatgttttgtaatccacatttcttattctcaaattataaaggcaaattaacaaagttaggaatagttaatactatataatatctgttacctcgtgtcctggttaaggttatctttcttaagtaatattcccagaagatttaacataattgagaaatgtttctttgtggccgtagttacagtgctaatcacagctccatcaaacaaaggaggagaggaagaactgaggctactagagataaagtgatcatgcctgaaagacaaagcatagattatcttttcatctttaatcaaagaaagcaagcaagcccaaagttaaatcaacatacatctttaaaatctatccattaaaaaaataaaatgttttgtggggttcttttgttaagaaaaatttgtgaatacagtacctggtacaatgagaatacaaagtgtagagcacagcatactgaatggtagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggacatttttaaattaaaattacagactggaagggatctagtacactacacctgggacaaatactcttttgtgaagtcagtaaagcctttgcgtgcaatatagcatctctatgcaatgcagcaactcctcgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccgcatctctactaaaattacaaaaattagctgggcatggtggcgcacacttgtaatcccagctactcaggaggctgaggcaggagaattgcttgaacttgggaggcagaggttgcagtgacccgatatcataccaatgcactccagcctagatgacaaagttaagactctctctctcaaaacaaaacaaaacaccagccacatacaaaacacaggaatgagagtacctgtgttccaagaaaactttcttgagtcggagtctctcgctctgttgcccaggctggagtgcaatggggtgatctcagctcactgcaacctctacctctggggttcaagcaattctccctgcctcagtctcccaagtagctgggattacaggtgcccatcaccacgccctgctaacttttgtatttttttagtagagatagggtttcaccatgtgggccaggctggtcttgaactcctgagctcgggtgatctgcctgtctcagtctcctgagggattacaggcgtgaaccactgcgcccagcccgagaactttctttacaaaaacaggcactagtgttgtgatggttgtacacttctgtgaatatactaaaaatcagtgaattatacacttaaaataacaaacaaaaaacaggtgctgggctgtatttggcccacggaccatagtttgctgatctctgatctaaacagagccctttgtatgtgccttttgtggaagtagactgtatttcctcaattttccatatactgcaaatggcaaggtgccctgttcaataaggaaacaaaggcacaccctgccactctacaccttttccatccatctttttcctttacactgccaagacactccattccacctgactgccccatccccacccactttctccttatttctagagtacaggacataaacatctttgaatctgtaaataatgtgaataattttcctcaaaaatcaagctttcatgtttgaagaagagtttattgtgacttcaaacataagctgtaactggtaataagcgaagcagctatggaattatacaaggcaatccaatcaaacaacacggagcacattgaagcgcaaacatcaaattttaccttcttcctcctaaaaactttattccctaattacatccattactttctttctttgtttctttctttttttttttttttcttttgagacagagtctggttctgtagcccaggctggagtgcggtggtgtgatctcagctcactgcaacctccacttcctgggttcaagcaattctcctacctcagcctccaaagtagctaggattacagctgtgcaccaccacccctggctaatttttctatttttagtagaggtgagctttcaccatgttggccaggttggtctcaaactcctgaccacaagtgatcagcccgacttggccttccagagtgctgggtttacaggtgtcagcaaccatgcccagcctacacctattattttctattaaaaataatgtttttcaactctgtgtggtccaataggaagaagaaatacacaaaccataaacaataaatacaaatcaagagcagggccacgtcaaattacttaaaaaaaaaacacacacaggctgggcgcggtggctcatgcctgtaattccagcactttgggaggctgaagcgggtggatcacctgaggtcaggagtttgagaccagcctggccaacatggtgaaatcaagtctctactaaaaatacaaaaattagcccgtcatagtggcaggtgtctgtatctcagctactcgggaggctgaggcaggagaattgctggaacccgggaggcagaggtggcagtgagccgagattgcaccactgcactccagcccaggtgacaacagcatgactctgtctccaaaaaaaaaaaaaaaaattcccccccccccaaaagaaagactaaaggttgagtatcccttattcaaaatgcttgggaccagaagtctttcagactttgtatatgtttggatttgagaatacctgcatatatataaaatgagatatgtgggggatgggacccaagtctaaacacgaaattcacttatgtttcatagacaccttctattcatagcctgaagatcattttatgcaatattttaaataattttgtgcatacaacagtttggactcatcacatgaggtcgggtttggggttttccacttggggcatcatactggtgctcaaaaagtttcaaattttggagcattttagatttaggattttcagattagggatgctcaccagtaagtgttatgaaaatattccaaaatccggctgggcatggtggtgctcacctgtaatcccagcatttttggaggccaaggcaggtggatcacctgaggtcaggagttcacaaccagcctggctaacatggtgaaaacccatctctattaaatacaaaaaaattagccaggcgtggtggcgcatgcctgtaatccgagctacttgggaggctgaaacaggagaatcgcttgtacctgggaggcggaggttgcagcgagccaagatcgcaccattgcacttcagcctgggcaacaagagtaaaacactatctccaaaaaaaaaaaagtattccaaaatccaaaatcaaaaacacttccagtcccaagtatttcagataaggaatattcaacctgtatgaatgtttctagggaaaaagagacagccaaaatataagaccatgtataagaactaacttcagtagacagaaagaaaaaagtaccaggggaagaagaaagagaccgcattttaaaacaactatacaaatttgagctgtaagaaacactgacattttctataagcatgctagagcaaacaggagaaattcataagacattttctagaaaataaaactaatataaaaaaacttatcaagatttgtcaaggaaaaagaagaaaagttaaatataatggcaagaaaacattcctaccaattttatttatccaggcatgtcttaaatatggctgtttgttacatggagaaaccttaaatgcatactggtaagtgaaagaagccaattgaaaaggctacatactatatgactccaactacatggcattctggaaaaagcaaaatgatggagacagtaaaaagatcaggggttgccatgggcttaagatggagggagggaggagtggggagagggaatgaggaaggagtgggtagaacataaaagatttttagggaagtgaaactatcctgtatgatactggtaataggggatacatgtcattacacatgttaaagtccatagaatacataacacaaagtaaactatgaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacttattttacagttatcatgggcattttttcacattagcaaagagaggtgtaattctggcagaaatgctcagcagaatgtcatctagaatttgctttaaaataagccagttagagatgaaaggatagcaaagaggcctagatgaaaccagatgggccgtttgcttctaattatagaagctgagtgttaaatatgtacaaatttattatactatgctccctatttttatgtgcttcagaatgtccataataaaagtggggggaggatatttatggttaagaaattaaaggaggccagccgggcacggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcgaaagagtgagactccgtctcaaaaaaaaaaaaaaaaaaaaagaaattaaaggagaccaggcatgactgctcacacctgtaatcccagcactttgggagggcaaggcaggaggattacttgagaccaagaattcaagtccagcctagacaatgcagtgagaccccttctctccaaaaaatacaaaggttagccaggcatggtggcatgcatctgtagtcccagatagtcgggaggctgagtgggaggatcacttgagcccaggagtttgaggctgcagtgagctctgattgtaccgctgcactccagccaggggaatatagcaagatcctgtgaccaaaaaaaaaaaaaaaagaaaagaaagaaaagaaaagcaaaaaacaaagaatctggtgcgtagagcaatgtttcctcagaaaaaacgagtaaagctacactgagactagctatcaaccactaaaaatagaggcctggcagagtggctcatgcctataatcccagtactttgggaggccaaggcaggtggatttcttgagcccaagaattcaagaccagcctgggcaacatggcaaaactccatctctacaaaataatataaaaaattagccaggtgtggtggtgcacgcctgtagtcctagctacctggggggctgaggtgggaggatcacctgaacccaagaggtcaaggctacagtgagccaaaatcatgccactgcacttcatcttgtgcaacagagtgagaccctgtctcaaaaaaaaattgcattaaaaataaaagtaaatagacactaaaatgaaggcatagattataagactgatgaatgtactctaaaaaaataatataataaagcaaagcccttatgttttttcttttttggagacagggccttttttgtcaccttggctgagtgcagtggcacaatcagagctcacttcaacctcaagttcctgggcttaatcgatcctcctccctcagcctcccgagtagctaggactgcaggtgcacaccactacaccaagctaatttttgactttttgtacagatggggtctcactacattgcccaagctgtgccagaattcctggatgccagcaatccttctgctttggcctcccaaagtgctgggattacaagcataagccaccatacccagacaaagcccttaatttcttacatatcgatttaagggcctgaataaaccaacacattaaaaaggaaaagaataattcacataccagcatgagtaaattcaagactgagatgatataatcggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaatctgtaaatggggaaaacaagcagctttttaaaaaaattcacgtgcttccacaaagcaaggaaatactttttatttaatgcaatttcaactgaaaattaactgcttgccttgccagcagtctcttaatattctagttctcagtagctgaataatgatacctttactacaatatgtaaacatgatcttggctaaaaaatcctaaagtgctactatgacaggaaatggaatctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaactttctatctactgatggtctcttttgaaagataagcactctcatgcttaccacatagtatcttcaaaaatcatatgatttccaatacacacacaaacaaaatcccccacttaactataatggccaataattgtgtactaaatttctaataaaataggggagaaaacagagcaaatgttaaaaaatacttctataatatttaacaaccaatacatacaggattttatttagtctacccataattttcattaaaagtatccttggaggttgggcatagtgactcacatctatcatcctagcactttgagaggattagctggaaggttctcttgagtccaggagtttaagaccagccatgtcaacataacaacacctcatctctaccaaatttgtttttaaattggttgggcgtggtggctcacaccagtagtcccaccaactacttgagaggctgaggtgggaggatcacttaagcctgggaagtcaaggctgcagtgagccaagatcgtgccactgcactccagcctgggcaacagagaccagtggctcatgtctataatcccaacactttgggaggctgaggtgggaagactgcttgaggccaaaagttcaagaccagcctgggaaacactgagacgccatctctacaaaaataaaaaattagcaggagctatggtgggaggatcacttgagcccaagagatagaggctgcactgagtcgtgatggcaccaccccactttaaaaagaaaaaaaaaagagctgggtatggtgacacccgcttgtagggctgagtgaggtgggaagttcacctgggcccaagagttcaagactacagtgagctatgattgcactactacactccagcctgggtgagagagtgaggctccagctccaaaaataaataaaaataaaataaaaaaataaaaaccccaccattctaccattctcaaaggcctaaaagatcctcataaatcaatatacacctatcctataaattatgtcccttttattttatgtctgaattaacagctttttatttcaactctgtacagtcttcaaacaaccaccttttagacattaaaaatgaagcaaagatattaaaccattttgaaaccatattggtttaaaataccgatatgctggtttcatttatctttaagttctgacatttctgctcaagtacacaacttactatataatcaatatcctattttatttagcaacatgttcagcaaaagtatatgctcctaaaagcaagttttatcctaacggtaaaattttcatcagttagattaaattttttatgactgtatcacacatgcttctttctccttattcacagccgagtacaatgcctggggttcatttcttgtgtcttttccactgaaccctcattggatgtgctatatacagtgcagctaatgtttgaggctgctgaagtgtggcaatctatctacctcatttttaatttgtttatgttctttgatatcaggctatcaaagaatataaagatatacaagttttcatatgagttccatcttatgctcagagaagattactttctgaggcttctcctatagtgtgctattcgtaatatgttgaaaaactaaaaggaaacccaataatttaaaagtaaaattataagaaatattatttaaaaatgaaagaataagatttaaaaattcagagtggccttttgtcatgggagggtagggaagttggatgaaaggaggatgagatataaaaggattccctgcttttctggttatttaagaaagcagtcagacaatatatacatatacacatacatacatacatgctaaacaaatgaaggattaataacagttcacctggtaaagagaagcatttacaatgtaaaacaattttatttttgaatgacacttcaaatgcccaaaagcacttacatctgttacgtatgcctcagtaatcggaggacccgaattgggctgaagcgttccccaatgctcctcaccacagtactaaatacccggagaagcgcagtcagctttggtaatgacactgatggaggagggacgtcttcatccactgattccccagaggccacatggctgaggtcctagatgtgaattcacagcattcttaataagtagtacattgtttaaaaaaaaaaaaactctaaaatatttcaatcaattcattttagaatagatttttaggcttttagaaagagaactgtggcccatgagaatattcatgactctgaatataaaaatgggttttacctaattatttcaaaaagccaacattaaacccaatagacaacaaattaaggaaataatctcttaaatcaactcagaaagctgttggggaaaaataaattctagcacatatgctctagttatatgtaggtataaatgaagacggaagcttttgccactcctgaattagtttttggctaaaaatctcattctaggtattctttgagccactcagctcaacagtaagtcctccaaaccaagagcatgcacatgaagagcaaagggagattacaagacctggtctacagatgtgtaactgaagaagtacgatatatgaaaaggacaagattcgcaaaaactaggatactagaaccaatctatacatttacctaaaattaagcaccaaaataacagaagagaatgagatcttaaggataacaaggggaagcatctctacaaactagaatgtgtggcttatgagaggtagatcagctttaaacgtgggctgtgaaaaaagacattctaggtgtgggggcaaagaaaaaacaacacagaagcaaaacatttccttgcttttctaggaaagagtaaacacatcagtacagctaaaggtactgaattcctgttgactacaagcagcaaagatgataaaaacaagatgaggccaaaatctttatgggagccttgattggttgatctgaataggggagaaacacaaagagattcagataagagatagcacagagttaagccatgacagtggggccagaaaagccaagtaccagtaacagaggcttcagcagtgctcttaaagctcctatgctatattcgtacagccacaaaagctggctgaagccaaggcctgtcctccaaagtacgattcagatctcccgtacatatgtaagaggaaaatctttaggagcttttggtgttttgtgtttttttataacacaacatcaatttgctttaagactctgaagactgggaacaaaaaataaaaataaataacaaaaaatgtctttagaaaaataccagctaccaagagtatgtaaagctttgcgaaatacgaagcttgcaacgtttcttttagtctctccagtaattctcctggtaacttaaatacatctgaaataaatgtttaaaatactgactgagcacgggggctcatgcctataatcccagcatttgggaggccgacgcgggtggatcaccagtggtcaggagtttgagaccagcctggccaacatggtgaaaccccgtctctactaaaaatacaaaaattagctgggcatagtggcgggcacctgtaattccagctactcaggaggctgaggcaggagaatcatttgaacccaggaggtggaggttgcagtgagctgagatcgtgccattgcactccagcctgagtgacagagtgagactccgtctcaaaaaaaaatttttttttcaaaatattgcaatgggcttgtaatttctgcttaaatgtcaggaggtctgagccattttaaaataaatctagcacaatttaagattttttcttaaccaaaattttaagaaacagctttctatatactcacctcagcatatgcttccatgtcttctagaaaatgaccaagaagagtcgtagaaaatgcaagatcagctacccaaaatggctccaaactctgcaaccacccttggaatcgtataagaaattgtgaaagggtggggggagaaaaaacaccaaaaaatccaaattaaaaaaatataagaggcttgttttaaaaagtatccggttttcaagcagcataccctaaaacatgtcctatatcataaaattaagactgctaaacatgctgatcacgattaaccaatacctctttaattaatacctctttaatttctgcaaaaattaacatgtaaatgttatttccttactttttcagtaaatttcctatctatattgtcactacacatgacttaacactaaaatgccacaatctaccattggcctggctaatcccagggccacatctaaccattaaaggtgtatacttatctcctcagtgaaaatgaaacagaccactatcacctgaatatcctattttcaaaagtttattacaccaagtaagttacgagaaactatgacacttgaaacaagctgaaatgtgcaaatgagccatgctagtcattcacttaactccaaaaaaatgggaaacaaaaccatttctcatttatgacaattctccaaattaaccctatttccttttttaaaaaaataaccagaaaaacaataaaatgttacaaataacttggatcttccattgtccacttcagggtattgccactgcaatatattcttaccatatactttttcctaccagtacaaactacaaataacttgggtaagtcctgtctgtacttattctacccacctactagtaatttcttctgaaaatatatatttagctaacaagtaatgttcatttacaatataacatttctctgaattagttttcttgcattattaaagaaatgttattgatagatggtcactgggggaccactgctcctccccgacagtatttaaataactggtataggctgcaagacttaccagatacctgctgcgtgagcgaaggtttctgagtatgatctatatgccatccaactaatatatcaactgtatccttgatggaaacaaagagagagggggccaatcattttaagatattactgccattcacctgtggaccattccacagcaaaagatcctaaaaggagcatctatgttctacctactcaacattctagaaacttagaaaggggagaggggcaggaaaataaaagaactacatttctgacaacaatgaaatagtttattttcttcaaatattttaaggtacgaacgtcagaaataaaaatgcagcatttaaccctggaacctcaaatatcactgattatactcaaaggagcagaggcattgttttccatctgattcctcagttcctcacacacacaaccatccccctcaccccatgatctgaaaagcgaaatgaggaattcaccctaaaattagtgtggagaaaacaagcaaattaggttatttactaagtgactacataaaaaactgagtatgagaccaagaaaaatagattctgtagttttagttaaaaaaaaaattgacttgtaaatcccaactactcgggaggctgagacacaagaatcgcttgaacccaggaggcagaggttgcagtgagctgagattgcaccgctgcactccagcctggacaatacagccagactccatctcaaaaaaaaaaataattaataaataaataaaataaatatactgaaaatatttcactccactaagatgttaagctaaaaacaaatactgttttctcttcttcaatgtttgttaacattagtccttaataacatctgtttacaatatccctaaatgctctctttaagattccacctgtgattaaatttcaaatacaaaaaagtaaaacggatttgggaaacttttctataaagtacagcaattaatttgcaatccaaaatataaagcaaattttatataatttatgctttactatattagtacttgcttcacattaaaattaaagatcagtatggcaccacacatgaataacatgcaggctcaggttaccattatacataaatttttaaaataaatatatggcaaaaataataattgtcattccattgaaagaatatttattttgcagctgttaaaagacatttttccctaaaaaaagaaaagctgtgctttacatagcaatcttataaaagaaatgctagaatcagaaaaccatcattttaggctgggtgcagtggctcacacctgtaaccccagcactttgggaggacgaggcaggtggatcacttgaggtcaggagttcaagaccagtctggccagctcgatgaaactccgtctctactaaaaatataaaaattagcagagcacagtggcacctgcctgtaatcccagctactcaggagggtgaagcatgagaactgcttgaacctgggaggcggaggttgcagtgagccgagattgtgccactgccctccagcttggacaatagagcaagatttcgtctcaaaaaaaaagagaaaaagaaaaccattattttgcaatagccaatgttataatctacacaggcacagactatcaatgctaaaaatcatttaaaagacatcttaggggtaattacagaaatttgaatatagaacacatatgtaataaaattcattttcttaggtatgattacaatattcttgttatacagaagaaaaaccttattcttgggagatgcaaactaaaacattatgggttgaactgtcatcatgtgtatggttttcagatgctcaacaaaagtgtgtgagaaaataaaactggcaaaatattagtaactggtaaatctaggtgaagcatattattatgaaattattatcgtatttacaggtatttattttactggtgcatctatctttctatgaatgtgagaattttcacaagagctgggaaaatgttcataattatgcatgcagaataagcccaagctggtggcattctgttcagttacaggtaattttctgaatcttccctcaaatttttctcaaacctctataatcaaggggaaaaatgttttgttttgctttgcttttttgagatagggttgcctataatggagtgcagtagcttgaccatagctcactgtagcttcaacctcccaggcacaagcgatcctcctgcctcagccttcaagtagctgggactacaggtgcataccaccatgcctgacttattttttttccttttttttttttttttttttttttgatagaaacagggtttcaccttgttgcccaggctggtctcaaactcctggactcaggcgattcaccagcctcagcctcccacagtgctggggttacaggagtgagccaccatgcccagttaaaaatacactttttatttaaaaaaaaaagagaacactccttatatttcctttatattttgtaaactacatacccaaaataaagcatatcaaaaactgtaaaaaaaaaaaaaaaaaaccctaatatcagatattccagacacaacaataccataatttaatcacttaaaatcttactcaaaactaaatcaatgatcttttaggccaggtgtggtggctcatgatagtaatcacagtactttgggaggccaaggcaggaggatcacttgaggtcaggagttcaagaccagcatggccaacacaatgaaaatccatctctactaaaaatacaaaaattagccaggctaatggcacactcctgtaataccagctacttaggaggctgaggcaggagaatcgcttgaacctgggaggcagaggttgcagtgagccgagatcatgccactgcactccaggctggacaacagagcaagactccgcatcaaaaaaaaaaaaaagatattttaatatattcagatacacaaatatgaaataaaactaagtagagctggtattcatttacacataattatcttataccgtttggaataagaatttggggcacgttagcaaaccaaaaggctcagaaagacgtcgtgatatttagttcttgtctccctctacaaatgtgaagcactcttctatccggcattcctagtggagttcctattttcaaatttgcaaatcattctggtgctaagcaatctcaaaaaaaacatttactaaaaaccagaggaaaaaaatcttataactttgggaggctgaggcagatggatcactgagatcaggagtttgagaccagcttggccaacatgatgaaaccccatcttctctaaaaatacaaaaagttagctgggtgtggtggcaggtgcctgtagtcccagctattccagaggctgaggcaggagaatcacttgaacctctgaggcggaggttgcagtgagctgagatcgcgccattgcactccagcctgggcaacagagtgagactctgtctcaaaaaataaatataaaaaaataaaaagctgctattctccattaatacctgcaggcccgacaaaggcagcctaggaattctagatgaatggaatgaatacaacttgctggaagttcttaggaaacaaaatgactattcacagaaccaaataaaagccttccactagaaactaaaaataataataataataataatggttttatatatatgcatacacaagcaaagccagaagagaataaatagcaaatgaatgaaaactagaagcaaaaacaaacaggaaaccatctctacattttttttactcaatcgaccctgaatgctacagcattatccagggccgcagaaaacacacataatactttattcctgataaacaattcgatgtccttaagtccgccaatatcaccgtacattctgtgcaatcaagaaatttactcagctgggcacagtggctcacacctgtaattccagcactttgggaggccaaggcgggtggatcacctgaggtcaggcattcgagaacagcctggcccacatggcgaaaccccatctctactaaaaatacaaaaattagcccggtatggaggcatgtgcctgtaatcccagctacttgggaggctgaggcaggagaatggattgaacccaggaggcagaggttgcagtgagccaagattgcaccattgcactccagcctgggcaacagaacaagactccatcaaaaaaaaaaaaaaaaaaaaaagaaagaaagaagaaaagaaaattagccaggtgtggttgcatgcacctgtagtcccagcactttgggaggccaaggcaggaggatcaatcaaggctaggagtttgagactgcagaaagaaaccctgtctctaaaaaaaaggtccaggtaatttcagggtccagctccaccacaagcgcagctccaggggctgttgagttttgcctttatcattccaagtagtccctgctccagaccaagtcccaccatctggcagtcaggtcagtccaaccac

SEQ ID NO: 421 - DNA, 128108 bp, Homo sapiens
gtgcttgcattggttgcaattctgagagtcatctctgatggatggacatagataccttggccttggacaatttgtgctgactgtggagcatctgtgggtcctgtggctggcagtggaggcggtaaggagatgactagcagtgagctaccctaaggcccccttgtctaccgcctctcgtctcaaagtcctcatcctcctgtacacatgactgcatggacagccagtaggtgctttcttcttcagtttcttgaaacttgaacagtcatctgttttgctgatagattaagtttgttaaaaccctgccttgtccaagggcagtggttcatgcctgtaatctcaacactttgggagaccaaggtgggaggatcacttgagcctaggaagtcaactctgtttttcttataattctaccatccgctctccaccatggagccagactgacctttggaaaacatcccccaaccccccaccgccaaaaaaaacaaagaaaagaaaaacatcccagatcatttcattcccctgctagtgatactcccgcatgagtgattttcctttgtactttgaataaaattccaactcctgctgatggcacccaagggctgtgtgtaactggcttccgcctgcctctccagcattgtcttagatcatctccccacactccccgtgtcgtgtacatgccggcctcctttttgttcttggtctgtcttacctcagggcttttgcacatgctcgtctcagtgtctgccaaatgtatagctcgttccttatccttcaggtctgtttccaaatgtcacttccttggaggctgtttctgaccatcctgttttaaatatgcccctagttactctatcatgttagctttatttactgttttatttgtatgtttatttgtatattgattggtgttctcctcattcacacacgcaaactctcaaatgtaaatttcataaagacagggacttccccattcttgttcactgctagcagaatatctgaaactcagaatgccctcaaatatttctttttttgttttttttttgtttgtttgtttgttttttttttgagacggagtctcgctctgtcgcccaggctggagtgcggtggcgcgatctctgctcgctgcagcctccgcctcccgggttcaagcaattctcctgcctcagcctcctgagtagctgggattacaggcacctgccaccatgcccagctaatttttgtgtttttagtagagacagggtttcaccatgttggtaagactggtctcgaacccctgacctcgttatccactcgccgcggcctcccaaagtgctgggattacaggtgtgagccactgcgcccagcctaagtttttgaatttttagtagagacggggtttcactgtgttagccaggatggtctcgatctcctgacctcgtgatccgcccgccttggcctcccagagtgctgggattacaggtgtgaggcaccatgcccagccaccctcaaatatttgctgaatgaatggctatcgttctttgtcaaatccctttctcattaatcccatgcactgagtagaatggcatgaaatatgtttggtttctctgtctagtttgagttcctgagatctagttggtgagagacatgatgttctaccggttgctgtcgattgttggaagacaaagagccagcccaggatggcagaactggtcctctgcaagaaacagcacgtcagctgccgaggcgcgttccatggccctgcccacccaggcacaggtggtcatctgtggaggtggaatcacgggcacttctgtggcctatcacctctccaaaatggggtggaaggatattgtccttttggagcagggcaggtaaggatcagactgcatttggctcatggctgtgctgcactaatcgtataagattccctctcctttcagagatactgccccaccagtagctaatctaaatgttgctaagtagcatgagaagaagcaaggtggaatctcctgaattttgtttaaggatgactaataatgctcatgttctctggtttttagagagttggcaaatttcgttttccttttttttttttttttttttttttttggtggtggtgttttggtagacaggatctcgctttcttacccaggctgagcttgaattcctggcctcaagcagtcctcccaccttggcctcccaaagtgctgggactacaggcatgacccactgtacccagcaacattttagactttgacaaaaatttgcgtttgtaaataatgtggattgcatttaagcaaagtagacaactgcttgtgtttgcttaattgctaggttcttaatattgttctcattccccaagagaaatatgctctataggcttagtttctctgtgctcgccttcttttaggtcaagtattttctgctttattggcttgtaagctaagtccctttatattaatttgtaatagttacagagattacagaatggattcttataatccatcattaattaatattataccactatacaagtaatgttagattcatacaacaatattggccgggcatggtggctcacacttgtaatcccagcactctgggaggctgaggtgggcagatcacctcaggtcaggagttctagaccagcctggccaacatggtgaaaacctgtctctgctaaacatacaaaaattagctgggcgtggtggtgtgcacctgtaatcccagctactcagcaggctgaggcaggagaatcgcttgaatccgtgaggcggaggtggcagtgagcagagatcatgccactgcacgctagcctgggtgacagagcgagactgtctcaaaaaaaaaaaaaaagaatacaggcctttgactctgataattctcaacctgtgtttagctaatgttttcttattcccttttttttttttttttaagatggggtcttgctgtgtcacccaagctggagtgcagtcacactatcacagctgactgtagccttgacctcgtggattcaagcagtccttctgccatagccttccaagtagctgggactactgacatgcaccaccacatctggctggttgttgtatttttctgtagagatgggatctccctgtgttgcctaggctgttttcttttctttcttttttttttgaaatggagtctggctctgtcacccaggctggagtgcagtggtgcaatttctgctcactgcaacctccgcctcctgggttcaagcaattctcctgcctcagcctcccgagttgctgggattacaggcacccaccaccatgcccggctaatttctgtttttttagtagagacaggatttcaccgtgttagccaggctggtcttggactcctgacctccagtgatctacccaccttggcctcccaaagtactgggattacaggcgcgagccaccacacctggcctaggctgttgtcttgtgatcagacttgggttagagacttttataaccatcactgtattgagatacaatttgcataccatgccactcatccttgttaagtgctgaaatctgtttacagagttgtgcatccatcatcataaccaggtcatacatttttggcagtaagaccacagaaattaggctggactctcagcagtgcaccacatcaggaggtgtatggctgtcctgtctcacttctggtggtgataaacctggtcactcagttacattggtgtcctccaagcatctctagcacagagaccctgttttctccccttgtaatgggccagtgccctttgaggagagatggattctgagattatgccaatatcctgttcatatgagacctccacctaccgggcttagcatccattgacaactgttgcctgagtcagccaccaccgtgatggttgacaaatggtgattttttgatcatacttctacatttattatagttggcatattactgtcaggaagagatttccttctcccccatttatttactcagttatatatctgtatacacacatacacacacacacaccagtttagactcatggatttctattttatgcagtggatagttttttttttgagacagagtcttgctttgtcacccaggctggagtgcagtgacgtgatctcggctcactgcaacctgtgcctcccggattccagtgattctcctgccccaggctcccaagtagctgggattaatagttgcatgccaccacacctggctaattcttgtatttttagtatagatggggtttcaccatgttggccaggcaggtcttgaactcctgacctcagctgatccacccgcctcagcctcccaaagtgctgggattacaggcatgagccaccgtgcccggcccgcagtggatacttttaagagcaaaagtgggttttgtttttgttaatgtttttgagacagagtctcacgctgtcactcaggctggagtgcagtggttcaatctcagctcactacaacctctgcctcctgggctcaagtgatcctcccaccacagcctcctgagtagctgggactacaggcatgcactaccatgcctggctaattttttgtttttttggtagagacgtgatttcaccttgttgtccaggctggcctcaaactcctgggctcaagtgatccgcccacctcaacctcccaaagtactggggttacaggtgtgggccgccacacttggcctcataatgcttccttgatgtcaaagtctttctcctattttttgaaatccttttaaatttaattatcaggtatttccacaaaaagtgataaactaatcgcagtgtaaatgtttctaagtgggagaccctagggaggttcatttttggtttaatttgttgcttcaagattatataataccttagaattgatataaggcagactatttaaacctcacacttaaaaataattacgccagccaggcacgatcgctcacacctgtaatcccaggactttgggaggccaaggtgagtggatcaccggagatcaggagttcgagaccagcttggccaacatggtgaaacgccgtctctactaaaaaatacagaaattaactgggagtggttattcgcgtctgttaatctcagctactcgggaggctgaggtaggaaaatcacttgaatccaggaggcggaggatgcagtgagccaagatcgcaccattgcaccccagcctgggcgacagagcaagactcagtctcaaaaaaaaaaaaaaaaattatgcctcggccaagtgcagtggctcatgcctgttatcccacgactttgggaggccaaggtgggtggatcacctgaggtcgggagttcaagaccagcctgcccaacatggggaaaccccgtctctactaaaaatgcaaaaattagctgggcgtggtggcataagcctgtaattgtagctactcaggaggctgaggcaggagaattgcttgaacctgggaggcagagattgcagtgagccaagtttgtgccactgccctccagcctgggcaacagagtgagactgtctcaaaaaataatagttattattatgccttatccgtggcttgtgaaatggttttatactgccctttatgtataattattcctcttgtccatcttcactattgttctcatagatcaatgggtcttaaatctgtctgcacattagaatcagctggggagcttttaacaattaccagtgcccagacctctccccagaacaaaccagaatctctaggggtgaggccaggcatcaatatttttaaaagcttccccggggactctaatgtacctccaagggcgagagccactgtcaaagctgctcaaggagtgctatcccagcagagacgtcaccagagctataggtgctgaccaccagccagttaatggaactcccacctggggtggagctccacacagttacaaagatgatagaaaaatctctttagggagctgacaatcttatgtggaaaatataattattagagtaaatacagtaaactcaagtgacaggcatgctgacacagatgttagtttatttactgagtgataaataatttggggaaaatgaccttagaaccccccacctgctttcttgacatatgggtcccttgcaaaactgggtctttgggccctagcattactgtagcctttatattctgttgctaccacaaattagagaacatttttttcaatgtaaagtttatgtacttttgaataggcaatgtatttatatgattcaaaattgaaaatatgtaaaagaagctgggtgcagtggcttatgccggtaatcccagcactttgggaggctgaggcgggtggatcatctaaggtcaggaattcgaaaccagcctggccaacatggcaaaaccccatctctactaaaaatacaaatttagccaggcatggtggtgcacacctgtaatcctagctacttgggaggttgaggcaagagaattgcttgaacctgggaggtggaggttgcggtgagccgagattgtgccattgcactccaatctgagtgacgagcaaaactccgtctctaaaaaaacaaacaaacaaaaaaacaaaaattagctgggcatggtgacacacacctgtaatccctgctactcgggagactgaggcaggagaatagcttgaacccaggaggcagaggttgcagtaagccgagattgtgccattgcactccagcctgggtgacaagggaaactgcgtctcaaaaaaaaaaaaaaaaaaaaaagtatatatatatatatgtaaaagagtatacaggaaaaagactccccaatgttctttccttttctttctttttttttttaagatggagtcttgctctgtcacccaggctgtagtgcagtggtgcagcctcagctcctgcaacctctgcctcctgggttcaggcgatcctcctgcctcagccttctgaatagctgggattacagacgcctgccaccatgcccggctgatttttgtatttttagtagagatggggtttcgccatgttggccaggctggtctcgaacgcctgacctcaagtgatctgcctgcctcagcctcccaaagtgctgggattatagatgtgaaccactgcacccagccctcaatcttcacttctaacaaaaagctttctctctggagggaagttaagttctagttatattctctacttctataagcaattatgtgttggtaggtttgtgtatatgtgtatggatattcatttattatattttttctcttttttatataagtgggagcataccttacacactgttcttcaccttgctttttcattatgattgttccattttggtacataaagaccttttcattcttttttatagctgcataatattccattgtatagatgaattccaaaattttattttattttagagatggggtcttgctctattgcttagtctgaagtgtagtggcacaatgctagctcactgcagccgcaaacttttgggatcaagggatcttcttgcctcagcttcccaagtagcctggctaacttttatctttattttttttacttttttttgaggcggagtctcgctctgtcacccaggctggaacgccgtggcacagtcttgactcactgcaagctccacctcccgggttcatgccattctccttcctcagcctcccgagtagctgggactacaggcgcctgccacaatgcctggctaattttttgtattttttgtagagacggggtttcactgtgttagccaagatggtttcgatctcctgaccttgtgatccgcccacctcagcctcccaaagtgctgggattacaggcgtgagccaccgcactcagcctttatttttatttgtttatttatttttatttttatctttttttggtagagacacagtctggctatgttgcccaggccagtcttgaactcctggcctccagtgaacctgctacctcagcctgtcaaagtgctgggattacaggcatgagccactgtgcctggcctaaactatccagaattttaaatctgtcccatgtcattgaacatttttctcaccctgttgcccaagctggagtgcagagatgtgatcacagctcactgcaacctctaccttttgaactcaagcgctcctctggccttagcctcccaagtagctgggactgcaggcatgtgctaccatgcctggctaattttgttgttgttgttggtagagatgggttctccctgtgttgaccaggctggtcgtaaacccctgtcctcaagcagtcctcagtcctcctaccttggcctcctaaagtgctgggattataagtgtgagccactgtgcccagcttgtttccatcttttggtgttagaaacagtattaaatgagaaaccctgacctcgtattcacagatgacgtcaatctacctaatagcattttgcatccatcctgcaggctggctgctggctctaccaggttctgtgctggcatcctgagcactgccaggcacttgaccattgagcagaagatggcagactactcaaacaaactctactatcagttagagcaagaaacagggatccaaacaggtaagcaagtgtcttccatttattgctttgcctgtccctgagattgttatattcatttctgtatttggtcctctgccaggtgtgcctgctgctttggtaattaaaacttgggttggccgggcatggtggctcacgcctgtaatcccagcactttgggaggccgaggcaggcggatcacgaggtcaggagatcgagaccatcctggctaacatggtgaaaccccgtctctactaagaaattaagaaaatatgtaaattatccttactgtacttcttttgaaaataagataccaaattgcttcaactctttcttcataagaattaagagtcattgcattttaggagaattgtcattggcccaagtgtaattatggttctatatcaggtgtgttgattacagacaacaggaattggctctggccaacttggagcttgttgggaggagcttgggcctgtggagttggcaggaggctgccagctggaggcagcctggaagccaggatgtggggactgcaccgcaggcagtccctcagcgagaacaggagcagcctggcgtggctgatgctgcccttgagatggtgacctctagtcattcacctacgtgctcaagactgactcttccaggagggtctgattggataagcttaggtcacatgcccactgtttggctatactggggaagaagaagggagaatccgacccttggtagctgatgttattgtgagtggcctttgccagggattacactcccccaagactaggaggagaaagggtgaaactgcctaaaaggtgggaagaatagggatggtcgaatccctgcccaaaactgtcttttttttttttcttttttttaaagacaaagtctcactctgttacccaggctagagtgcagtggtgcaattttgacccactgcaacctccacctcctgggttcaagcaattctcctgcctcagccttcccggtagctgggattacaggcgtgcaccaccacacctggctaatttttatatttttagtagagacagggtttcaccatgctggccaggctggtctcaaactactgacctcagatgatccgcccccctcagcctcccaaagtgctgcgattacaagcatgagccactacacctggcctagaatctcatttgatcctcacaacctcacaaaactgtgagctgagaatgtttggtcagggcatggagccttagtgcatctgaagttcttaaaattttgcatagaagctcagagaagctgatttacctgcccaaggatattgagtggcagtcccaggattcatcacaggtcttctaacctataatctagtggattttccactctcctgtcctacatttggtctgatctgtctcatttgggctcatttttcttacaggttacacaaggacaggctcaatctttctggcccaaactcaggaccgactgatctccctgaagcgcatcaacgcagggctgaagtacgtaagagtctagaagcgtgtcctgactttaccacactggcctctgccaaagagcctgtgaatgtcattgtcccttgtgttctgtggcagtgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgagcaggtttttgcattttcttaagataggttagcagggaagacattacctaaggaagtgtctcacaataggaagtgacaccaactcaagtttggaaagattatcctctttggggtactcagcctccattttgaacacttataattttatttatctgttaatgagtgttttccctcagggccacatttttaaagttctaaagaactgcttttagtgctaattaatgccccttttttggagacagagcttcactcttttcgcccaggctggagtgcaatggcacaatcttggctcactgcaaccttcgcctcctgggttcatgtgatcctcctgcttcagcctcccgagtaggtgggactacaggcgtgccccactacacccggctaatttttttgtgtatttttagtagagacggggtttcgccatattggccaggctggtcttgaactcctgacctcagatgatccacctgcctcggcctccctaagtgctgggattacaggcgtgagccactgtgccctgccaattaatgccctttggacttaaggtaatattttccgccacaggacttgagaagctcaaggtgaaaacacaccttggaagtttaatccacacctgaaatcatgagcccagttgcattgaatgaggggaagacttaactagcgtccagggtatcatatccatggtatgagcaggttagcacttaaggcgcactatttacatcctctcctctctgctccatagtttatgattccaggaatttaattattgtgttccaaagtctgtttttaaactgagttgctattttcaatcttgaacaaggcccatttacatagtctcaggatgtgattctagggttttgtgttttttttaaatgaaagcattgagccgggcgtggtgtctcatgcctgtaatcccagcactttgggaggccaaggcaggcggatcacctgaggccaggagttcaagaccaggctgaccaacatggtaaaaccccatctctattaaaaatactaaaattagccgggcatggtggtgcatgcctgtaatcccagctacttgagaggctgaggcaggagaattgcttgaacccaggaggcagagagcgagccaagatcgcacgactacactccacccttggcgacaaagcaagactccatctcaaaaataaaataaaaaaataaattaaagcattgacttgactttgtcagtgtttcttctgggtggagaacctgctgcacatgccttcattctggaacatcagatgaaacaccaactctttctttaccttggaacaggtgttcagatctatgaccggacatctgttcttcatgtaatggtcaaaaaaggtcaagttactggagtggagaccgataaaggacagattgaatgccagtattttgtcaactgtgctggccaggtaggtcagcaccaacactgctgttcttatttaacgtttgtctccaagatttttttggtgtagagaagtaagattagtattgtgattggttatacagatatcagtaactacgctgtttcttgtagggtattctaaatcagaaacctacacttagtctgcaaatagaagcctgtgtgaccttgtccttcctccacactgggttgatgggtgctatcctggtcaggaaggccagcaaatggtcaggcattgacgtgaatccttggcactgggtcttgatgttacatttcattctataacctagcaaataacatattaggctattttattgtgtcaggaatgtggacactaatttccaggacactgcttcttttaaagcagattggctcttgccttccatgctatgatcccgaagtgaactaagaaatacttttgccatgtgaagttcatttagtgattgctatttggggtttgtagctgagcccaggcgttttatcaaaaggacctcctttggttcccatgagctcctttgactagctggtaaatatctcttcctttgatctcaaagtaatttttatgtcttaaaaaatgtagtattgctccccatccaaataattgaactaaagcaggctgacttcccacacctgacactgtagcaagagcacacataagccacttggaattaatctcaagaggctgaacttgctcatttttatttctgttcctcttcccacccacaaatcaacctgtccatttgtagtgggcatacgagctgggtctgtccaacgaggagccggttagtatcccgctacatgcctgcgaacacttctacctcctgactcgccccttggagacccctctgcagagcagcacaccaagtgaggacttgcacttttttaaaaaatcttgtttctttgccagtatcctgtcctctgaaaaggaaaactttctgctaaggacagcctgtgtctgaaagagtctttcatttctagagcatgttacagggaggtggacccaattctgacttttctttattaactctttatgaaaggatggccaaaatttccattaatacatttttttgtttttgtttgttttgcaagctaattttagtcctaaacagaggtcattgagaatatttggactgtcttgttgactttttaacttgaatgctatggatagtagaaatgtcataggtaaacaatagacttaggtgggttcgtggttccaagcactgtaggagagggttctcacatccttttgacggtcttcatgcctagaatgggctctgcaacccccctctctgttaaactttcgcttggcacagtgggagttacgtggtttgcttgtggggactagtcaaagcttctaggtaagggataatcagagaaacagtctccactgaaaggctaaatgggaggatcttcccccgtgacctcaaaaggtattttaaagctaatgaatgcctgtgttcattgaatgttctttcattaataaagccattaatgggtgtttttgtttggttgttctgtccatttagaaagctgacttgcctctaaacccttgttttttcttccactccccactccatgtcatttctccacctcagctattgtggatgctgatggaagaatttatattcggaactggcagggtggcatcctgtctgggggctttgagaagaacccgaaaccaattttcactgagggcaagaaccagctggagattcagaatctacaggaagactgggatcactttggtatgtgaactgcattataaccgtagtgccttatatttgtttaagatgttatatttttcaaagtattttgaagaatagttccttgtttaatgtttataacatcgccatgaggtacaacagtggttacagagggtgagtttgcctggtctgaggatggagttactaggtagcagattcaggggactaaaatcttagttaatagacatttgccttattcttttttaattttattcttagttttacttttttttttttatttcttgagacggagccttgctccgtgctcagactggagtgcagttgcacaattatagctcactgcagccccgaactcctggtctcatagctttttttttttcttctttttggtagagacatggtctcgccatgttgcccaggttgatctcgaactccaaggctcaagtgatccctttcaccttggcctcccaaagtgctaagattacagatgtgagccactgtacctagccctttgtgtgtgtttagtcatctctatcattttgtgtgtgtgtgagatggcgtcttgccctgtcacctaggctggagtgcagtggcatgatcatagctcactgtagcctcaaattcgtgagctcaagcaatcctgccacatcagcctcccaagtagctgggattacaggtgcttgccaccatgcctagctaatgtttaaattttttgttgagatggggtctcgctgtgttgcccaggctggtctcgaactcttgggctcagtcaatcctgcctcagcttcccaaagtgctgtgattacgggcatgagccatgatacccagctgctttttttttttttttttttttgagatgaagtctcgctctgttgcccaggctggagtgcagtggtgtgatctcggctcactgcaacctctgcctccccggttcaagtgattctcctgcctcagcctccagagtaggtggtaggtgggattacaagcgcctgccaccactcccgactaatttttgtgtttttagtagagacagggtttcaccatgttgatcaggctggtcttgaactcctgacctcaggtgatccgcctgcctcagcctcccaaagtgctgggattacaggcatgagccactgcgtctggcctttttttttttttgagataagagtcttgctctgtcgcccagactggagtgcagtggcacaatctcggctcactccaacctccacctcctaggttcaagtgattctcatgcctcagcctcctgagtagctgggattacaggcatgcatcaacatgtccagctagtttatgtatttttagtagagacaggattttaccacgttggccaggctggtcttgaaatcctggcctcaagtgatctgcctgccttggtctcccaaagtgctgggagtaaaggtgtgagccactgtgcccagctctgcttcttttttttgtttttttgtttttttttgagatggagtttcactcttgttgcccaggctcaagtgcaatggtgcgatctcggctcaccgcaacgtctgcctcccgggttcaagtgattctcctgcctcagcctcctgagtagctgggattacagacatgcgccaccacgcctggctaattttgtatttttagtagagacagggtttctccatgttggtcaggctggtttcgaactcctgacctcaggagatctgcccgccttggcctcccaaagtgctgggattacagacgtgagccaccatgcccggcccctgcttattctttattcacctaaaattattgctcagattttaggttttaggaggagacttctttcagtaggacttcatataaaattgaagagttctttagaaaacagaattgttttgttttgttttgtttttcagaattgttttgttagtgtagtattttattaaattttaaaataattttatttatttatgtatccattcattcattttgagatggagtcttgctctgttgcccaggctggagtgcagtggtgcgatcttagctcactgcatcctccgcctcctggattcaagcaattctcctgcctcagcctcccaggtagctggaattacaggcgcccaccacaacgcagagccagtttttgtgtttttagtagagatggggtttcactatttggccaggctggtcttgaactcctgacctcaagcgatccacccgcctcggcctcccaaagtgctgggattaccggtatgagccaccgcacctggcctttaaggcctgtaatcccagcactttgggaggccaaggcgggcagatcgcctgaggtcaggagttcaagaccagcctggccaacatggcaaaaacccgtctaaatataaaaattagctggatgtggtggcgcacacctgtaacgccagctacgtgggaggctgaggcaggagaattgctggaacccgggaggcagaggctgcagtgggctgagatcgcaccactgcactccagcctgggtgacagagcgagactccatctcaaaaaaaaaaaaaataataataataatatagttacctagttccaaatttaaaaagatgaaagagtctctaatgaagaatttccctctgacccttgatgggctttctttttttaataaattcttacggaaaatttcaaacttttaaaagtggatagaagctgggcacagtggcttacacctgtaattccatcattttgggaggccaagatgggaggatcactggagcccaggaagtgaagaccagcctgggcaacatggcgagactggagactatgtgtctactaaacaaacctggcgagagtagtatgatgagcccccatgtacccattatccagctctggtctggtttcatctttttctgctgtccactggattatgtcctgatggtagatttcctttaaagcagggtgaaagtctgtcttttgcagctattccaatgcagaacattgcctttttttttttttttcctgagatggagtttcactctattgcccaggctggagtgcagtgtcacgatctctgctcacttcaacctccgcctctcagattcaagcgatttttctgcctcagcctcccgagtagctggggttacaggcttccaccatcacgactggctaatttttgtatttttagtagagacgaggcttcgccattttggccataatgctcttgaactcctgacctcaggtgatccgcccaccttggcctcccaaagtgccggggttacaaatgcaagccaccatgcccagctcagaacatcaccttttattaaaatctctgtggccgccatttaagagcttttccactcacactggtcccttcaagattattatctgtagatacgttttacttgctgttctctgctgctttcctttctaaccaatatcttttttcctcagtctttataccaagtattttgcagctatatcctgtaattctaccaaggtttctgctttgtgataaatggcccagttggctcgtctttaaaaaaatctcttccagccggacgcagtggttcacacctataatcctagcactttgggaggccgaggcaggcagatcacttgaggtcaagagttcgaaactagtgtggccatcatggtgaaaccccatctctactaaaaatacaaaaaattagctgggcatggtggtgcacgcctgtaatccgagctaattggcaggctgaggtgagagagtagcttgaacctgggaggcagaggttgcagtgagccgagatcgtgccaccacactccagccggggcgacagagtgagactccatctcaaaaaaaaaaaaaaaaaaaatcaagaggttttctgaaaggggagagtgtaaaaaagtagaggggttgaaagtggtttaattccttaaaggtgagaactctatttggttttgttgtcattgctcagagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaagtctttctcactcaaagtcagctgtgaacataagtcaacttgctgggtctcttcccttctagaattacttgttattaacatggcgtgtggtatatttaatctagtatgttaagactaataagaagatacatgtaattttggagttgtccccttctaagtatgagaggctccccatgttccagaaatgtcatcgggcaaaatgtttttgcaactcatcttttggagttagccacagatcctgtgggatattcttttatattttttcagttataacaaatattggtcatttgagtgtgtatttgagtttggtagccaagtatgttgattgaggtaggtatttgaactaggtaatacacggtttgtttgtttttttagacagtcttgctctgtcacccaggctggaatgcagtgacatgatctcaggtcactgcaacctccacctcctgggttcaggctattctcctacctcagcctcccgagtagctgggattagaggtgtgtgccaagacatctggctaatttttctatttttagtagagacagggtttcaccatgttagccaggctggtcttgaactcctgacttcaagtgatccacccaccttggcctcccaaagtgctaggattacaggatgagccactgtgcccggccacaagtttttatttaaaaattagacactaggccgggcgcagtggctcacgcttgtaatcccagcactttgggaggccgaggtgggcggatcacaaggtcatgagatcgagaccactctggctaacacagtgaaaccccatctctactaaaaatacacaaacaaaattagccgggcgttgtggcgggtgcttgtggtcccagctactcgggaggctgagacaggagaatggcgtgaacccaggaggcagagcttgcagtgagccgagattgcgccactgcactccagcctgggcaacagagcgagactctatctcaataaaaataataataataaaataaaataagacactaatgaacattaaataagccagtcacaaaaggacaaataccgtgtggttccacttatatgaagttgctagagttgtcacatcatagagacagaaagtacaatggtggttgccagaggcgggggaggggagctattcttgaatgagcacagagttccagaaatgcaagaggaaaagagttctaggatggatggtggtgaaggttacaccgcagtgtgaatgtacccactgccactgaactgaatacttacaaatgggtaagatggtagccacgatgaaaagtttattttaaatttatgagaccagttctcttgagtgatttgtagaatggctctgaaaacagttacagaagaggagttagaaaaatgtttggagcaaaggagatgtggtcacgtaactgtataatctttaggtgacagaaaaaaacccattggatatttagagtatatttgtatgtgttttagtcttatttcttcatagatgaggcttataacttttttgaaacaagatcttactctcacccaggctggagtgcagtggcaccatcatagctcactgcagccgcaagttcctgggctcaagggatcatcccgcatcagactccagaagagctagaactaactgcaggcgtgtgccaccatacccagctcttttttttttttttttttttgaaacgaagttttgctcttgttgcccaggctggagtgcaatggcacaatctcggctcaccacaacctctgcctcccgggttcaggtgattctcctgcctcagcctcccgagtagctgggattacaggcatgtgccaccacgccggctaattttttttttttttttttttttttttttgagttggggtttcgctcttgttgcccaggctggagtgcaatggcgtgatctaggcttactgcaacctctgcctcccaggttcaagcaattctccttcctcagcctccgtagtagctgggattacaggcgtgtgccaccacactggctaattttgtatttttaatagagacagggtttctccacattggtcaggcttgtttcgaactcctgacctcaagtgatccgtctgcctcggcctcccaaagtgctgggattacaggtgtgagccacctggctcactttgaaacttttttttttctgtagagacggggtcttactatgttgcccaggctggtctcaaactcctgacttcaagcaatctcctgcctcagcctcccaaagttctgggattacaggcatcagccaatgtgtctggctggcttctatgttaaatacctcctagggaatcttatcatctggggtaaaatcctcatagtagtcttttgagagcagtacacagacccatgttcgtttcttccagaaaagttaaggaaagtgcccaaaactattcagctggtctatggcaatttaggatcttttgattctgtttgttctcgatttgtagaatattaattttctcaaatctcacacctgagccccaacacgtgccctctgtctatataggtaccttgccgaatggatggtacatggttatccctcagaaaacgtttgggaattggacctgaaacgttttggagccctccagagcagccgcacctttctgcgccaccgggtcatggaagtcatgcgtaagtgaagctttatcgcagttgctcctagttgcaggtatcttctcggtggcccgtgttgtcattcagaaggagcaaagttttcctcagttctttaacaagtgctttgagttgggcatttgatttgactgtttcaggcctgagttaaggggctttatgctcctcatgatatatacgtaacattttctttagtgcatcggaccttgtttcattctgagaacaagaaaatagaataggagttacagttggtacatagcagcttcataaatattctaagcaatgccttcttcccggtctgccttgagagaccgtatgtcgaagtgcgtgctttctgcagtctgccttgagagaccctgtgtcgaagtgaatgctttctcactcccacttagtttttgagaaaatgctttctcactccccacttagttttttctttccaagtcagagaatttgccgagttattctcagagcttcaggcttccgtgagtgactttcaccattaatccaccctacagcagcaagattgggagccacttcccatataaatacaaaacatacattcctgctctcactcccgtgttctcgccctgcttcaactttgaaggattggccacttcatcttaatttgttattctaccttgatctctgatttattttctaggaagcccttagaaagcttttgtatcaggaattgaaccaaaccacgtgggttcaagttgtaatttcattttcctgtactgaggagctgttctcagactttgccaaatggtatctaaatattttgggcatacttatgctcaggactaagtttctgtgttggctctgaccaccattcttggttgcaagtaaactgttagtttggtagttgaacaacattgttggtgaggactctggatggcctttaatgcctgagtgctcacttttggcctgggaagaggatgtacatccatggagatgaaggacctaacagcaatatgtttaactgctaaggttctttaattttagcaaatattttggttaaaatgttgaacttggctgggtgtggtggctcatgcctgtaatcccagcactttgggacgttgagggaggtaggtcacttgaggtcaggagtttgagaccagcctaggcaacgtagcgaaaccctgtctctactaaaaccaaaaccaaaaaattagccatgcctagtggcacacacctgaagtcccagctacttgggaggctgaggtaggcgaatcacctgagctggggaagttgaggctgcagtgagccatgatggtgccactgtgtactccagcctgggcagtgggactgagaccctgtctcaaaaaaataaaatacaaaatcaaagttttttgttttaaagttgaactattataagcctaaatttccctacccatagttactttggaacctgtacaaatcataattgagcttgagcttctgcttggtgatatgacacttttggtagccaattctcatgaaatagaagtggcaggcacatagaaaatggggaaggcgccaggcgcagtggctcaagcctgtaatcccagcatgttgggaggctgaggcaggcggatcacttgaggtcaggaggtctggcctgaccaacatggcgaaaccctgtctctactaaaaatacaaaaatttagccagatgtggtggtacgtgcctgtgatcccagctacttggcaggctgaggcaggacaatcacttgaacccgggagatggaggttgcagtgagccaagatctcaccactgcactctagcctgggtgatagagagggattccatctcaacaaaaaataaaaaaaaaatagaaaagaaaatgggggaggggatgatagaaccgaaagtactaggagatggagagattgtcaccatgcagagaaccccacctggcttccttctcctgtctcccaacctccccaagccttgatgtgccttttgtttgggatggtgtgagatcagggaccacagatcacactcttctggctttttttacttattgctgttgaagattagaccttaagggaaatgaattttttttttttccgagacagtcttgctctattgcccaggctggagtgccgtggcgtgatttcggctcactgcaacctctgcctcctgggttcaaacaattctcctgcctcagcctcccgagtagctgggattacaggcgcctgccaccatgcctggctaatttatgtatttttagtagagacagggtttcaccacattggtcaggctgatcttgaactcctgacctcgtgatccgcccacctcgacctctcagtgctgggtttacagacgtgagccaccacacccggcctaagagaaatgaattctgaccctagctttgttgtgtgaataatgtcattggtacaatacaatataacttctcagatttcagagccacctaatcaagctgcaatatgtaccctttcacttcagaagtgagttaattatcagggaggaaatgtctgtaacaggtctgagatcctaacacaggcacaatgaagaatcgaatgccattttttcacattttgttaccacctgtgtcccacttagtaaccttcttctctgctatgaagcttggtaaggtttaggaccctgacctttctgccatcatttctacctactaatgtggaatgctgaatgtgaatacaggccgagtcatgccgtgacacgtagctccagggagggacgatagcagcttggcaggattgtcttttccttctggagcatgcctgatacactgggtaattttgaaaattagactacattagcctggaaattgggccgggcagagtggctcacgcctgtaatcccagcacttcgggaggctggggcgggcagatcacctgaggtcaggagtttgagaccagcctgaccaacatggagaaaccctgtctctactaaaaatacaaaaattagtgtggcacggtgacacgtgcctgtaatcccagctactcgggaggctgaggcaggagaatcgcttaaacccaggaggcagaggttgcagtaagccgagattgtgccactgcactccagcctggacaacaagagcaaaactccgtcttaaaaaaaaaaaaaaactacgttagcctggaaagctcttttgaatagaaacaactccagagtctagtggacatgggctactcaggtctagaatctgtgtcttgggctttgatagactactcgtgtcttttctagctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaagggtaagaagtcacattctcatttttgcttcttttttttttttttgtcctgggaattaataaaacatattttcaaatgcataggctagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacaaagtttgagataacagtaagtatttgggaaccaaaaagtaatagattaggaaactttacatatttattgaatgccttttgtttttcatcttcaaaactgattcctgactgggtgcagtgggtcatgcctgtattcccagcactttgggaggccaagggggcgtggatcacctgaggtcagagttccagaccagcctggccaagatggtgaaaccccgtttctactaaaaatacaaaaattaaggccaggagtggtggctcatgcctgtaatcccagcagtttgggaggccgagacgggtggatcacctgagatcaggagttcaagaccagcctggccaacatggcgaaaccgtctctaccaaaaatacaaaaaattaaccaggcatggtggcgggcacttgtaatcccagctactcgggaggcaggagaatcgcgtgaactcatgaggtggaggttgcagtgagctgagattgcgccactgcactcagcctgggcaacagagtgagactccatctcaaaaaaaaaaacaaaaaacaaaaacaaaacactgatttcttaagaattctggtatattttagtgtttcatctgtattgtaacatttttctgaaattttagctccttgtttcaggtttttaatttgctagagaggcctgtttatcataagaatcaatagctagcgttccctggagcttcttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcaggtgagatgagctgccgtcccgctctgctccctccaacatgttgattccttaggggtgctgtagcagaggctctcaggcgcttctccgggaaccataaatcccagagtctaagaatcattacatgaaatcaaagccagtttattagcagtcctaaacaaaagaaatcaccaggaggaaaagaaaaaaaagcccaccagattatgtaccctactgggagaagatgccttgtcttttttcttttttttttttttgagacagggtctcactttgttacccaggctggagtgcagtgatgcgatcatggatccctgcagcctggacctcctgggctcaagtgatcctcccacctcagctttccaggtagctgggaccacaggtacacgccaccacacccagccagtttttgtatattttgtagagatagggttttgccacattgcccaggctgatcttgaacacctgagctcaagcaatctgcccaccttggcctccaaagtgctgggattacaggtgtgagccactgtgcccagccgatgtcttaacgttagtaaatctgtataatttcttggcattaacaggaagccagaattttgttttgttgttaggtggtgtatcctagaatggtgctactggccttctgtgaaagctaagaaatcatttcctagtatttgcctcattgctttgaaaccaaataagatttgattgcttcctgatccttttgctgctacctggttttgattattttggggtctcacttttcagtttcttcatgatctctccaaccgaccagcaggtccactgttgggcctggcttaagaaacacatgccgaaagacagcaacctgctcctggaggacgtcacctggaagtacacaggtacgggggttcgggctctgccacgtcgaaaaggccagcagatgcagatgtgtccacgtttgccttctttacatttgactctcaaaaatgaacattagagttagcataaaagaggctctctggtcatagaaaattgatctctaggggatgcggtggctgacacctgtaatcccagcacttttggaggccgaggttggaggatcactaggtcaggagttcgagaccaacctggactatatggtgaaaccccgtctctactagaaatacaaaaattagctgggcgtggtggcacacacctgtaatcccagctacttgggaggctgaggcaggagaatcacttgaacccaggaggcagaggttgcagtgagccccagattgcaccactgcactccagcctaggcgagtgagactccatctcaaaaaaaaaaagaaaattgagggctggacacagtggcttacacctgtaatcccagcactttgggaggctgaggcgggcggatcatgaggtcaggaatttgagaccagcctggccaacatggtgaaaccccatctctactaaaaatacaaaaattagctggacatggtggtgcatgcctgtagtcccagctactcatgaggctgaagcaggagaatcgcttgaatctgggaggcagaggttgcagtgagccaagatcatgccattgcacctccacctcccgggttcaagcgattcttctgcctcagcctcccaagtagctgggattataggcgcccgccaccacgccgggctaatttctgtatttttagtagagatggggtttcaccatgttggccaggctggtcttgaactcttgacctcgtgatccacctgcttcggcctcccaaagtgctgggattacaggcatgagccaccacgcccagtcccagagagtacctaatttttaaggatgacttggttccctgattttctcactctcagcagtctcggcttaacccctcccaccttcccacctaactgatcttgccccttggccccaccagcgtttgctctcccaggctctcattctcaattccttgtagtagcaaatatgatatacgtcctgctcctggattgggatactacagaatgttactgaacaaaagtcatgttctagcctgtcttaggatggatgacatgtaattagcacaagctgatgtcacaaacactggtgtccagaataatgctttccttatctagtaagcattaggatatgtttgaagtggatttagcttctctgaatttaaagtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggtaagtgctgataaagttctgtttcttaaatgggcagagaatgtgtctttcatagcggtggcaggtacatattcttactatggtgttagcacccacaaagagtgtcttggctgggtgaggtggcacatgcctgtaatcctagcactttgggaggccgaggcaggtggatcacccaaagtcaggagtttgagaccagcctggccaacatggtgagaccctgtctctgttaaaaatacaaaaattagctgggtatggtctcacgcacctataatcccagctacttgggaggctgaggcacaggaatcgcttgaactctggaggcagaggtcgcagtgagccgagaacacgccactgcactccacctgggtgacagagtgagactctgtctcaaataaaagagtgtgctggccaggtgcagtggctcacgcctataatcccagcactttgggattacatcttatatttataaataaatataaaaatacaaaaattagccgggtgtggtggcgcatgcctgtggtcccagctactcgggaggctgaggcaggagaatgacttgaacctgggaggcagatgttgcagtgagccgagattgcgccattgcactccaggctggcaacagagcaagactgtctcaaaaaaaaaaaaaaaaatgtgctgcccttcattagcaaagaagtgactaagtatatttatttatttatttatttatttatttattttgagacagagtttcactcttgttgcacaggctggcgtgcaatggtgcgatctcggctcactgcaacctccacttcccgggttcaggcgattctcctgtttcagcctcccgagtagctgggattacaagcgcccgccaccatgcccagctaactttttgtatttttagtagagacagggtttcaccatgtttgccaggctggtcttgaactcctgacctcaggtgaaccacccacctcagcctcccaaagtgctgggattacaggtgtgagccactgcgcccggccttatttgtttattttttacactccaagcttgctttatttaataagcattaggatatctttgaagtggatttagcttctctaaatgtaaagtctttatgctttttggtttctgtagcactggattaaaatttgaagttacaggattatgacacacacaaaaatgcctttcgaagttaggtcccttctctccatgcagtgtggcctcttttctgtacacagagtaacttctgtgtctgtggcatcttcagggaagaaatggcgtaggtgaatctctgaacttcctacataattttctttcctataagtggcaaccacagctgagtgaaacaaactgtaaccgaatgaaagcaatgacaacggaatcctccccaggaagctgctgattagagagggccaaacggacagacatcttggccacctgtaacgagcaacttccaggtggttactgatggagactctttgaagttcacccaaagtgggatccacctacaaattgtttcacagttttccttcttctccgaggcaaagtgaaagcaacagaaaactctccactgttagctatcagtggacccctcccagcgtttgctctgctgcttggaggagtgacccatacgctcaacacctggcgagtgctgcatcctgtcagcctcctgtggaagcggttcacttcggtgctgtccaggactttccactttcctttataggaacggtgattgcgtcagtggccgctgttagggaactgagctgctatgtaacgtgttctgagaatcagaagcccatctttgaccccaggatagcagattaattatgtctgtgggcatcgggcatcatcttttgtatggcaggcggccagggtttgtctgctgattcccccagagaagacactcgccttgtcctcattgtgcctgctaccctcgactaacacaaggacctggcaaagaggaatattttgtgcttgtcaaggactttcctccactctctaccatcagcttggctaaaactcctgagatggtaacagtagcaagcagagatgtcacataggcagtgctccattctctgtgcctcaggacctggaagttaaccactttcgggatgaaattcttgccttgacgtctgtctccctcaacagtaaacagagggtgcagcactaatgaaaggtttccccaggcgtccctcccttgacaagtaatgtgagtgcccaggctgactgctgcctttgtccctgcaggagatgagtgtgggctatgcaaatgggatccgggtgatgagcatgacgcacacaggagagccaggattcatgctctacatccccatagaggtgagagggcacccttcccttcccttcccttcacttcccttcccttcccttcccttcccttcccacaaccactgtggggtgccagtgctcccagcagcgcgttcaccagcactggcaggtttggagagctgtatctgattgggccttgggagctgaggtaggctgcattgaagagatttgaccatttttaactaagttatataagtttttttgaataggtgatacatttaaaaagtatttggcgccgtctgatctgttctcaccaactgtcaccaataatattagtattacttttatatgtcatttcagatttgtatgcatattgcaagcaaattcataattaatttttttttttttttgagacagggtctcactcttttgcccagggtggagtgcaatggcatgaccgtggctcactgcagcctcgacctcttgggctcaagccaccctcccacctccgcctcccgagtagctgggactgtaggcatgtgccaccatgcctggctaatttttgtatttttttgtagagacaggttttgccatgtcgctcaagctggtctcaaactcctgacctcaggtgatacacccaccttgtcctcccaaagtgctgggattataggtgtgagccaccatacccagccaagccccctttttaaaaacagaaatggaagcatactgctattcttcatcctgtttttttttttttcacttcacaattttttttttaattgaggcagagtctcactctgtcacctagggtggaatgtagtggcataatctcagttcactgcaaccttcgcctcccaggttcaagtgattgtcctgcttcagcctcccgagtagctgggattacaggtgcacgccaccacgcctggctaatttttgtatttttagtacagacggggcttcaccatgttgcccaggcttgtttccaactcctgacctcaagtggtccacacacctcagcctcccaaagtgctgggattacaggcatgagctaccatgcccggcctcacttcacaatttctcttagagctctttctttgttggtacctaaagcaaaagagcttccttgttctttttttctttattttttaacagtggcgtagcattccattgtggtacatcattccgatactaatagacatttatgttatttctagtcttttgctgttataaaaaggtctgcaggctgagttcagtctaatcatatgcaaatagtaatagtttcttccttctccagaaccttttttttgagacggagtctcactctgtcgcccaggctggagtgcagtggcgcaatctcggctcactgcaagctccgcctcccgggttcacgccattctcctgcctcagcctcctgagtagctgggactacaggcgcctgccaccacgcccggctaattttttgtatttttcatagagacggggtttcaccgggttaaccagaatggtctcgatctcctacctcgtgatctgccagccttggcctcccaaagtgctgggattagaagcgtgagccaccgcacccggccggcttttttttttttttttcttttttttttttgagatgaagtctcacacttgtcccccaggctggagtgcgatgacatgatctaggctcaccgcaacctctgcctcccgggttcaagtgattctcctgcctcagcctcccgagtagctgggattacaggcgcctgccaccacacccgactaatttttgtatttttagtagagacaggatttcaccatgttggccagcttggtctcgaactcctgaccttaggtgatccacccacctcggcctcccaaagtgctggaattacaggcgtgagccaccgcacccgggcccatagtctttcttcctataatttccttcctttgttctattgtgacaggtagcaatcaatgattgtaggcatgcttgttttcttcttgatgttagtcatactacttgtagtgataggttttctcttaattttttttttttttgtgagacagggcattgctctgtcacccaggctggcttactgcagcttgacctccgaggctgaagtgatccccctgcctcagcctcctgaatagctgggactacaagcatgtgccaacatccccagctaattttttaattttatttttgtagaggcagggtcttgctatgttgcctaggctggtctcagactcctggactctagtgatcctctcacgtcagcctcccaaagtattgggattacatgtgtgagccactaccccgaccttatttattactattttttagtgcagtgggatgatcatagctcactgtagccttgaacttctgggcttaagcagtcatcccacttcagcttcctgagtagataggaccacagatgcccagctatcttttatttttttgtttttagacggagcctcccactgtcgcccaggctggagtgtagtggcatgatctcggctcactgcaagccccacctcctgggttcaagcgattctcctgcctcagcctcctgagtagctgggactacaggcacacgccaccacactcggctaattttttgtatttttcatagagacagggtttcaccgtgttggccaggatggtctcaatcgcctgacctcgtgagccgcctgcctcagcctcccaaagtgctgggattacaggcatgagccaccgcacccggcctatttttttattttttgtagctttgagagtctcaatatgttgcccaggctggactctaactccagcctcaaatgatcctctcatctcagcctcccaaagtgttgggattaccggcgtgagccactgtgtctggccctgttttaactatttgagccactgtgcccaaccctttttaaatgattaaagcacagataatatcagcgcatgaaatttcatctgcttttccacactcagaagtattacaacaatatgaagatgaagagattgttcaagacttgggaagaatttaaacagatgcagctgccatggttggcctgtgcaggcaggttgattctgaagtgccacccagtggttcaggtgttgtcacctgggtgcttgtggtcaaacctcatcaggaaggggaggctctgtggctctagcagcttcatccttgcttggaggccttggtttcagctttctgatttccctgggctgttcccattcttatgatttttcaagagtctaagagattatttgtgccacgcttgggttctttataagctggcttttgtccaggaagcttatgtttgtctctctgagaagaggtcttccaaaacatgggggcagatggcagattctcgttttgttcacactaaatctctggtattttgtgagaaaaacgagtaaatggtggggaactactctttgagtaaatggtggggacccactcttctctttgattttcccagcattagtcacgtagttggatctggcccaacactagtcacctggttacatcgttcttccttggtcatcctcttacctaaaggaccgggcattgagcttgaggtgggagagtaccacattccctggagatgccagctgtgtattctcctcgtcctgccgcattctgtgggtctcctgcacccaccttggctgattcaggtgtttcccttacacacataccacaggcgagtgttgcatgcaatagcttggattccttttttccacatttaaagttgtcttcccggcacggtggctcatgtctgtaatcccagcaatttgggaggccaaggtgagtgaatcatctgaggtcaggagttcgagagcagcctggtcaacatggcgaaacctcgtctctactaaaaatacaaaaattagctgggtgtggcggcagccacctatagtaccagctactcgggaggctgaggcaggagattcacttgaacccgggagtggagatggcagtgagccgagatcgcgccacttcactctagcctgggcaaaagagcaaaactctgtctcaaaaataaataagtaaataaagttgtcttgatcatagtggtctgtttggtagatgcctgttcagctacagtggtgcagttcatagaaacatactgtgctaggataaagaactgcagtaccactgaagctggttctttgctacgtcttgctttggatttcattttacagttttaaaagcaaacagtgtagtctcatttttgttggactttaaacttaacagcgtatgttcagacagggattgaatatttgctttcagtttggaaaaccttctgttcactgatctgataacgtacatgtttctgaaaccaagaaaagagcagcttgagagcctgaatgctgtgggacatgagcaggcgagccctgccttcctggctcccccgccgtcatccgatgtgtgcacacgtctcgagtaacgtgtgagagctgggcctcacagcttgggccagtacgtgagggagtaacagtggttgggaaattggagcaaaagaacaaagccagaatcagatgaagaccatggagggttggtgggctgttttagaaatgatgatgagattggccatttaccaaatggtgagagagcttctataaattattatttaagaattgctgtaagctagaatcaccacacaagacattttagagaggtgaaaagacatggatcctgttgtcatggagcttaagtccaggctggggtgaccccagctcatcactcctgggctgtgccctgagcgtgtcaaggatgagacatcctgggagttttatacgcctcctctcttgtccatgttaatagtgtgagccatcagcgcttccagacatgctccatgcttaattctgaaggtctgctgcttatgaactttctgtctcttcctatagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaaggtactgtgtttacccagactccactttcactcagcatcccgagtagtgaatctgcactagactaggaagaagaactgatgtgacaggaaaagggggaaaagattgaggccttgatgttagcatcaggtaaatgaggacaagagtgccctgagaatgaaaactttataggataaaatatcttcaaatgaaaacataataatggtggctcacgcctgaatcccagcactttgggaggctgaggcgggtggatcacctgaggtcaggagttcgagaccagcctggccaacatggcaaaacccgtctctactaaaaatacaaaaagtaggccgggcacggtggctcacacctgtaatcccaacactttgggaggccaaggcgggcggatcacaagttcaggagatcgagatcatcctagctaacacagtgaaaccccgtctctactaaaaatacaaaaaattagccgggtgtggttgcgggcgcctatagtcaggagaatggcgtgaacccaggaggcagaggttgcagtgagccgagatcacgccactgcactccagcctgggcgacagagcgagactccgtctcaaaaaaaaaaaaatttacaaaaagtagctgggcgtggtggccagcacctgtagttccagctactcgggaggctgaggcaggagaatcacttgaacctaacaggcagaggttgcagtgagccaaaatcgcaccactgcactccagcctgtgtgacagggcaagactccgtctcagaaaaaagaaaacatagtaaatagatgacacttggtcaggtgcggtggctcacaactgtaatcctagcactttgggaggccaaggcaggaggatcacttgagctcagcctgggcaatacagcaagaccttgtctctgaattacaattgaaaaacaaacaaaaaaacccacttatttctagtgttctgctgtctaaaagactgagtgctttctgggaagctattctgagttaattatggtgatgcattaacatgccacgaatatttgtacaaactagtcgtcctatagtcagctgcctaatttttgtggtttttttcttttgtttttgattttgaggtggggtctcattctgtcacccaggttggagtgcagtggcgcgatgttggctcactgcaatgccctctcatgctcaagtgatcctcccacttcagcctcccaagtggctgggaccacagatgcacaaccatgcccagctaatttttttgtattttggtaaagacagagtttcaccacattggccagggtggtctcgaactcctgagctcaggtgatccgccctcctcggcctcccagagtgctgggattacaggcgtgagacagcacacccggcctaatttttttggtttttttgttttgggcggatcacctgagttcacaagttcgagaccagcccggccaacatggtgaaaccccgtatctgctaaaaatataaaaattagctgggcatggtggcaggcacctgtaatcccagctactcggtaggctgaggcaggagaattgcctgaacctgggaggcagaggttgcagtgagccgagatcataccattgtactcccacctgggtgacagagcaaggctccatctccaaaaaaaaaaaaggtaataacccattttggaaaatataaagaaggaaattaaaatcacccatattttgtctatttaatggtagtaactattttttttttctttcttgagacggagtttcgttcttgttgtccaggctggagtgcagtggcgcgatctcagctcactgcaatctctgcctcctggcttcaagcgattctcctgcctcagtctcccgagtagctgtaagccatccagctaattttgtattttttgtctttaccaaaatacaaaaaattaggtgggtgtggtggcgcatctgtgggcccagctacttgggaggctgaagtgggagaatcacttgagcatgagaaggcatttttgtattttttctttttttagtagagatggggtttctccaggttggtcaggctggtctcgaactcctgacctcaggagatccccccgccttagcctcccaaagtgctgggattacaggcgtgagccaccgtgcctggccataatcaccgttaatagtttattctagtcttatttgttgtacatatgtgtatatatgtgtgtatgcattgaatatagatgtgcatggtcttgttgggattatataaaaaagtctttttttttttttttttgagacagagttttgctgtgtcaaccgaggctggactgcagtggtgcaatcttggctcactgcagcctctgccacccaggttcaaacgattttcctgtctcagtctccctagaattataggcacactccaccagaatcttggctcactgcagcctctgcctcccaggttcaagtgattttcctgtctcagcctcccaagtagctagaactataggcacactccaccacacccagcttatttttgtatttttagtagagatgaggtttgcctcatctctgttcaaggcgtgagccaccacgactggccaatataaaaacatttttctaaagtactggactgataaggtattttattaagtgagtgagttttcttcctaaacgtttttgttctatctggtcttgtgactttatgtttataaaataggaaacaaaatgcgtacctctgttgttacaaaaattaccgcggcgtcttttatatttcacatgcagtttttcacatggtagaaatcgcacagtttcccaaaagctggcagggttgtgggaggaggcggctgtgccccattgcagtgacaccaggggacccttcccacggtgctgctctctgtgccgagggtctgagtgtcgctggatgactcggcgtttcctttctttcttagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcaatttgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactactcttgcacggctgcttgtgaaatgttcttcatctgtagtgacttaaatgtgtttgccaccacaaagcataaacagcgtgcagaggagagtgtgtacctccctgtgtgtaccagtgtgagggaggatttggggacgggggtagagaagatgtaggtgtttatcttaccctccctgcagcgctggagtggctgggggtaaaagcttcccgcctcctgaaattccgaccggccttctgcctacagctgacctcaggaggaacctgccacctgatgttccacacgggcacgtgtgcactcaggtttgtgtggaaagcaaggggggtcgtgttctcaccctgtggaaacaaccctgagagaaacaaccagtgctctttttctacaccagcttccatccacaagttggtccctggacttgacctgttcactaatttttttttttgaggcagagtcttgctcttttgcccaggctggagtacagtggtgtgatcttggcttactgcaacctccactcccaggttcaagtgatttcctgccttagcctccagagtagctgggattacaggcacgcgccaccatgcccagctaatttttgtattttcgtagagacggggtttcgccaggttggccaggctggtctcaaacccccaacctcaagtgatccacccaccttggcctcccaaagtgctgggattacaggcgtgagccactgtgcctggcccaaagtaatttttgagtagtttttttttttttaagtatttgtacttttgagaatctcataggttaacatgtttacaacaatctcttcatcttgtcttctaaatcagccccttctattccagttccaggaatagtcaaccacgccagaaacctgggactcacctggtctccccactcgcctctccctacacctcccgctcattacccagcctcacagggctgtctcctcagtgcctctcctctgttcggacctcactgtccccaccactgctgctgtggcagagagggttgtcagccctgacttcgagaacaatctcttactgattttcctgcttctcatgtcatcccccctccctctgcagggttgtctttgtaaaacaggggaggtcaatttactcactgccttgaaaccctcaagggactcccctttgtcgtgagacaaagctctcagtccttagcctggccagccagggtctccagggtgtggcaggccacgctgccccagggctccggcctgcgctgcgtgtgatgtgggtcctgcagccgagtgcgtgctcgccatccacagctggatctcacctcgaatcctgctttccagtcacactgagaggtctcccactcccatatttgctcactaaaatgcctcctggcagccctcccctgtgcttgtggaaagtcgcaaattgaggatcacatggacccccactcccccaagttgtcctgacagagacctcctgtctttcatttgattgattgattgagacggagttttgttcttcttgcttaggctgctggagtgcagtggcgagatctcggctcaccacaacctccgcctcccaggttcaagcaattctgcctcagcctcctgagtagctgggataacaggcatgcgccaccatgcctggctaattttgtatttttagtagagacgaggtttcactatggtggtcattggtcaggctggtctcgaactcctgacctcaggtgatcaacccacctcagcctcccaaagtgctgggattacaggtgtgagccacagtgcctggcccctcctgtctttcaaaagctctgcccaagaccaccatcatcccacagtggagcctttccttccccaagagaatggcccctttggggtcctcacacacccgtttctgatgtgtctttatttggttatctgccctgctccttctgtaagtccctcggagaaagactcgaattctcccaaactccaacacctcacatggtgtttggtgtttaacagatgattaaatgaatgggcaaaaagtggagggcaaaatctttaaaatgtcttttaagatttaaggattttaggccaggtgcggtggctcacacctgtaatcccagcactttggaatgccgaggcgggcggatcacctgaggttgggaattcgagaccagcctgaccaacatggagaaaccttgtctctactaaaaatacaaaattaggcgtggtagcgcatgcctataatcccagcttcgcgggaggctgaggcaggacaatcgcttgaactcaggaggtggaggttgcagtgagccgagatcacgccattgcactccagcctgggcaacaagagcgaaactctgtctcaaaaagaaaaaaagatttaaggattttaaatgtttgatttttttttcttgttgagatagagtcttgctttgtcgccaggctggagtgtagtggcgtgatctcggctcactgcaacctctgactccctggttcaagggattctcccacctcagcctcccgagtagctgggattacaggcacacgccaccacgcccagctaattttttgtatttttagtagataccgggtttcaccatgttgaccagcatggtctcgatctcctgaccttatgatctgcccacctcagcctcccaaagtgctgggattacaggcgtgagccaccgcgcccggcctgaaaatttttaaatgattgtttgccgactttacaacaggacgatgttgttgttcgcaggccagtaggtggcgctgtggcacgtgatctgagcctcctggattcacacaactgttcatgtggagaacccagtgccgggacccattagcaccccagtcaggctatgcgtctccctcccaagggtgctcacctggtgtggccttcatggcacagggggagtgagatgaggctcctttagtacaccctcccctgagaagagcgacgtgtgcttaccctccagtggcttgttctcatgaaaggctccacagttagggaccttcagatgcttagatctggggtgtcacctgactcaagcagctcagaatcccagattgttgtggtgggtcaagggcatggggctttgggtttactggcctgggtctgaatgccagcattgcctcttccttggtgtataggaccttgggtggttacttttcctaggcctctgtttacttgttttaaaatggacagtgatgcctactttatagggttgttatgaaactcaactaatgaatataaaatactcgacccagactggcatggtggttcacgcctgtaatcccaacactgggaggccaaggtgggaggatctcttgagcccaggagttcaagaccagcctgggcaacttagggagaccccgtctctaccaaaaataaaaaaattagccaggtatagtggtgtgtgcctgtagtactagctacccgggaggcagaggtgaaaggatcgcttcagcccagaagttcaagactgcaatgagccgtgatcatgccaccgcactccagcctgggtgacagatcaaggccctgtctcaaaaaataaattaacaggtcgggcgcagtggctcacgcctgtaatcccagcactttgggaggctgaggcaggaggatcgcttgagcccaggagttcaagacaagcctgggcaacttagggagaccccgtctctaccaaaaataaaaaaattagccaggtagagtggtacgtgcctatagttccagttacccgggaggctgaggtgaaaggatcgcttcagcccagaagttcaagactgcaatgagccctgatcgcgccactgcactccagcctgggtgacagatcaaggccctgtctcaaaaaataattaattaaatacttgacccattgcacgatctttccatgcacgacagctgctcttctattattcttccaggatgagctgcacagcctgcccccttgggtttccaggttgtgggagatgagcaaaactgaatgacctcagtaggccaagagcaaaggatgtgggtccggacctggtggccagttgcttgtgacaggagctgggctggagtccccaagtgccactagtgctgacatcttttaactgtgttcattgtgacttgtttatttctaaaagtaaccactggcgccttggtgcagatggaactccaggtgcatgcggtgagttaaccatggtctggggagctttgtttccacgcctaggacatgcatctgtgtgcatgatatgtgagctgatatagccatgcctctggtgatttgaacgcctgcgcttcccagctgcttcagggccctgaacatcgctggatgtttgtacttcattccctcctcagcccagctggtcccactccgcagctgtgctctaggcatttcatctcaactgggtgatatatttgaatacagcaattataagaacagcaacctcagaagaacatctggcatccagacctccccagcctagttccacaaggtaccaacttccgtaagccttgaagagctaagtaagacatccgggccgggtgcggtggctaatgcctgtaatcccagcactttggaaggccaaggcgggcagatcacttgaggtcaggagttcaaaaccagtctggccaacatggtgaaacgccatctctactaaaaatacaaaaattagccgggtgtggtagtgcatatctataatcccagctacttgagaggctgaaggaggagaatctcttgaacccgggaggcagaggttgcagtgagccaaggccacaccactgcactccagcctgggcaacagatcccttggtatagatacggggagcttgggtggtctcatcacagcagaacctcagctcttggcatgttctttcctttgctaccagcttttgaaactgaagtgtagcagagtcatgaaccagactttgaaacatgaaccagacagagaaacattttaagaagtagcggctgaccaggagttggagattgcagtgcactatgattgcacctatgaatagccactgcactccagcctgggcaacatagtgagacccctatctaaaaaaaaagaaaaagaagggccaggcacggtggctcatgattgtaatcccagcactttgggaggccaaggcaggtggatcacaaggtcagatcaagaccatcctggctcacacagtgaaaccccttctctactaaagatacaaaaaattagcctggtgtggtggtgggcgcctgtagtcccggctactcgggaagctgaggcaggagaatggtgtaaacccgggaggcggagccgggcgcggtggctcacaactgtaatgccagcgctttgggaggccaaggcaggaggatcgcttgagcccaggagttttagaccagcctagacaacatggcaagaccccgtctctaccaaaaatacaaaaaattagccgggcatggtggtgcatgcccatagtcccaactacctgggacgctgaggtgggaggatcacctgaaccccggagccgtgagcacaccactgtactccagcctgggtgacagagtgagaccctgtctggaaaaaaaaaaaaagtagctgggtatggtggcacgtgcctatcgtcctacctgctcaggaggctgaggcatgaggatggcttgagcccaggaattcgaggctactcagcaattatggtaccactgcactccagcctgggtgacaaagtgagaccctcaaataaaacaaaataaattggccataaatgtaagagttttttcctgtattgttcattctgttccttgatctatatgtcttgtcctttttccatatcttatagatgtgattactagaagtttcatagcaagttttgaaatcaggtagtatacattctccagttttattctttttcaaatgtgttttggttattctaattcctttgcgtttccatgcaaattttaagatccagttttcaaattttttttgagatggatcttgctatattgcccaggctggtctcaaactccagggctcaagggatcctcttgcctcagtctcccaaatagctgggattacaggcacatgccaccaaacctggcctctcaattgctttaaaatacaacaacaacaaaaatcttttggaagtttgatgggcattgcattgaattaatagacaaatttggggagaattaccatctatcttaacaatattgagtcttcccctggccaacatggtgaaatctgtctctactaaaaatacaaaaactggccaggtgcagtggctcatgcctgtaatttcagcactttgggaggccaaggtgggtggctcacttgaggtcaggagttcaagacctgcctggccaacatggtgaaaccatgtctctactaaaaatacaaaaattagccgggtgtggtggcgggcgcctgtgatccaagctacttgggaggctgaggcaggagaatcacttaaaccgaaggggtggaagttgcagtgagcccagatcgcgccactgaactccagcctcagtgacagagtgagactctgtctcaaaaaaaaaaaaaaaaaaagaaaagaaaaaaaaagaaattagctggacatggtggcaggtgcttgtaatctcagctacatgggaggctgaggcaggagaatcacttgaacccaggaggcggaggttgcagtaggaagagatcacgccactgcactccagcctggacgacagagcaagactcagtctcaaaaaacaaacaataaaacaatattgagtcttctattccatgaaggtgaaatgtctatgcatttttttagatctttagtttctctcagcaatgttgttttacagttttatgtgtatggattttcttttttttttttttttttttgagaatgagtcactctgtcgcctagtctggagtgcagtggctcaatctcggctcactgtaacctccgcctcccgggttcaagcaattctcctgcctcagcctcctgagtagagtagctgggattacagttgcccaccaccacgcctggctaattttttgtatttttagtagagatgaggtttcaccatgttggccaggctggtcttgaactcctgacctcaagcaatccatctgcctcggtctcggaaagtgctgggattacagatgtcagccactgtgcctggccatgtgtggaactgtttcctcaatttcattttcagattgtttattgccaatgtgtagaaatgcagtggattttggtatgttaattttgtattctgagacctttattctagtagggtttttttttttttatacattcctttggattttctacagtagaattatgtcatctgcaaatgaagatagttttacttctttcttttcagtgtggatgcctttaatgtctttttcttaacttattgcacaaattgcgcattcaatagtacaatgtttagtgggaccggtgagaaaagacatccttgccttgttttgatcttagggaggaaagtctttggtctcactgttaagtgtgatattagctgtacgttttgcgtaagggctgtattcgtttgctaggactgccatacaaggtaccacacactgggtggcttaaaaaacagaatgtattttctcagagttctggaggcataaaggccaggatcaaggtgccggggggttggttccctctgaggacctctctccttggcttgtctacagccgccttctccctatgtcttcacaggatcttccctctgtgtgtctcttcttataatgaggccagtcagactggatcaggacccaccccagtgacctcatttaactttaattacctctttaaagaccctatctctaaatacagtgacacggaggtaatggaggtaggacttcaacatactaatttggggctggttgtggtggctcacgcctataatcccagcagatgacttgagctttgagaccagcctgggcaacatggggaaggcccatctctactaaaaatacaaaaattacctggcatggtggcgcacacccacagtccagctactcaggagcttgaggtaggaggatggcttgagcctgggatgtggaggtcaaagccccaggagcagaggtcacagtgaaccaaaattgtgccactgcattccagctgggcaacagagccagacttcgtctcaagaaaaatttaaaaatcaaatagacatgatttttttttagacagagtctcattctgttgcccagcctggagtgcagtggtgtgatctcagctcactgcaacctctgtctcctgggctcaagtgattctcatgcctcagcctcccaagtagctgggattacaggtgtgtgccaccatacccagctaatttttgtatttttagtagagacgggattttgccatgttggccaggctggtctcaaactcctgacctcaggtgatccgcccacctcagcctcccaaagtgctggtactacaggcatgagccactgcacctggcctaatttttttttttttcttgagacagaatcttggtctgttacccaggctggtgtgtagtggcacgattacagctcactgcagccttgacctccctggctcaggctatcctcccacctcagcctcccaggtaggtgggactatggacacgtgctaccacgcccagctaattttttgtattttttttagagacggggtttcaccatgctgcccaggcaggtctcaaactcctgagatcaagcagtccacccagcttggcctcccaaagtgctgggattataggtgtgagtgagctactacgcctggcctggacatgtaatttttaaaagaaaatgtggccacaactctcctagagttaaatgttttttttgtttgtttgtttgtttgttttttgagaccatcaacaagatttcaaggctttaaagaaaggagctgcttcaggaagagataaaatgactcaaacgctataaccttcaaatgtagactgggagaagaggtatcagctatgcatgagctggagaggggtgggatagatagagacacaggtgataaagaaaatatagcaaaatgtgaatcctacaatctgggtggtggatgtaaaccctgtagtagcctcacctggggaaagctgccttgcaacaatgaggctgcccattctccaaacccaccccagccaccgagcaggctccactaaaaagtctgaacccaggagggagtaccatggaaaccaagttgcaatgccctggttaggggcccagcagaggggtcatcccagctctacgccattggatactgagtttcaggagtgggagtgccatcctcagggtcacacagcgtgtcggttccagcctaggtcttccagtgtctcattaatcttttatccactcagcttctcttctggcccatgaaccttgctctcctgggactcttttttttttttttgaggggtcgggggtgggacagagtctcgctctgttgcccaggatggagtgcagtggtgccatcttgcttcactgcaacctccgcctcccagattcaagcaattctcctgcctcagcctaccgagtagctgggactacaggcacccaccaccctgcccagataatttttgtatttttagtagagacaggatttcaccatgttggccaggctggtctcgagctcctgacctcaagtgatccgcctgccttggcctcccaaagttctgggattacaggcgtgagccatcacacccggcctgggactcttcttgcagtgagccagggccatgggacccttcaaaagttgctccaccctaatccccaaaatatctttttctcccgcctgtcccaagtgcctggcatcatactatatgggtcaactggccatgtttgccatggaagcccaattgtaggaagtgggtcttttatcacccggcatagcagagctgtggaaactgcactgggaaagatcaggatgtgaattaaagcgttgggaatgggaaggcagagaccttggattagctgggatgctccatgcactcgctgagtgaccttggacaagccccttagacacactaagcccgtttcctcatctacacgacgggcatcccatctgctactgcaccaggttcttgtggcaataacttgaactcacacatgcaaacaggctttgtgagctccataaacacaggtggctcggccaggtgtggtggctcatgcctgcaaccccagcactttgggaggccaaggtgggaagatcccttgagcccaggagttggagaccagcctgggcaagacgatgaaatcctgtctctaccaaaaaaaataataataattagccaggcatggtggcacacacctggtcccagctccttgggaggctgaggtgggaggatcacttgggcccaagaggtcaaggctgcagtgagctgagattataacactccaacctgagtggcagagtgaaactgtctaaaaaataaaaataaaaatacatcaaaaaacaggtagctattaagcattgctaggacccacacgcagtgaccctgagggtgctgggtttctgtttgagggagaagaaactcctgagcccctaggtattgtgggggacatgcagttccagaccgccttcatggcctgtatgcctggcctcatccccatccctggcacccatgacgatagccacattccactggtgtttccccaggaaagccaaccctacctgcatctcagcagagcttccacggagttggaaccccgctccgagagggtgtgggctcaggggccaggggtcacacaaactccagaaggaggacgtagttggtttgcaaggctgtcctttgccctggttgaataacctttggtcttccccgagaggaacgtgggcattaggctgcagcccacaggaagctatgtattttctgagaaacttggcccatggtgcagatctgctccagctcactctggtgggatcacgccagccacggccgggccacggcacatcatggcaacgtgctgcccacctgctacgccacctgtttttctagaggcggacgtgatcccagcaggactggagtcagcccagggcatcacgtgctctggtccccgcctgctttgactcctcctgcctcactccccccctggcctgtagtcacgttggtgagggtggtgggcaccggggctgggcccagcccccgaccctgcccagacagactttcctaaggcacccttttcctcgtgcaggtgcggcctcagcccacccccctttgagcccacagattgcacccctctggtgtgcggttacctcttgcctatgtttaattcatggctggggggttgggacgagcttcccaagaaaggaaagaactcccctggggtcttgcccagtttctgctcaccagaaggaccatagccgaggtcctcctcccagggcccggggctggggagcggaagccatcagtgggctcggaggacactgtcccagccaggacacggccatcggtcactaatctgcagcactggaatgtccgcaggccaatcagcggggtctctgggggctccccaagggtgctaataatcccacaatgattagcaggggccgcgggtcagtgcacgccactctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggaggtaagggacacctggtgaggaggtaggtggaggcaccattatgagctctgaggagtgggtgctaggagacttctggaagcccggtcccaggcctgagccccaggccgtgcgggtggtttaatgaggaagccctgggacagcccgggggcggtgaggggtggatgctggactggggaggaaggaggaggaaggaggaccagggctggggtcaaggaggaacgccgaggagcgctgtggctggggcctggagaaatccgtggcccggaggagccccagacaggggcctgcgggagccagggctggcccctacacccagcccgcaccgctgttccctcccgccaccccaaccccagcactcagcccacgcctgctgtacctggtctctctctcagcctcgctccattgctatgccccacgtcccctgcacccaccacactcctctcccatcttgttttccaagggcagggacacatgcttattctgccgtgtgttgggttcaggtccccccatcctcgggctgcctgaccttctctctccaccccagccctgaacaggaaggagagtttcttgctcctctccctgcacaaccgcctgcgcagctgggtccagccccctgcggctgacatgcggaggctggtgagtacccgacccagctgggctctgccaggggggtggccggaggcgcggaccccagagggcggctcaggaggccacgcctgtccaggtgcccttccacttgaccagggtgggcaggcacagccagccaccttgcccctgagggacggaggccctggttgctgggggtctctgcagtttcttaaccccccaccctcagttcaggaggtcgggccccttggctcccactcgcctgaagggcaggaccttgggccttccctggcatcttgttgccacagagaccaggagccacaggaggagccggatcccctcctccagggaaggggagcttcacgaggagccctgcaggatgggcggccgggccagggagggagaaggtcgtgctgggctggggaggggcttctgtgcggcaaggacccagcgcctcctcctgagcttatctgagccacgaggacgggccttgcccatgttctctgctcactcactcgtccacattttccacattttcagcaggggccgggggtcgggggtatagagttccccaccagcccggctggggctgcggggttgggactgtcatctggaggctcagaaacgctgccctccattgtctgggaccccagcagccccagcccatgttagcaggccagggagccagggcagggtggtgggggcgggagggttccccatggctgcttcccatgaactcctccaaggcaggtggccacagtggcgaccttgagcactctagggtcagtttcccaggaggtgggggtggggtggctaaatgcggggggtcgcttctcccccattcccagccctgagtggctctgcctctcctcaggctcagaccctgggcaaccaggggtgctcccagctgtgacctccgtggttgggtactcctgcctgggaccccaggaggggctgcggtggtcgttggctggcagctggcaccctttccagggcccttttgtcaaagtcttagaaaacttcatttccataaaggtgcaaatggagctccatggctcagcctccctcgtggcccggccccgagcaccctccgggcctctagggctccagggcaccccttctttggacacagtggagactgaaggtcttgtgggggtggagggctgctgagggaccccggggagcccccagctcctggccccagccttcatcagaggtaaaaccccgatggacattagtgcaggatgaagttggcttggggtgcagccccgaggggcccccctccctgcatccactcagtgcttgtgagtcctatcctgcaggcacctccctgctccgtttacagatgagctcagggagtctcgggagatcaggggactgcaccaagtcacccaggggtggtgattgccaggcccacttgtttaagaagagggagggggctgggcacggtggctcacacctgtaatcccagcactctgggaggctgacacaagcagatcacctaaggtcagcagtttgagaccagcaatggccaacatggtgaaaccccgtctctactaaaaatacaaaaattagccaggtgtggtgtcacatggctgtaatcccagctgcttgggaggctgaggcaggagaattgcttgaacctgggaggcggaggttgcagtaagccgggatttctccactgcactccagcctgggcgacagggtgagactctgtctcaaaaaaaaaaagaagagggagggggcggggtcagctgtgcgtggtggggagcatatgaggccaggctcctgggggcaggagactagggcagagaggcgtggctgtagggctttttgcatcacaggagggcagcatggccgggtgggagcagtggagcctttctgacaatggccagggcccaaacacagaaccagtctgcaacgcgtgggcactgctcacatgaccagatgggagaaagacagcaggagcgggtcccactgcctgggcagggccgaaggatgcccacgacaggatttggagatggaggctcagtcgtgagaggagctgggctcctcctggagggacatcagacaacaccagtgcttcctccagcaggactcctcatccagtgctctctttgccacctgacctggcacccggtggatgctcagagatggcaggggagttgaatctttgaggcctggcccagcagtcaaaggcctcccacagatgtctgtttgtgctgcccccaggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcaggtgagtgtgctgcaggtgaggccagcgtgccagctcccagatacagacttccactggtccatctcagaagaggctacagtttgtcctaaatgttgggattccttttcctccaattggtttagttttactttttttttttttgatacggagtcttgctgtgttgcgcaggctagagtgcagtggcgtgatctcggctcactgcaacctccgcctcctggactcaagtgattcttgtacttcagcctcctgactagctgggactacaggcatgtgccaccaggcctggctaatggctttatacttttagtagagatagggttttaccatgttggccaggttggtcttgaactcctggcctcaagtgatccacccacctcagcctcccaaagtgctgggattacaggcgtgagccactgtgccccgccacattttttctttttttggagacatggtctcagtctgtcaccccaggctggagtgcagtggcgtgatctcagcttactgcaacctccgtctcctagattcaagcgattcttgtgcctcagcctcacaagtagctgggattacaggtgtgcgcctctacacccagctcatttttttgtatttttagtagagacagggtttcaccatgttggccaggctggtctcgaactcctgacctcaaatgatctgcctgcctcagcctcccaaagtgctggggttacaggcgtgagccaccatgcctggcctaagccactttttttcaatctgaaatataaataatttcaaacataaacgtatttatttatttatttgagacgaagtcttgttctgtcacccaggatggagtgcaatggcttgatctcggttcactagaacctctgcctcccagattcaggtgactgtcctgcctcagcctcccaagtagctaggactacaggcacgagccaccacaccccactaatttttgtatttttagtagagatagggtttcaccatgttggccaggctgggtctcaaactcctgacctcaagtgatccacctgcgtgggcctcccaaagtgctgggattacacgtgtgagacaccgcacccagcctcaaacgtaaatttaaaacggccccactcttacccactacctaggtttagaagatgctactaaactaaagccctgctcctccccttttcccgctgtccctccctggagggaatcttcccaaagttcaggagcatcactgccaagcaagtttccattttttctcttcattcaacaaatatttgttgagggtcttctacacacacctggtgctcttcagatgcactgaaaaacacaagcaaaatcccaggaaatatttaatacctccactacctgtgcaagtgggttgtgcatgtttaaatattacacaaggctgggtgcggtggctcacgcccgtaatcccagcactttgggaggccaaggtggcaggattgcctgagcccgggagttcgagaccagcctgggccacatggaaaaaacctgcctctacaaaaaaatacataaattacccaggtgtgatggtgtgcgcctgtagttccagctacttgggaggctgaggtaggagaattgctggagcctgggaggtgaagattgcagtgagctgagactgcgccattgcactccagcctgggcagcaggagtaaaaccctggcttagtaaaaagaagaacatgtgcccctacaactaggtgctgccaaagtgcttacgccaactgtgcagaccagcaaaccagttcccacttcccgaagatcttctggctccttaatttttttttttttttttgagacggagtcttgctctgtcgcgcaggctactgtgcagtggcgcgatctcggctcactgcaagctccgcctcctgggttcacaccattctcctgcctcagcctccctagtagctgggactgcaggcacacgccaccacacccggttatttttttgtattttgtttagtagagacagggtttcaccgtattagccagggtggtcttgatctcctgacctcatgatccgcctgcctcggcctcccagagtgctgggattacaggtgtgagccactgtgcccagccttggctccttaagttttgtcagactcaaaggtgtgaaaaacctaactctgttttgttgttggtggttgttttttgtttgttttgtttttgtttttgttttttcgattcagagtcttgctctgttgcccaggccagagtgcagtggtgcgatcacagctcactacaacctccgcctccccagttcaagagattctcctgcgtcagcctcctgagtagctgggattacaggcgcctgccaccacacctggctaatttttgtatttttagtactcctgacgtcaggtaatccacctgcctcggcctcccaaactgttgggattacaggcttgagccaccacgcccagcctctattattgtttctaattttcttgatgtgaatgtttagatcattaattttaaatcattttttgtttctactatatacatttaaagctataaatttccctttaaacgatttcagctgcatccaataagttttgatgttttttctatttccaatcatgatgttgtttttgtttgttttgagacatggtctggctctgtcgcccaggctggagtgcagtggtgcaatctcagctcactgcagcctcaatttcctgggctcaggtgatcttctcacctcaggtccggagtagctgggactacaggtgtgtgccaccatgcctggctaattttttgtatttgtaatagagatggggttttgccatgttggccaggctgatcttgaacttctgaactcacatgatccacccaactcagcctcccaaagtgctgggattacagatgtgaaccaccacacctggccatgatgttgttttagattttgaagtgtatctttaagtttctaaactatgttatcttctctatttacttgtaaattatttactttaaatttcattgcattgaattcatagaatgtgggctgtaggatgtgctgattctttgctatttgttgaaacttgcttagtggtctaatgtatggtcctcctttctggtttgcaaaagtcccatgcattcctaaaaacgatacatattctttaagtgttggatacatgtatatgatcacatgttcacatctgcctgctacaagccagtcttgtacatgtcatttttagtctctactggagagtttgtttcactcttcttatatattgcccatttgtgctatttccaagctgttgctgattctaagactttaaactggtttgcagacctgtatccattaggttttattgcatgacatactaccccaaaatttagcagcttacgattctgcaggtcagccacttgggttgggctcagcagggaggttttctggtcttggctgggcccactcatacacctgcaatcaactagggggccggctgggagctggctgtgcaaaaaggcctctaatggttcatctctgttccatgaggccttccaaactcctatactgagtttgttcatgtggtgactgagcatggttctatgagaatgagtggaaatggcaaggtctcttaaggcctaggttcaaaatcggctcagtatcacttctgtggcattctggtggccaaaccagttacagagccagccagattcaaggagcaaggaaagagacacctctctttgctgcaaaaagctgcagagtcacatttaaaggagtggcctggtgcaagaaatgaatggttgtggtcaccatgcagtcacaaggcccttgatgttccagtctttttttggctactcccctccacccatcaacaatctcccctcatttcaggtacctcccctctccatccccctctcaactaagaaagccttcctaggccgggcacggtggctcacacctataatcccagcactttgggaggccgaggcaagcagttcacctgaggttgggagttcaagaccagcctgaccaacatggagaagccctgtcgctactaaaaatacaaaaaaattaaccgggcctgtaatcctagctactcgggaggctgaggcaggagaatcacatgaacccaggaggtagaggttgtggtgagccaagatcaggccattgcactccagcctgggcaacaagagcaaaactccatctcaaaaataaataaataaataaataaataaataaataaataagccttcctgaactattcccacccatgcttctacccctgcccaggacagctgctgctcctgagccctcgaggaggtaagggagccctctgttcacctggatgatagcgaaagctgtgtccccctccccaggggtggttcacaatagggtttctgatcccctgtgtctcctgtagctcgtgtgggccacctcaagccagctgggctgtgggcggcacctgtgctctgcaggccaggcagcgatagaagcctttgtctgtgcctactcccccaggtaagccctgctacaccctctgctgggatgtctgggagacagggaggggtgctttcaccgagggtgagattcccacacatccacccgaaagtagagtccctgatgccttgctctgcacccttggtgggagaggggaggagaggaaaggcagagggtgctaaagattctggccacgcagaaggtgctgctctgcggatgtcccttcctggatactggtcctggtatcagggagtttgtccaggattggtttggaggccatctcttctctcccagggaatctccctatctcacccagctccctgactccctggcctggccgcaggagctgaaggggccaggggggcaggcagcagggccctgcctctgccttgcccaaggccaggccctcccacaccctgtggtgcctgctcgtcctcacagaggcaactgggaggtcaacgggaagacaatcgtcccctataagaagggtgcctggtgttcgctctgcacagccagtgtctcaggctgcttcaaagcctgggaccatgcaggggggctctgtggtgagtgcatgagggctcagtctggtgaccctggggtgggggtggtagcatcctactgggctgtcccagaagccctggcccttagcacccagggaggctcctgcccggcctgctgggaggagacccttttctcagagtcccctcctcctctgaccagaggtccccaggaatccttgtcgcatgagctgccagaaccatggacgtctcaacatcagcacctgccactgccactgtccccctggctacacgggcagatactgccaaggtgagggcactggagcctgggtgtgcccagccctgctctcgtggcaggtcctagggctgctacacttcctgagagtctcaagggtgtcagaggtgctgactgtgtactccctgagtctgcccactgcatacattctttcaacaagcattcactgagcactagctgtttgccagaccctgagctgtgcaggagattcaaagtgaaatcaggttcagccccttaggctctgggaggaggacagaattaggacccagaagtggattcttgccctactgcccctctaccctaacccactctgtgaccatgggcaggtcacctcccaaactccaatatgcctcactctgcaatggggaccaaaccaaagacaccaggcgtgccagcaatcggaagccttggtgggttctgtctatgggaggggtattcttgctgtggttggcattccctggatgttcgaggcctctggggggcagcgtggggtccagaaggctgggggctgagcctctgccccactgccctgccctggcagtgaggtgcagcctgcagtgtgtgcacggccggttccgggaggaggagtgctcgtgcgtctgtgacatcggctacgggggagcccagtgtgccagtgagtcctgccccagggcccccaaagagccagctcctctcaagaccccccttcaatggggcatcagctcccaggagcccgctgtgtgcctctctttccaactcattcagtgacaacacgttgagatcttgaaactggccacagcatggatatttacaccaaagaaattggcaaatgctataaaccatggatttttttttttcttttgagagagagcaagctcaatattccaacttaccagctcgctcctgaccctcaccacccactcttttggagcaggtggccagaggaaggggcaccctgagcttagctccccggcagggcaggaaagggcagggattctgaagtccacacacaaactcaggctcccctaccccagccaaggtgcattttcccttccacacctgtgacctgaggatcgacggagactgcttcatggtgtcttcagaggcagacacctattacagagccaggatgaaatgtcaggtgacagtcacccctagcttcctaggaaccccctagggcctcaagtgagggtcttaatgcagggaccctggagtgagaggtggttccttccacgtctctgacctcaccctattcatcagcataaagcaggggtcgtggactccaaggctcatagaagccaggaggtcacttattgacctgaggggccaaggtcaagaccaacctccatctaagggagttccagccactggttgccttgcaggaatgcaaggtcagggtggccagagctcggggttgttcaagaaaaccagcaacccagacttccactggcaactctcgaaaccacaattaattactggggttggcaatcaacttggatatatttaagacactgtgcaggtgaaacagaacctcctcaggggccagaccttgcctgggcttgtgggctgctggtcgcgcccccgtgcacagggagaagagaagcagacgggagcagaagggacccctgctcttggaagggaggctgtgcgggctgggggtgatgatagcccggccagcacacacacgtggcatcttaggccatgggcaggggtggcaggaaggggcagcctgggctctgggagccttgcctgtgtgacccagggtggggttacagaggaaaggcggggtgctggcccagatcaagagccagaaagtgcaggacatcctcgccttctatctgggccgcctggagaccaccaacgaggtgattgacagtgacttcgagaccaggaacttctggatcggtgagtgcccagctgattgggggtatggcgagtaaggggttgtgatgccccaccctgctgcaggaaccctgggccatggcggctgccagcagatggcaagggtgtgttgagggcctggagcccagagcggggccagctgctcaccccctttcccgggaagggcccaggtagggagcacatgggggctgccagcgctgggaagaggggccagaaaggcagctggcagcagactccagggtctgagtgggccaaccttgactaccccggcccagggctcacctacaagaccgccaaggactccttccgctgggccacaggggagcaccaggccttcaccagttttgcctttgggcagcctgacaaccacgggtaagtgtggggtgcctccctcccctgggcctccttctcacttgggcctgcctggtggagccccccatcccgctgcctggctgggccctttgagggtctgatccttccctggtgcctgcccaggtgccagagagttgtgggcacagctggtgtgggccggtggtggggtgagggagatgcaagccggaaggcacgtcacgtgggggagagagggacccaggaagcctccatccatctgtccatccccagtgtcccctggtgtgactccatccctccaattctcatccactcacccctccgtctgcatgccctctgcctgcatcagttacactgatgccagcattccttagctgtcacccacctgcactcattcacaatacaaccctgcacctgcagacccaccagccatcctgtagcaagaaccctctggtcacgtggccccaccctgctcttcaaagcccagcaatgcccagggccagggtggaggtggtccggctgcgaggccaccaagggctccagcgatttcagccagccctccttgccaacagccggcctgtgcccctggcctcttgcctggaggaagtctgggccttgttgggttcccaggtgtacctctcaagtgggctgtctattccagtccccaccatccccacaggctggtgtggctgagtgctgccatggggtaggcagagctgttaccccaggaaggggcttccctgagaagtggagcagggctgggggcttggggacgggcctggctcccggcagccccgtcggcaggtgggggcactggagcccctgagatgcagggtcctgatgggtggagggcttaggcctctcccggatccctgacttcactcttgcctcctgaccaccacaccatggcctgcaggtttggcaactgcgtggagctgcaggcttcagctgccttcaactggaacaaccagcgctgcaaaacccgaaaccgttacatctgccagtttggtgagggacttcctgaggctccccttctctgatctctgaccctgggggtgctgctgacccggtccagcctgcaagggtatctaggtggcaggttcagagtgggtctgggcacacggggccatagaggatgccctgttgatggccttgtacctgtgggctcctgagcccagaggggcaacgacgggcccagcttcatacagcaaggccacgcaggaaggactagagctacagctctgcaggggatttctccaaggaccctctcctgtcatgaaagctgctgcctgggaacctgttgggttccttggtgttcccgggagccccatgaactgtggtggaggcggaggtgaaacctagcatggcaccagctcccagcagcctctgctaggaaggcctggagcgccacagggaccacggccatgggcacttccagaccgagtgcaacagggctgccatcttgggactgcctgggctgccatcgagccctgctctcttctgcttccttccagcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcagacatcacccacaaggggttatcactgtcccagtttacagcggaagaaatgaaggcagagagattgagtaacttgcataagatcatacagctgggagtcaaacccagtgagtctggctgtcatttatttattttttttcttttcttttcttttttttttttttttttttttttttgagacggagtctcgctctgtcgcccaggctggagtgcagtggcacgatctccgctcactgcaaactccgcctcccaggttcacgccattgtcctgcctcagcctcccgagtagctgggactacagacgcccgccaccacgcccggctaatttgttttttgtatttttagtagagacggggtttcaccgtgttacccaggatggtatcgatctcccgacctcgtgatccacccgcctcggcctcccaaagtgctgggatgacaggcgtgagccaccgctcccggccctatttttttcttttttgagacagagtctcgctttgtcgtacaggctggagtgcaggggtgcaattggggttcactgcagcctcgaactcccaggctcaagcgatcctcctgcctcagccacccaagtagctggaaccacaggtccgcaccaccacgccccgctattttttgtgttttttgtagggacggggttgcaccatgttgctcaggctggtctcgaactcccgtgctcaagcgatccgccatcctgggcctcccaaagtgctggggttacaggcatgcggcccggcgccggcccagtctttccctctcccactgcttcccagggcttcgcctgtctaaccgggcgcgggcagttgtcctgtgtcctggctcagcgcggacctacgcggggtggtcacacagatgcccccagctctctctacctcccgcgaaggcgctgagccccctgatccctgcccgggcactggcgcaaggtcgcctgcgagcgccaggccttcctgcccggtgggagacgggagggcccgctctccggctcggtctggttcccgggtcagccagcagccgcgcctcttcctcccagacccgggacccgccccttggccggggccgcggccgcagcgcccggaggggccgccctgcgcatgcccgcgggaggtgggtgacccgggagcgcgctgcccgaggccggggggcggtggggacagcacaggcggggcggccgaaccgagaccttcccaccccgccccacgcctggttggggacctgacgcgccgtcgtgagtggggcgggtgcaggtgtccctgggggccgggggcagacactggtgcgggacgacctgctcccgagggggtccgcaggccacacccagagaaactggggcgcctccagtcaccgccgcggtccgccccgccggaggctttgaccccctgaatcagcgtcggggcagggatccgcgtggggtggaagaggctgggaaacttgggagtcccgggcctcctctggagccgcccgcccttggctggctggtccttctcttcctcggctcccgccgggctgggccctgggccgccctcactccctcccctctgcagcctcccttgcgtttgtcattcactctgccaggctctccttctgcctccgcatgcccaacgatccggagaaaaacacggaccatgacatcaaaaggccttggccaaggaatcgtgattattgtgatacaagattctgcacctcaaaggggatccctgtagtgagttttggaaaacgtacaaagcctgacttacaatatgcctgttatctgtggcgtttcatctggggaacttacttttccttgatagggtaaactattctcatccagagtatgtccctcagtctgtaaaagtccatggtgccctacatctattaggggagtgaggaagggcagtgggcattggatctgcttctttgaaagcccccacctgtgtttagcttctgttagaggcctttgaaccagagcaactccatcttgagtaggcgctgggtaaaatgaggctgagacctactgggctgtgttcccaggtggtggaggcattctaagtcacaggatgagatgagaggccggcacaagcagtaaagaagccgcggccaaaacccaccaaaaccaagatggtgatgcgaatgacctctggtcgtcctcactgctacactcccaccagcgccaagacagcttacaaatgccatggcaacgccagaatgttaccctatatggtctaaaaaggggaggcatgaataatccaccccttctttagcatataatcaataaataaccataaaaatgagcaaccagcagccctcggggctgctctatggagtagccattgttttatttctttactttttttttttttttgagagggagtcttgctcttgctcaggctggagtgcagtggcgtgatctcggctcactgcaatctccgtctcctgggttcaagcgattctcctgcctcagctttcgagtggctgggactacaggtgcccaccaccatgccggctttttttttttttgtacttttaatagagacggggtttcaccacgatggccagggtggtctcgaactcctgtcctcagatgatctgcctgccttggcctcccaaagtgctgggattatatgcgtgagccaccgcgcccagccctattcctttactttttttttttgaggtggagtctcacacctggcctccaatatgtttattcatattgctgaggcaggggattgcttgagcccaagagtttgaggttgcagtgaaccatgatcataagctgtatttcagcgtgagtgagagattgagaccttgtctcacaaaataaaagttaaaaagcccttatctggaggtgagaaagccaaatacaaaggtcttctcagttggttcccagtcttcccagtccagcagcctcagcatcaccagggagctggttaggcaaattctcggcggccccaacctactgaattggagaccctgaagatggggctatctgaattttaacaaggcctccaggtttgcatgctcaagattgagaaccactggcaaaagcaaacaatttgaatctgaagtcagcccacctgcatttgaatacaggccctgccacttaataactgtgatttagagcaagttagttacttaacagctaggttgaccaattgtccgagtttgcctggcactatcctgatttcagcactgaaagtactacattatcgctgtggctcacgcctataatcccagcttctcaagctgtccctgtggaatcctcaatatcggtacattcatccctatctagcatccccttcctccctcacccatcctgcaccctcagaattcattctcagatcagcttcccagatttttgccaatatcaattaaaaaaattttttagccaaccatgtactgtgagtaagccaatatcaattagcaaaatctttaagtttcttttggtgattcagtatcttccccctggagttttttgatgattcagtaccctcctagatttggcccctggggcctgcggggatgtgacttgtcatttaattctggagaaaatgaggggtagggcttataaggagactccttcggggcagggtcattacagggtgtgttacatagggaaatgctagctgctggctagctctcgctcttgaaaggctcttcctccctcaactgaaatggggaagggggaaccccggccgactgaggtcctgacatctttagcacatggcttcttaggtcacccagggcatccaggttaccagcttgggaaacaggagatgtaggttggaggaagaggctacagcccaccctggaaataactgccatccgtcccacccatatggttaggctttgtgtccccacccagatctcatctcgaattacaatccccacgggttgagggatggaccaggtggaggtacttgcatcctgggggcagtttcccccatgctgtgctcgtgacagtgagtgagttctcacgagatctgatggttttaaagcgtggcagttcctctttctcgtgcttacatcctcgtaactatcctgtggagaaggtgtctgctttcccctacctccatggttgtaagtttcctgaagcctccccagccgtgtggaactgtgagtcaattaaacttctttataagttacccagtctcggtgtttgcttttttgagatggagatttgctcttgttgcccaggttggagtgcaatggcgtgatctcggctctttgcaacctctgcctctcgggttgaagctattctcctgcctcagcctcccaagtagctgggattacaggcgtgaaccaccacacccagctagttttgtatttttagtagagagggggtttcattatgttggtcaggctggtctcgtgctccaagcctcaggtgatccgcccacctcggcctcccaaagtgctgggattacaggcatgagccaccgcacccaaccttggatgtttctttatagcagtgtagaaacagactcagccgtcgctgcaggccatacctcagctacatagaacacctaactgcccgcaagggagttcctgctactaggatcttcagagtgacaaagaggaagctttggctggcaagggtggtggggaggggaggggctaggtacctaaggcttccctatctttccacacagcctaattttcatagcctctggtctccacatttcactctttcccaaataaagaccttttaaggtgtgggtccccttggtcattctgtaaccattggatcaagttttcagttttttctgctctctcagctgcaaaataacacattcgagttttggtttttttttttttggagacaaagtctcactctgtcgcccaggctggagtgcagtggtgtgatctcagctcactgtaacctctgcctcctggatataagcgattctcctgcctcagcctcccaagtacctgggattacaggcacccgccaccacacctggctaatttctgtatttttagtagagacggggttttgccattttggccaggcacactcgggttttctaaccataccttgagccaagaatttggattctgagcttgtcttttcatttaagctatgtggcgctgttagcatgaccgccctgcccagcagatcttgacttcagtgtaatctttattctcttctatggcaggagccattaggtcccccaaagccttgcctttgatgggtactttgttcccggggacaatgggattagctgtcttgccagggcgtgccatggggctgctggtgtcctgtcccttaataccagctggattttcactgtcctctgaccactttccagccttcaattgctcctgtttcctttggggcttcttgctctgtccagtcctggtcctatttttgtgagaatcaaggttcttagttttaaccaacagaaactaattctggcaactctaaacagaaagggacttggtcagaggtcctggctagttcccaggagctcaaaagggtcagaaaatcaaatcaggaagaggacattgggcaaagctggccaggtgaagaccccacagcctctgctggcacagaagctacaattggcaccaccgaagtgggacagaagctgccacctgtgcaagctagatgtagtcgctgccgctgtcaccatcaatttttgagatgatgcttcttcctgcctgccactttaattcaaagcgaaggccaggtgcagtggctcatgcctgtaatgccagcactttgggaggccaaggcaagaggatcgcttgaggacgggagtttgagatcagcctgggcaacagggtgagaccccgtctagccaaaaaatacaaaaaaaaagagctgggcagaaagaaaatggctcatgcctgtaatcccagcacttcaggaggccgaggcgggtggatcacctgaggtcagaagtttgagattagcctggccaacacggtgaaacactgtctctactaaaaatacaaaaaattagtcaggttgggtggcgcacgcctgtaatcccagctactcaggagactgaggtaggagaatcgcttgaacccgggaggtggaggttgtagtgagctgagatctcaccattgcactccccgctgggtgacagagcaagactagtctcaaaaaaaaaaaaggggccacgtcgatggaaggacaagaataaagaaactgaggccgggtatggtggctcacgcctgtaattccagcactttgggagtccgaggtgggcggatcacctgaggtcgggagttcgagaccagcctgaccaacatggagaaaccctgtctctactaaagatacaaaaattagccaggcatggttgcgcatgcctgtaatcccagctattggcgaggctgaggcatgagaatcacttaaacctgggaggcggaggttgtggtgagccgagatcgtgccattgcactctagcctgggcaacaagagcggaactgtggctcaaaaaataaataaataaaaaatagagacattgggccaggcacagtggctcgtgcctgtaatcccagctctttggaagaatgaggtaggaggattgcttgagcccaggagttcgagggtgcagtgatcacgtcattaaactcccacttgggtgacagagtgaggagctgtctccccacccccatcccccaaaaaaagaaggtaactgggcaaagaagttatttttagtagagactggctttcatcatattggccaggctggtcttgaattcctgacctcaggtgatccacccacctcggccccccaaagcgctgggattacaggtgtgagccacggtgcccaacctcctcttctcatttaatcctcaaaatcatctcacaaagcaggtgctattaatacccgcgtcttacagaacggttaacagatgtgtccagggccgcatggagaacaccttgagagagcaatgagatctcgctctcctgcctcatgaccgatacacggtttcaagaagttagatgacatcacagatactcagggcacccagctccaggccttactgccttcgcacaaggccgctctctactagcttcaccccgcatggaatgcaatggtcaatgaggccctggtcagaacatgggactgacaaagccagcacttgtaggctgagtctcagatcacgtggcttgtttgttttgtttgtttgtttttgggagatggagtttcactcgtgttgcccaggctggagtgcaatagcaccgtctcagctcactgcaacctccgcctccttgttcaagtgattctcctgtctcagcctcccgggtagctgggactacaggtgcatgccaccatgcctggctagtttttgtatttttagtagagatggggtttcatcacattggtcgggctggtttcgacctcctgacctcaggtgatccacccaccttggcctcccaaagtgctgggattacaggcgtgagccactgtgcccggctggcttttttttttttttgaggagtcgcactctgaaatccaagctggagtgcaatgatgtgatctcccaccatgctagttgtgtttgttgttgttgttttttctttagtagagatggagtttctccatgttggtgaggctggtcttgaactcctgacctcaggtgatccaccccccacctcggcctcccaaagtgctaggattacaggcgtgagtcaccatgcctggcctcaatttcttgaaagacaaagaaaaaagacagaaagagagaaagaaagaaaaagaaaaaaaagagaaagagaaagagaacaagaaaaagagaaggaaagctccatgggtttaaatgcaagagtcagcttcaaggagggctgggaagtcaggtgacgccacccttgtgcttcccgcagccagatcacctggtggaggtaccgttggttttgggcccctctctcagcacttgctaccagagaggacagctctacaccagagagtgagggtgggaacctgctcactgctgtctgctcagggctgggcatgaggcaggtgctcagtaggggtctggagaataaatgaatgaaccatcacggggccaagcacctggaagcgggctggagatgcttgctctggactcctggctcaggagtggactccccaggtggacttcctcctgcatcaccacagctgagtgcatggagcacaggtagggcagctaatgagcagggtcatcatgaatgacagcagatgacaccaggacaggggaggtcagtagccagatgggaagaaagcagaatgaaacaggtcacccgggtgcagtggctcatgcctgtaatcccagcatttcgggaggccgaggtaggcagatcatgaggtcaggagatcgagaccatcctggctaacacggtgaaaccctgtctctgctaaaaatacaaaaaattagccggacgtggaggcgggtgcctgtagtcccagctactcgggaggctgaggcaggagaatggcgtgaatctgggaggtggagctagcagtgagccgagatcgcaccactacactccagcctgggcgacagagcgagacagtctcaaaaaaaaaaaaaaaaaagttctggcggagagtgtgggtgagcactagggtactggaaagattccatgcctgggaatcgtgcgtggattgattacatccccacttctggcaaaatgcttcatggccttgtgcaagttaactttgtctccctgggcctctgtttactcatctgagaaacggggtaaagacatttgctcttcttaggtcacagggctcctgtacacgatgtgaaaggactttggaaagtatcctccggtgtgcaaatttctctgagaagtgctgtggctgtttatccttagactggaatgagaagggggagatgtgacttttgtgactttcagggtgggccaggtgttgtaggtgacaggacaatctcaggctggtagcagtggctcatgcctgtaatcccagcactttgggaggctgaggtgggtggatcacttgaggtcaggagtttgagaccagcctggataacatggttaaactccatctctactaaaaatacaaaaattagccaggttggggtggtgtgtgcccggagtcccagctactcaggaaggtgaggcaggagaatccttgaacccgggaggcggaggctgcagtgagccaagattgctccgctgcactccagcctcagcaacagagtgaaactccatctcaaaaaaacaaagacaatctcagatgtgcagttcacaccctggggctctccgtgggatcaggctgagggtcgcatttaactgaaatcttcaggagttcagcgtcggggtagatattccctgagaagcagctgagaggtaaagcttcctccgggaagtactcacttgctccttgttgatttcatggggtctcaggtttcaggaggaaagtaaagatgaaaagcccttgctctggcatcttggaggacttctgggtgagagccaggaaggggaaggcgtttggactcattgccctcccaggcctggagtctgattttcctgctctgtctggttttggaggtggaggctgcgaagccgaagcagtgctggtcctgccagctcctcccagctcctcccctgccctctgcttccctggccttgcacagggacaaggagctccaaagagcggctctgtcctgtctcagcctgggagggaagagggaggtggcatagatggttccacaaacagttcagtacgtgccaaaggagggcctgggaagccccaggtcaggagagggtgcctgcccttcccgtgaaggccagggctgagctgcttcctgccagcatccagttttgctcagagcacccagaacgccgtcttggaggaacgggggcaggcgctgccgcagaaccctggagctgtgtctcctgcctccagggctggccgtagctgcaaagaccagctggcaggtggaggactcaggaagactctccctgtgttggccctgcagccccatgtccccttctctgcttcttgggaacaggaggcctgtgtctgcctgtcctgagcatctcaaaaggaaaagctattctagggatgatgagagggaatcagggcctgaggcacttggaggaacatttgctgagctccctgtgcaacagcccattccaaggccaaggttgcaaaggtggcttagatgctgtccctaaatggccatcgaggttccaagcctggcaggaagggctcgagtggtggggccacagcggagacaaggccaagcagcctgattcttgggagtggaggttaatgagcagcgtttgcacttggctttctatagggtcaggctgtagtgcaacatcctgaggtgcgtggctgcccacaggtgctcagccagcccagcctctgccaaggcagacagagcctgggctgggaagcgggggatcccactgcttggggagtccccttttcttctgcatagtggggatgccaggagcagtgaacaagctcagcaaagagttctccagcccgacccgaggtttccttcctcctgactttgtcacctcactgggagaatatacagctctgtctgaaacaagtttcctgcggggcaccctgtgcaggggaagctcgggcagcccaacctaccagatggaagggaaagatagaggctgtgaggttcttctgggcctgtctacagcctcttctacctggctgccctttgttcagagtaaaggatgcagttcccaagacataagcaccgcgggcttcagagtatgaaggatccttccaggtcagccactttgggcaactggtgagcaaggcgggtgtgcagggccggctacatcatttgtggggcctggtacagaatgaaaatgtggggcccttattcagaagttactaagaatttttttttttttagatggaatctcactctgttaccccggcgggagtgcagtggcacgatcttggctcactgcaacctctgcctcccgggttcaagtgattctcctgcctcagcctcccgagtaggtgggattccaggtgcccgccaccacgtctgggtaatttttgtatttttagtagagacagggtttctccacctggctggtctcgaactcctgacctcaggcgatctacctgccttggcctcccaaagtggtaggattacaggcatgtgctaaaaatttcaagatgaggacagcagagcataagtgaagcgcaggacccttgcaagtgggtccgtctgggtgtgactgcatttggggagaaggggatggggtcctgcctgtccctgcagtcacagcataccacgagtcctggggcagaggagcctggattcaggcccttggtgctcagcggtcctggctcacggacacccctcgttcagcagccagggggttcctcactgtgtcccagatgtcactctaaagattgcttcagaggctccctccccgaatcgttggagggactctgccagttccaatgaccagccagctgccttcaggtcacaaaagaatctggggctggtctgagaccaggtgtacccccagaccccatctctgtccagatcatgagagggggtccagggtcccccgcctcccacagttgggcttcactgcacagctggaactcagccaggcctgttccgggaagcagggctgtgagtgtgagcagtccaggaccttggcattttgaacaaagaattgaacaaaacccacaaagtaacatagcaatgaaacatgggaaggaagcagtgaaagcaggaatttatgaaacagataaagcactctgcagggctggagtgggcctaagcaagcggctcaagagcctggttacaaagtttcctaggtgttttgttagtttgtttttgtattttattttttttattattattatttttgagaagtctcttacccaggctggagcgcagtggcatgatcttggctcactgcaatctccgcctcctgagttcaagtgattctctggcctcagcctcccaagtagctgggattacaggtaagtacccaccacgcccggctaattttcatattttttgtagagatggggtttcaccatgttggacaggctggtcttgaactcctgacctcgttaatcggcccacctcggcctcccaaagtgctgggattacaggcacgagccatggcacccagcctcctgggttttaagtactgcttttgaggttctattggctaccccttatctggatgaaggatttggtctgtggctcataaaaggctaatgtgaactggcgccctgtgcagatgaagggatgacccatgcttcgcctgcggctaatccaggacactctcccttcccatctaagatgtggtggagacaggagggtgatagggtgtctctatattaaaaacacacacacacacacacacacacacacacacacacacacacacacacacacacaaaggcagccagactatgcactaggaactgccctgggaatcccgttgcgttctcacaacaatcccacttcacagataaagaaaccaaggcacagaaatattcagtaacgtgtccagatgcggtggctcatgcctgtaattccagtattttgggaggctgaggcaggcagatcacgaggtcaggagttcgagaccatcctggccaacatggtgaaaccccgtctctactaaaaatacaaaaattagctgggtgtggtggcaggtgcctgtaattctagctactcaggaagctgaggcaggagaactgcttgaacccgggaggcggaggttgcagtgagccgagatcacactactgcactccagcctgggtgacagagcaaaactctgtctggaaaaaaaaaaaagaaaaaagaaatactaagtaacttgtctgaggccacttagttaccaagacgtgggagctgggacttgaacccaggcagtctggctggattcatgcctgcagcctctgcactcctgctacttcctgtgtgagaagcgcctgttctgtggaaggttgtgggctgagatctttccatgacttccactcatttacccccaaggctgttcttaaagacgggcatgacagttatgcccattttacagatgggaccctgaggctcacaagggcatgccactcacccatctccacaaagctatagctcgtcagcagagggcagaattcggccgcctctcccctagctcgaaggctgtgattgacacagaggtttttttgttgttgttgctgttgtttgttcctttttcttttttttttgagacagggtcttgctctgtcatcccggctggagtgcagtggtgcgatctcagctcactgcaaactctgcctccaagatgcaaatgattctcgtgcctcagcctcccaagtagctggaattacaggtgtgcactaccatgcccagctgttttttgtagagatggggttagtagagatttgtttaatagagacgaggtttcaccatggtctctactaaaccctgtctctactaaaaatacaaaaattacccaggcgtggtggcacatgcctgtagtcccagctactcaagaggctgaggcaggagaatcactcgaacctgggaggtggaggttgcagtgacccaaaatcatgcactctggcctggggtctcgcttttgcccaggttagagtgcagtggcacaatcatagtggcttactgcagcctcaaactcctgggctgaagggaatcctcccacctcagcctcccaagtagctaggactataggcatgtgccatcatggcgagttaattttttgtgtgtttttattttctcgagacagagtcttgctctgttgctcaggctggactgcaatggcgtgatcttggctcaccgcaacctccacctcctgggttcaagcgattctcctgcctcagcctcccgagtagctgggattacaggtgcgtgccagcatgcctggctaattttgtatttttagtagagacagggtttcgccatgttggtcaggctgctctcgaactcctgacctcatgatccacctgcctcggcctctcaaagtgttgggattacaggcatgagccactgagcctggcctggggagctaatttttaaatttgttatagagacaagagagacaagagtctctcttatgttgcccaggctggtctcgaccccgtggcctcaagtgatcctcccacctcagcctcccaaagtgctgggattacagatgggtgtcaccgcagctggcctctgaggagggtttcattataaacctgccctgaagggagggaatccaattttacgagagggtgtagcctggtgaggcctggatgacctccgcaggcaggggcttgtgcctgggctgaggcctaagggacaatgggcagacatgaagttgccccaggcagagggtacagtgtgggcaaagtcaggaagtggcagggcttggatcactccaggaagagagaggactcacgtgtcacaggagctcgagacccagagagagagtgaggcaggcaggcagggaccaagcttgggcacagccaggaaggcaggacagggcatggtggggccaatggaatcattacccaagacgggcattttcagggaaacagcttagataaggccaggcgtacagtagctcccacctgtaatcccagcatttggggaggctgaggtaggaggactgcttgcgcctgggagttcgagaccagcctaggcaacatagtgagaccccatatccacaaaaaatttaaaaaaggagtttgtgttcctgtagtagcatacttgggaggttgaggtggcagtatcacttgagcccgggagttcaaggctaaagtgagctgattgagccattgcactccagcctgagtgacagagagatacgctgtctcaaaggaaatacaaattaaaaaaccagccgggcatgctggtgtgtgcctgtagtctcagctacttgggacactgaagtgggaggatcgcttgagcccaggagttcaaggctgccgtgagctatgattgtgcctgtgcactccagcctgggcgacagagaaagaccctgtctcttaaaaaaaaaaaaaaaaaaaaaaaatcttagaggatgctgtgcctccctgggggtcttcagtcacccatggtcctggcagcagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcaccaccatgccacccaccccgagtatcccctgggcatcctggcatagccagatgacttccgtgcccgttgcaataaccactgcttccaactctctatagaccaccccttgggtatatctaatgtaagtgatatttattttatttattttttgagtcagagtctcgctctgtcacccaggctagagtgtgctgatgtgatcttggctcactacaacctctgcctcctgggttcaagccattctcatgcctcagcctcccaagtggctgggactacaggcatgcaccatcacgcccagctaatttttgtatttttttcagtagaggtggggtttcaccaagttggccgggctggtctcaaactccccacctcaagtgctctgcccgcctcggcctcccaaagtgctgggattacaggcatgagtcgtggtgtctggccctaatgtgagtgatctttaacaatgaagacttgaaaaagaaaaccctgaagaaacctaattctttgatgtctggacgacaaggaagaagatagatagaagtggcatcagataataaacagtgtaaatgtttatcagaaagaggctggtggttgggaccagtaggaggatcgcttgagtccaggagtgcatctctacaaaaaagttaaaggattttttaacattggccaggcatggtggcacacatctgtgatcccagctacttgggaggctgaggcaggattgcttgaagcccaggaggctgaggctgcagtgagctgtgatcgagccactgcactccagcctgggtgacagagcaaaacccagtctcaaaaaataataataatattttacataaccaaccacttctaaagactaaaaaaaaaccctacaattaaaaacctcaggtccctcaggcaatcataccagatattgaaacaaagcaataacataaggactgcagtatttattttatttttatattatttatttattctttgttagtttgtttttggagtgtgggttttgttttgttttttgatttttttcttttgttccacccacagatttcttcttattgcccaggcttgagtgcaatgacctgttctcagcttactcaacctctgcctcttgggtttcagtcatttttctgcctcggcctcctgagtagctaagggaggagtcttgagattatcatccacggagggtggaagaggagagggtggaaggggaataagaagacactccagtgaagcacttgccttgcgtgcaaaaatgtaagggggcctctccctctccctctccgtctccctctccctctccctctccgtctccctctccctctccctctccctctccctctccctctccctctccctctccctctccctctccgtctccctctccctctccctctccctctccctctccctctcactctccctctcactctccccacggtctccctctcatgcggagccgaagctggactgtactgctgccatctcggctcactgcaacctccgtgcctgattctcctgcctcagcctgccgagtgcctgcgattgcaggcacgcgccgccacacctgactggtcttggtggagacggggtttcgctgtgttggccgggccggtctccagcccctaaccgcgagtgatccgccagccttggcctcccgaggtgccaggattgcagacggagtctcgttcactcagtgctcaatggtgcccagactggagtgcagtggcgtgatcgcggctcgctacaacctacacctcccagccgcctgccttggcctcccacggtgccgagattgcagcctctgcccggccgccaccccgtctgggaagtgaggagcgtctctgcctggccgcccatcgtctgggatgtgaggagcctctctgcctggctgcccagtctggaaagtgaggagcgtctgcgcccggcagccatcccatctaggaagtgaggagcgcctcttcccagccgccatcacatctaggaagtgaggagcgtctctgcccggctgcccatcgtctgagatgtggggagcgcctctgccccgccgccccatctgggatgtgaggagtgcctctgcccggccgagaccccgtctgggaggtgaggagcgtctctgcccagccgccccgtctgagaagtgaggagaccctctgcctggcaaccaccccgtctgagaagtgaggaggccctccgcccggcagctgccccgtctgagaagtgaggagcctctccgcccggcagccaccccatctgggaagtgaggagcgtctctgcccggcagccaccccgtccgggagggaggtgggggtggtcagcccctgcctggccagctgccccatccgggagggaggtcgggggtcagccccccgcccggccagccgccccgtccgggaggtgaggggcacctctgcccggccacccctactgggaagtgaggagcccctcagcctggccagccgccccgtccgggagggaggtgggggggtcagccctccacccggccagctgccccgtctgggaggtgaggggcgcctctgcccggctgcccctactgggaagtgaggagcccctctgcccggccagccgccccgtccgggagggaggtgggggggtcagccctccgcccggccagctgccccgtctgggaggtgaggggcgcctctgcccggctgcccctactgggaagtgaggagcccctttgcccggccagctgcccagtctgggagggaggtgggggggtcagccccctgcccggccagctgccccgtctgggaggtgaggggtgcctctgcccggccgcccctattgggaagtgaggagcccctctgcccggccagccgccccgtccaggagggaggtggggggggtcagccccccccgcccggccagccgccccgtccgggaggtgaggggtgcctctgcccggccgcccctactgggaagtgaggagcccccctgcctggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaagaaaattaaaaaaaaaaaaaaaaaaaaaacaggctacctacaatttgtgttgaagatatgaatgaatgaagtttccacacccttatgtggagttctgataagtaagcaacaataaggaagggtccccaggttggggagaccccaagttgagaacaataatgaacaattattgtatgaacaattgttagagacagctaatcacaaacaacctgcgggcacaatgaccccattccacacgtagcacccttcagcaggaccctataaaactctcctccagcccttgcctctttgcaggtagccccttctgtgctgagctgcccattgcaacatattttcataatttctctaataaatctgcccttctttacctacaactatcttggtaaatggctttaccacctgcaaaactgaccctaggttgttgctacccgatatggtttggctgcatccccacccaaatttcatcttgaattgtagttcccataatccccatgtgtcatgggagggacccggtaggaggtaatcgaatcatgggggcaggtttttcccatactgttctcgtgatagtgaatacatctcactaaatctgatggttttataaagggcagtttccctgcacgtgctctcttgcctgctgccatgtaagacatacctttgctccttctttgccttccaccatgattctgaggcctccccagccttgtggaactgtgagtacattaaacctctttttctttataaattgcccagtttcgagtatttcttcatagcagtatgaaaagtaactaatacactacctgagacaccttaggagatttgtaatagctgtaatgccaggtccaccatatttttagcataaagcaaatgtttacccatgatatgactgcacaggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccgtctctacaaaaaatacaaaaattagctgagtgtagtggcacacacctgtagtcccagcaccttgggagggtgaggcaggaggatctcttgaacccaggaggtggaggccgcagtgagcagtgatcatgtcagaggtgtgtgaaccagagcaactccatcttaaataggagctgggaaaaatgaggctgaaactgctgggctgcattccctgatggttaaggcattctaagtcacaggatgacatagaaggtcagcacaaaataccagtcgtaaagaccttgctgataaaacaggttgcagtgaaggagctggccaaaacccaccaaaaccaaaatagtgacaagagtgacctcccatcatcctccctgctacattcctacaagcaccatgacagtttacaaatgccatggcaacatcaagaagttaccctatatggtctaaaaagaggaggcatgaaaaatccaccccttgtttagcatatcatcaagaaataaccataaaaatgggcaaccagcagccctcacggctgctctgtctatggggtagccattcttttattcctttactttctctttttcttttgagatggagtctccctctgtcacccaggctggagtgcagtggtgcgatctcggctttctacaagcttcgcctctcgggttcatcccattctcctgcctcagcctccagagtagctgggactacaggcgcccgcaaccacacttggctaatttttttgcatttttagtagagacgaggtttcaccatgttaaccaggatggtcttgatctcctgacctcgtgatccacctgtctcggccccccaaagtgctgggattacaggcgtgagccaccccgtgcccctcctcctttactttcttaataaacttgctttcacttcacactgtggcatcaccctgaattctttcttgcacaaaatccaagaaccctctcttggggtctggattgggacccctttcctgtaactatcatgccactgcactccagcctgggcaacagagcaaggccctgtctctcaaaaaaaaaaaaaaaaaaagtaacgtgacttaatacattcattttggagggtaagtctctcaaaataggcctttcactgggggaaaatggtaaaaatactccctggtaattcaagaattggagactcctgagatgctgctcatattagctgaacacttatcaatacttcactttcttccatatatactcaaggaacaagtgctatttaaagtgtttcactctgctgtgctaggtgcaagactataaagaggtgtgaggatcaacacttttatgaaaaccaatgtcattctgaatatagtttcagatgctagtgcaaaggaagctcttggtatacggaaaaagtattcaacaataaattaggcatggttgcttccattttctgcctcacatacctttttttcatggttaaagtgatataaagtctatgatattttagattggcagttgcaaactagtggtcctcagcgtgctttttatgacacctacaaggtttgaagactctgatttcatattaaaaatctgggtttcaggctgggtgtgatgttgcatgcctgtaatcccagcactttggaaggctgaggcaggagaatcgcttgaaccagggaggtggaggttgcagtgagccaagatcacgccactgcactcaagcttaggcaatagagcaagactccatctcaaaaaatgaataaataaataaaatctgggtttcaggccaggtgtggtggtgcactcctgcaatcccagcactttgggaggctgagatgggcagacagcttgagctcaggaattccagactagcctgggcaacgtggcaaaaccccatgtctacaaataatacaaaaaaattagctgggtgtagtggagtgtgcctgtaatcccagcaacgtgggaggctgaagtgagaggactgcttgagcctgggaggttgaggttacagtgagctgagatcaccctcctacactccaacctgggcaacagagccagaccttgtcttaaaaaaaaaaaaaaaaaaaaaaaaattctgggtttctggcatctcaaaaaaaaaaaaaaaaaaaggaaaggtcagggcacatggctgctacagtcctctattaagcaatgtgccacagcaggggtccctgacccctgggccatggacatgtactggtctgtggcctgttaggaactgggccacagagcaggaggtgaatggtgggtaacaattgaagcttcgtctgtatttctggctgctcctcattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagttccctatagactttgcttcctaccgtcttacgttctgccttataggcatctcagtttgcaacccttgtttttgtcagtatgctacgctggtgacattgaccaaattgaccacacattaatgataagcttagttggtgatgacctcaacggaataacgtgacataagtattgtgacaatacttcttgcatgtatctacaggtggaattgtaaacctggtggtccgagatggtctaattcgatcttcctatgtatctccttatattaatagtggtaacatttgtggtggtgattcagcgtttcaatgcctcttctcacggcaacaacaaacgttttccttctgaatcaacattaacctagatgttactgcagatcaaaattagtatctacattttcaaccacagaaatattgggcagtaaaaatttttcttaatattgattgcctacataggttgtgtaattagcatatgtttatagttctatgatttgtgcctggctgctacagagctggagggggtaaagcaacagtgttttctcagttgtgtgagcagcattacattataataaataggtaatattaaactgggctgatgagagttgcaaaagactactttaatgttcatatggaaccaaaaaagagcccgcattgccaagacaatcctaaacccaatgaacaaagctggaggcctcatgctacctgacttcaaactatactacaaggctacagtaaccaaaacagcatggtactggtaccaaaacagacatatagaccaatggaacagaacagagccctcagaaataataccacacatctacaaccatctgatctttgacaaacctgacaaaaactagaaatgtggaaaggattcccgatttaataaatagtgcttggaaaactggctagccctatgtagaaagctgaaactggatcccttccttacaccttatacaaaaattaattcaagatggattaaagacttaaatgttagacctaaagccgtaaaaaccctagaagaaaacctaggcaataccattcaggacatagggatgggcaaggacttcatgtctaaaacaccaaaagcaatggcaacagaagccaaaactgacaaatgggatctaattaaactaaagagcttctgcacagcaaaagaaactaggatcagtgtgaacaggcaacctagagaatgggagaaaatttttgccatctacttatctgacaaaaggctaatatccagaatctacaaagaacaccaacaaatttacaagaaaaaaacaaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaacacttttacactgttggtgggactgtaaactggttcaaccattgtggaagacagtgtggcgattcctcagggatccagaactagaaataccatttgacccagccatcccattactggatatatacccaaaggattataaatcatgctgccataaagacacatgcacacatatgtttatcgcggcactattcacgatagcaaagacttggaaccaacacaaatgtccatcaatgatagactggattaagaaaatgtggcacatatatactatgcagccataaaaaaggatgagttcatgtcctttgtagagacatggatgaagctggaaacgatcactctcagcaaactatcacaaggacaaaaaaccaaacaccgcatgttctcactcacagatgggaattgaacaatgagaacacttggacacaggaaggggaacatcacacactggggcctcttttgtggtgggggagggggaagggatagcagtaggagatacacctaatgtaaatgacgagttaatgggtgcagcacaccaacatggcacatgtgtacatatgtaacaaacctgcacattgtgcacatgcaccctataacttaaagtataatttaaaaaaataagtaaataaataaaaaaagaaacaattgctggctttgcaattctctttcctccaaaatcaccaaggcctcaatttactcattgctgaaaaaggacgactgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccacttcttagtcctttaatacctgtttttctccttctcttattcagaccgtgtgtcttctgtttagtttctcaattcatacaaaaccatatccaggccatcaccaataattctatatgacaaatgctccttctaacaaccccacagtatcagcccttaccccaaaatctttcttcagttgaatctctcccactgtaggttcccatgccgcccctaatcccgctcgaagcagccctgagaaacatcgcccattatctctccatatcacccccaaaaattttcgccaccccaacactttaccactattttgttttatttttcttattaacataagaagacaggaatgtcaggcctctgagtccaagctaagccattaagccatcatatcccagtgacctgcatgtatacatccagaaggcctgaagcaactgaagatccacagaagtgaaaacagcctcaactgaagacattccaccattgtgatttgtttctgccccaccctaactgatcaatgtactttgtaatctgccacactcttaagaaggttctttataatctcccccacccttaagaagtttctttgtaattctcctcacccttgagaatgtactttatgagatccacctcctgcccccaaaacattgctcttaactccaccgcctatcccaaaacctataagaaccaatgataatcacaccaccctttgctgactcctttttcagactcagcccacctgcacccaggtgaaataaacagccatgttgctcacacaaaacatgtttggtggtctcttcacacagacacgtgagacaggagttcgagaccagcctagccaatctggtgaaactctgtctctactaaaaatacaaaaattagccgggcatggtggcgggcacctgtaatcccagctactcgggaagcggaggcacaaaaattgcttgaacccaggaggcagagtttgcagtgagccaagatcacactgtctggcatctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactgttcaatatactttgtaatctcccccacccttaagaaggtactttgtaatctccccaacccttaagaaggtcctttgtaattctccccacccttcagaatgtactttgtgagatctacccctgcccacaaaacatggctcttcaccccctatcccaaaacctgtaagaactaatgataatccaccaccctttgctgactctcttttcggactcagcccgcctgcacccaggtgaaatgaacagccatgttgctcacacaaagcctgtttggtggtctcttcacacggacgtgcatgaaacacacgactgcacttcaggctgggcgacagagctagattccatctcaaaaaaaataaaaaggagtcacctcccctgagaggcctctggaccaacccatctgagcaggccactcttccttctctatcttaccatcttgtttctgtcccagtagttagggctacctccagtaatcctatttgtccctttactgtttagtgcgtctcacttgactagaagctccatgaaagcagagatcctacctacctccttcaccactagacccccagggcctggtatgtggtgatcgctcagggcccattttcttcctttcctcctcctccaagggtggggaaagagcatcagaaggtctaggtggccccaggcccaaacaatcctcctttaaaaggaaaccagattgttacaaaggtcagaggctgaaaagttatttccgccttttatccctctaaattcttcacttcctgaaaaaacaaacaaaaaaaagccactgagggcccttggactaaatccaggcctgagttgctgggcagaggtcagtcttgtccagacatgggaaaaaaataactcgagtcagacaggtgggtcaccagagaacgaatccagcctgcaaatggtgtgtgcaatcttcagctctgtccagacctgcctccctctggggatgcctttaaaggtgatgaatgacctggatgaatgggcttagaagagggaaaaacaaatatcacaggtcaaatcattatttgtcttcaagtttaacaccgtctactggactgaaagatgtccaaagaatagttgttcaactatgtaaattcctttttttttttttttttgagacagagtctcgctctgttgcccaggctggagtgcaatggtatgatcttggctcactgcaagcaacctctgctcctgggctcaaaccattctcctgcctcagcttcccaagtagctgggactacaggcatgtgccaccacgctcagctaattttagtattgttagtagagacagggtttcatcatgttgaccaggctggtctcgaactcctgacctcaggtgatccacctgcctcggcatcccagagtgctgggattacaggcatgagccactgtgcccagccaactacataaattcctaacaacgtatctccagaaagtataggcacaacagcacatgcagtcattcctgtaatcaggtgctccgggaggccaaggcaagaagatcccttgagcccaggagtttgagaccagcctggacaacatagcaagactgtgtctctataaaatatacaaaaattgggctgggtatggtggctcatgcctgtaggcccagcactttgggagaccaaggcaggaagatcgattgaactcaggagcttgggaccagcctggacaacataatgagacccagtctctactaaaactcaagaaaattagccagatgtggttgcatgtgcctgtagtcccagcactttgggaggccaaggtgggtggatcacctgaggtcaggaggttgagaccagcctggccaacatggcgaaaccccatctctactaaaaatacaaaaattagcccggtatggaggcatgtgcctgtaatcccagctacttgggaggctgaggcaggagaatggattgaacccaggaggcagaggttgcagtgagccaagatcgcaccactgcactccagcctgggcaacagaacaagactccatcaaaaaaaaaaaaaaaaagaaagaaagaaagaagaaaagaaaattagccaggtgtggttgcatgcacctgtagtcccagcactttgggaggccaaggcaggaggatcaatcaaggctaggagtttgagactgcagaaggaaaccctgtctctaaaaacaaggtccagctaaaatcagggtccagctccaccacaagcgcagctccagggtctgttgagttttgcctctaccattccaagtagtccctgctccagaccaagtcccaccatctggcagtcaggtcagtccaaccacagtcatatcagggcgcttcccggttctttcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaagcaaagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaggctaaggcaggagaatcgcttgaacctgggaggcagatgttgtggtgagccgagatcacgctaccgcactccagcctgggcaacagagtgagactccatcaaaaaatagtaataataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagaaacccaacaggaaaaggaagagactgctctatggccaggcacggtggctcacacctgtaatcccagcactttgggaggcccaggcgggcggatcacgaggtcaggagatcgagaccatcctggctaagacggtgaaaccctgtctctactaaaaatacaaaaaaattagccgggcgtggtggtggatgcctgtagtcccagctactcgggaggctgaggcaggagaatggcgtgaacccgggagacggagcttgcagtgagccgagattgcgccactgcacttcagcctgggtgacagtgagactccatctcaaagaagaaaaaaaaaagaaccaagaggagtccaggagaagagaacagcagatgcaaaggccctgaggcagaaacaatcttggtatgcgggaggaataggaaggcagccagtgcagctggagcaggataggttaagagaggatcaaggtgatgagggcctggaaagaggggctggggtcaaatcaccagatcctgttggttgcaatggaagagcctggagtttattctcagggcagtgagaagccactggaaagttgttttttgtttttctgtttttgagacagagtctagctctgtcacccaggcagactgcagtggtgcaatcttggctcactgtaacctctgcctcccaggttcaagcgattctcctgcctcaggctccccagtagctgggattacaggcacaggccaccacacccatctaatttttttttttttttttgagacagagtctctgtcacccaggctggagtgcagtggcacaatctcagctcactgcaacctccacctcccaggttcaagcaattctcctgcctcagcctcctgagtagctgggactacaggtgcatgccaccatacctggctaattttttgtgtttttagtagagacaggatttcatcacgttagccaggatggtctcgatttcctgacctcgtgatctgcccaccatggcctcccaaagtgctgggattaacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctacctcagcatcccaaagtgctggattacaggcatgagtcaccatgcctggtcacacttctcattctttaaaccagacctcatttgtccacctcccccatcccccgccccaccccacggactgtcctataatgcccatacaacaggtcactgtttagaaagtgccacaaagttacaaacacagtcccttctgagcctcccaccaatgttggtgggtgcaaggtcaaaaaaaaaatctcatctatctaaggggcataggagactttttagttagagggcccaattatagtcctcctgaaaagatgccaaaagtccccttaaacacttagcaaagattcaagaaagatgaatctcacattctttgtatgggaaatgaggaacttgacatcttcaatataatagattccactaaaataagatgacgatcaataggaaccaactaaaaaaatacttgactagctgttattgaaaggctgaaattcagctgacataagcagtattaatattgagctagaaaataattcgcattgaattcagcccaacttttgttttctgatttgggtctcttctaaattttttttttcttctggacattgggaacaatccaatttgaaggcctcaatgcccaaatctacactcgttttattctatatccttggtttctttttttttttttttgagatggagtctcactctgtcgcccaggctggagtgcagtggcgtgatcttggctcaatgcaagatccgcctcccgggttcatgccattctcctgctgcagcctcctgagtagttgggactacagatgcccgcccccacgcccggctaatttttttgtatttttagtagagacggggtttctccatgttatccaggatggtctcaatctcctgacctcgtgatccacccgcctcagcatctcaaagtgctgggattacaggcattagccaccgtgcctggcccacacctgggtgatttttaaaattcttctagtagagacagggtctcactatgttgggtcaccgtgtttgatgtcagttttccctgacagaatctacaatctccttgatcaccattatatcccaacacagagctcagtacctggtacaaagcacatttgatcaatacttgctgaataaagaaataaaaatgaagaggcattccagcctgggcaacagagtgagatggtctcaaaaaaaaaaaacaaaaaaaaaaaaaacaaaaaatgactggaaaggagatgagggtacttgtgaagccatattatatgacacgctctgtgctaggacttttatataccttgtctcatctcttcatctcatataatccttacaagtatctcaaaagtggggaaatccccatataactgaagaggaaggcagttcagaagttcactgatttgccctaaggttcctcaatttgtaaacatcaggccaatgatccaaccccaggtatgtttggcagtgaaggaccagttgagtcatagctgcaagtaacaaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttatgttcagaacacaaaaataagtcttatgtcttcattaaaaatgggtgaagaatttgaacaaacatttgcaaactaaaatacaaatgaaatacactcaacatcattaatcatcaagaaaataaaattatgagataatcctaataatcactacatatgcaccacagtgattaaaatttttttaagttaagccacgtgacccaataaggtgcattcactcaagagaaacgcaaatatatgtccactcaaagacttgcacatgaatgttgagagcaggtttatactgaatagtgcaatgtgaaaaaaccccaaaatctagcaaagaatgaagggagaaataaactgtggtatatacatacaatagaacactactcaataataaaaaggattgtattcctgatacatgcaatatgggtgaaccttaaaaatatcatgctgagcaagagaagccaaacacaagagaacatgttgttatgatttcacgtacatgaaactttagtaaagacaagtctaatccatagtgacagaaagcaaatgagtaactgctgacagggccaaatgaggagatgatcccaagggaaccttctggggtaagacggtgttctgtatctcaatcgtattggtggtcacacaagtgaagacatgttagaactcatcaaaccatacacttagaatgtgtaatataaacctcaataaagcaaaatttaaaaaaaaaaacacctttaattttctcttacaaaaaaaaaaaggaaaaccacttaactttaatttttctccaacaactgattctggtacatagtataccttactgcctgcatccatggcctcacatcatgctgtttacatgaacgtaaagcttcaccgaagagtggaataagacagtcctgccagagaaaaaccaaaattactcaacgtaaaacaggctgttgatacgtttgcagatatatagcaagtcttaagtcaaagactgcaatatagtttggctacttcagattgattgcagtagttttatctattacactatacccttacatcatttatcttctactcacaagaggcaagcacacagtaagagaaagccttttgttttgaagggaaatcttcttcagaatattaagtctaatttatcaatatacttaataaagcacattacaaaaaaaaagtcacagcacatttactataaagcagactgcagaaaaacattacaactaatgctttataatgaagttctcgaagatcatcattcattcagaagcccccatctctggttgaactttaccccatttaggatgaagaggagagatctttgtttgcagcaaatctaaaatttacgtaatctgcctaaaggaactgtctttacatacaccacctcccactccaaaaatagaagaaaaaactgagcaatttgccatccttgcgattatctcaggttcttccatctgccccatgtacttcccaaatgaaagactgcctgaaaacagcatgttagatttctggatttaccagcttgcccaactacaaatcctatttcaaaaaactcaaaaaataaggtctttgttctacagtaatgaccattaatagtcataagaatgtgcttgtaaaaatatacagacctctgtttaaagtctgttagaaactgtgttctccaaagcaggtgagcaatacagctgcaaggtacttagaactggcaaagactgtgaaactgttaaagtagaaagtctcagaggtccaacagcgatgcgggatgtttgcttcaagtactttaccacatttctgaaacaaaatatttactgtcaattaataaaaattacaattcataaccactcaaagaataaagcaattgataagatgctatcaaactgacatccaaagttagggggcagtaagaggagcagcctgctctataataaaatgatattagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttatctccgtaagagtaacttactcagttatagactgccacttctgatcttgttctatcgggtttaaagcagttgccaaacaaacagaacttcttaacaattgaacttcaatggatttctgaggttcccttggatctggacttaacatgttacgaagcaggtttttcatgtctacagaagttaaatgaaatgtcattaattaatgtgcttttattataaattttgatttatgtttggcattattaaaaactaatcaccaatgaacagctcctttaatatttaaggcagttaaacactataagcattactgagagctatataaaaatcatacttcatacaaaattactgtacctcagacccctaaaaagcagttgccttcaaaggctcaaaaatcagtaagtcgaggccaggcgtggtggctcacgcctgtaatcccagcactttgggaggccaaggtgggtggatcacgaagtcaggagttcaagaccagcctggccaagatgatgaaaccccgtctctactaaaaatacaaaaaattagctgggcacagtggcagacacctgtaatcccagctactcaggaggctgaggcaggagaattgcttgaactcagaggacggaggttgcagtgagccaaaatcccgccactgcactccagcctgggcaacagagtgagactctgtctcaacaaaaaagaaaatcagtaagtcaatctactatttaagggaacaaatctagacctgcattagcaaatcttgctcaatccagaatactcattaaactttttaataacattttataaagtgttccatttgtgataaagaacttaatgagccacatcaagatgaaaatcaagaaaaatatttagctgaaacactactttgtcctttatcaaacaaaatggctagataaatctcaaagcattaaggtggtcatttttttatttgacttaattttaagtgcttttcatttcccaaatcaaacttaaatagggcagccctaaatttgttgcttcacatgggattctgccccccaaaaatgtaaaatgacttccagattttccagtaaaatatactaagccaaacattttgagcaacttgtccactaaaataactttaaaactattttctcaaatacctacctattttttcttttgatcctccagcaagtagattgatattttctcctggtaacaattctaattgctcagtacattcaacaaattttccagactcgaagctgcttaatgatctgtaattaaaatattggttagcttgtattcctacgcagcctgtggaaccattaaaaaaaaacaaacaaacaaaaacagaacaaatcctaggaagacagcaaagtacacagcatttttctgacaaaattccttccacgaggatgtcattattttggtttttatgttgaagatgtgactaccacttaattagtactcaaattggagtggcaaaccagaaagtcacagctacagactttcagtagagctgactcgcccctgtgtctccttcctgttttcatgtgttgcagcctgttctcttcagagcctaacacactgacagtagacctctgcaggacaactttgacacccagttctctccaagctgccagtgagctccttgtgcagcctcactcctcacctacagcatgagcccttgcagctctcccagcatcataatcttgtatctcagtcctggcttctttcactgctggcatccctccatctctccctttttcacctacttttcttttttcaaagaattcttctctttcatctgcttttatgaaaaataatgacacctctgaaattctttcctgtagtcctgcagcatcaatgccaggaagacaggcctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacattcgtcatttctgccattaaaaggtcctaagtcctctccagtgacaggttcctcaagtccccactatgctctataatgccctatgctttcagctaatgactcagtcctcagaaaaacaaacaaataaaaaaacacaggctttaatttcctctacccctacccccaatccaccatacactgccaaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatctccctccagcaatagcttcctatcctcgacttcaagaaaaactcactgaccaaataacttacctcaagcttttcattttcaaatgtctctaccactcaatagtattcaatctagcttcttctgtctctctacaaaactctttttccttataatccctagagcatctgacaaggctgactactcccatctggatgtcctatatctaggacacttcccttctcaatgtccctgtatttttttgaatggcttcctcttctatactttcacaaaaatgctaaactaggattctgacccaggccttccttcctcttcactcactattctccagaggcttctctctggtttggttgcttacaaaggctctagagtatagagactgaaaaggaaacagggccttttctgtgtactaatgatgtgcaaatctctcaagcttagactttctccttagttcaaaatccaattttttttttttaattgatcattcttgggtgtttctcgcagagggggatttggcagggtcataggacaatagtggagggaaggtcagcagataaacaagtgaacaaaggtctctggttttcctaggcagagtgtgtgtgtccctgggtacttgagattagggaatggtgatgactcttaacgagcatgctgccttcaagcatctgtttaacaaagcacatcttgcaccgcccttaatccatttaaccctgagtggacacagcacatgtttcagagagcacagggttggggataaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcctggacggggcggctggccgggcggggggctgacccccctacctccctcccagacagggcggctggccaggcagaggggctcctcacctcccagacggggcggcggggcagaggcgctcccatctcagacgatgggcggccgggcagagacgctcctcacttcctagatgggatggcggccgggcagagacactcctcactttccagactgggcagccaggcagaggggctcctcacatcccagacgatgggcggccaggcagagacgctcctcacttcccagacggggtagcggccgggcagaggctgcaatctcggcactttggggggccaagacaggcggctgggaagtggaggttgtagccgagatcacgccactgcactccagcctgggcaccattgagcactgagttaacaagactccgtctgcaatcccggcacctcgggaggccgaggctggcggatcactcacggttaggagctggagaccagcccggccaacacagcgaaaccccgtctccaccaaaaaagtacgaaaacccatcaggtgtggcggcgcacgcctgcaatcgcaggcactcggcaggctgaggcaggagaatcaggcagggaggttgcagtgagccgagatggcagcagcacagtccagcttcggcttggcatgagagggagaccgtggaaagagagggagagggagaccgtggaaaccgtggaaagagagggagagggagaccgtggaaagagagggagagggagaggagggagagggagagggagaggagggagagggagagggagagggagaggagggagagggagagggagagccaaaatccaattcttaacagcttacccaacaatctcatctgcacatttcattagaaatcttaaaacatagcttgttctctgtgtgctcctactccagttaatagcattgtttctcttccctctaccattgcccccacaaattaatggtctccatgcttccatacttgcccctcacctccagtctcttcaccatagcagaatgaaccaccaagtcagatcacaacacatctctgttcaaatcccacctgaaattttcagtcttactagaataacagccaaagttcttttctcagttcccagctacttctctgcccttatatcctactgtttaaggtgctcctaaacacacaggcctcccagctatttccagaacactccaagcccatcattctcacatcaggtctaggcccaaagggcatcctgatgggcatgccttgaccttgtgtcttccctccaaagaaggtcagctttacctaactgctttccttatggcacagaaaaggtgagtgaggtccaattaatccttctatcaataatctttatctaatctttgctttaaaaggttggaatttgtgtctgttttatgtgctgcctgggtcatagtatatgctcagtgaagcaattacacattaacccatttagcagtagaaagcaagggtatcagacaaagtctaatgacctttatcttcccagccaagtgtctgcaacagagtgagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaatcagtacaaatttttccttatattcactctggcataatcttcaaactctattaaggttttagaatgacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcatagttattggaaatttgttttataactggaaacagaaagccttactttatatagttgaattcagctttcaggttgagggaagtgctactggtactctttttcaagtcatggatagcattctgccattcctgcacagcagcgcaatcggcaattgagatgtagcactcacacatgctttatttcctaaataatttataacctcaggggaagagtcagtcggtttggacagcacagtttttctggattcacctgaaagtattttataaaataagaagagattcagatcaattagaaatatttcaaagagcacagaaacctaaaaacatgataagatcatcagtacaaaatatatcactataacttttgctttatttaaaaatactgaacgctcaccattcagacaatgtttcgggctggcactgttacacccagcattggctaaggtgagcaccaatttgtcaaagctggagatgcagcaatcaacacctgtcatggcacacaggtgctcctggtactccacagaggccttttcaaacctgaaaagcaaattgaagcagtcttatttctttatttatctacttacttactttcttttttgagatgaagttttgctcttcttgcccaggctggaatgcaatggcactgtctcagctcaatgcaacctctgcctcctgggtacaagtgattctcctgcctcagcctcctgagtagctgggattacaggcactcgccaccatgcccggctaattttcttgtatttttagtagagacggggtttcaccatgttggccaggctggtcttgaactcctgacctcaggtgatccgcctgcctcggcctcccgaagtgctgggattacaggcatgagccaccgcgcctggcctttacttacttacttacttattttttgagacagtcttactgtcacccaggctggagggcagtggcatgatcatggctcgctgcagccttgccctaccaggctcatgcaatcctccaacctcagcctcccaagtagctgggactataggcacccaccaacacacctggctaaaacaaggttttgctctgttggccagggtggtctcaaactcctggactcaagcgatccgctcacctcagtctccccaagtactgggatttcaggcatgagccaccgcgcccagccccaaaggaggctgttattttaaacacacatatctcatttcccccccccacaaaaaatggtgcaagaataaactgagctaaaacagtgagttgactatggtggggggaggtttgatgtcttcctcacaactgtgaaactaaatttaaaagtggttaaatgtttttaaaaaaatgtaagagtataaaagaactagtggaaaatattgataagtaactgatgtcagtgtgtggaaaggctttgtagaaggataaaatgcaagaaaagatgcacaagtaacagatctagatgcataatgctgaaatacaacactaaacattaaaaacaaattataaatcaagaaattggatagcatcaacaatcttagtatttaataaaatttcacagattaacacaggaaaaattgagaggccatgaagacatgatccatgttttaaaaaatcacaaaaggtcactatatggggcaacttctactattagtcattaataaatatagaaatgtaaagtacaataactattttcgctgatggtggtggcagcattcttgtttctcagtgactctcagtatccacaaagatgaagggaagggggtactctattattaagggtatacattgcagccatcttttctgtagagtaacttaccaatagaatatattataagacttatggtttggcagcctttcttctagtaaatcagtttatgagaatggattccaagaaagtaatcagaaatataagcaaagatattaagtgctatggtacatttagtaaaaaaaaaaatcagaaacaaccttaatgcccaacagtaagaaatattaaattatggtacactcataaatacaaacctttattaaaaataacactgtagaatatttaacatggcaatttttttttttttgagacagagttttgcttttgttgcccaggctagagggcagtggcacaacccgggctcacagcaacctccgcctcccaggttcaactgattctcctgcctcagcctcccaagtagctgggattacaggcatgtgccaccacaccccactaatatgttttgtatttttagtagagacggggtttcaccatgttaggctagtctcaaactcctgacctcaggtgatccacctgcctcggcctcccaaagtgctgggaatacagatgtaagccaccgaacccagcctacctaacacggaaaattttttttttttaaatattgagtgggaaaaacagatcataaaaccatgtgcctatgtacactgatgttttggtgaagaatggagaaaacgacatgaaagaaaaaagaattacaaagcatatggatatggaaatatgggactacaaaaggacacacaacagaagttactacaaagatatggaagtatgagcagttcttttatcttcctaaatttgcaagatttcattaaactaacataaatggacacagaatattatggtacaagctcctctacctggaggaagcaatgagtctgaatgtagagttcacaggactaatgagcaaatactctgacaataaagggtaatttgtatcagactctgagggggaaggagctcaactagggatcaagttcaaaagcgtttataaaacaactgacaggtcttgttttacagtgtgatttgccactaattcttaaataagaaaggcactccagtattgcggctaactaaagaacaaactgaagatgcctcctggtgaagtgatttatagcaagcttcaatgctgaaagcaaacaaagctgttttaagatttggctacaatgtcagtgagtaatacaaagaatttaaacataaagtaattctgtcacccatttccttccctccaacctacctcccttcagcctgttgagccactgagttaatccacagaagattttttccaacaatagatgatgaccagacagcaattccctgtatagcttcaggacaatgaagttcacatagtgcttctaccaccatcataatggttatttccaattcattcccctgaaaacgcattcagaaaagttagtcacccaataccattaaaacataaatccctataaaatttacaactgatcacagtctgtgcctgcttaaagccaaatgtatttaacaattattttcacaattttcacattatttagctcagaattctttaaaattttacatataaaatagccacaaagggtgactaacagaaccttagcagcacatggatgtttgtacccccaccccaaagttacccaaaaacatttaacctgtgacctctgtaggaataacacatggagtaaaaagaaagcaaaaattaaatataaataaacaggaattaaggaatgattaacttcatgtgtttgaatactgcttgacattacctgaattgctaaacattttgttatttttggattccagttatttattgtgagcccacttgcaagccaggaattactcaagcatttgtcatacgttataaaaacaatttctcctggccaggtgcagtggctcatgcctgtaatcccagcactttggaaggccgaggtgggcggatcacttgtggccaggagttcgagaccagcctggccaacatggtgaaaccctgtctctactaaaaatacaaaacttagccgggtatggtggtgggtgcctgtaatcccagggactgaggcaagaagaggcttgaacccgagaggcggagcttacagtgagccgagatcgcacaactgcactccagcctgggcgacagagtgaaactgtgtctcaaaaaaataaataaataaataaataatttcccccataaacaaattttcagaattacctttaaagttctaaactttgcacgtaagaaatatagttttaacgtgttctaacatgaatattgttttaacatgaacaaaaacatgaacattattttaacttctaacactgttttaacatgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggcaactggtatagaaaaaagctctaatgacctttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcccggaaaccaaccttgggaggtgaagttaatgcattagcacatccctcatatacattatacattaatttctccagattttccagatactgcagaagaagaacaagtctaagttggttgttaccatggccttcatcattgtctgcagttgtccactgactaacatcctgatcagggtttaatgtgtgagctgcgagacttcgaatgatacctgaaagcaaagacaacattctgaatttttaaaaatcttaaagttcctagaataagtgtgagttttttatgacaaattcacatttatcaagtatcctctgtctacccatcatttaaaaataaaaaatcccaacatgaaagatctttcattttaggggaaaaaatatatatatattttccacacaactcccataagttttggaaaaaaaccaaacatatttccaatgcaattattcaatgaaagcttattctaacaaacatacctgaaaattattgactttttttcaaaaaaaatcatatactctcaaatctttaacaaagatttaaaaatccattatttcttaataaggctttgaaagtattcacatcacaaagcttgagcgagttaccttcaattgtctggaaggtgtcttgagctctgcccagtggggttctcagcttagaaagaacagtgaattgtgcagcttcccatatggcccactgccaaaagatagcatctgtcttcaggagattgcgtggaattgttgactggtcacacttatccagtctctggcagctatagaacagtctttccaaccaattgtccttcctgggaaaagtagtttcatatttaaaagacaatgacaacttcattttaataatgaaaaaaaaaatgcaaggggaatgggaatacggaactgtaattttccctactccaaaaaaaggcaaaacctatgaaattgagaagcattatgtccccccctctcattttgaggtcttttatagttaacaggatgaggtacagtgtggaaggatgattagggtaaatggctcatgccagtcaggaatgaaactcattcaatgcaactaagcatctctagaatatctccacccccaccccactccccaaagtgttaatgacatcacatcagttaattgttaaccacatttcattactcaatttcaaagcccatttttgtttctacagatgctatcttcaaagcaattttcctattgatgaaaactgaaataacccatatgagaagaatgttacttgatactctgccacccccaaacatattttctcttcaaaactgcatgtaaagtcaagggaatcttaaaattatctttcccagataaaatagtcaaagaaatgccttaccctgttctatgagagttcccatacaaaataaaactaataacatcagagaaatcttgggggtggaatgtattacttggtgctttactcatgtgacttcttaatgctaaagaaatttcttgaatttctgtgtgattgttattgctgtagacagaaaataaagttgttgttatgcaaaatattttagcttaaaaggttagcacctactgtaagtggattatttacttattaactcactggaggtaaaaatatagtaaaatagagactttaaaatggatacagagatgtgattacaactttagatcctttttttattcacctcagatgggtaatgtgccgacatcataagaggatttgagggaggcatatcaaacatgtgaacataaaaacccaatcattatgcttatgtattacaaaaggatcaagtttaggctcttaaaagctcccaaatcaacttgatcaaaaacaatgaaagattactgtttagtttttcaaatatctgagctactaagaaacatattttggcactacatgagttattctatactaattattgtgagcctataaagctcattaaaaatttttaattttcttgcagaactgcaaaatttgattatttgacatcacttcaatcactggcaagcagggccataaaagatgtgtcattaatgctctaataggtgatctgtcttctcctaaagtagacaaccagtagaggctgtaaatataacagaatgtctttgctccaaaacaactgttataccttaggacaacatctaaaggaattgatttcaacagttttccaaatgcttgtcgaatacgagttccacggtgcactagttgaacacggcaaacatcaacacatctatgaaagaacgaaatagacaaagcaggtgtgttaacatttccaggttattagggttaatgtcaaaagacatgatcttaatttcatacctctgtaaaagatcatctggcaaggaagaggacagagcgtgtagactgctgcatgcctgcagacagatattcacatcttcaacgagagctattaaacattaaaagacagttactttcagctggccaaaagaaattatatcccagtttgtcataattatctgaatccattcattcattcaacaaagagtgagtgcctactacagactaggcactgttcttgtccagaatccttattgactgtcacatttggaaaaatgacacattcaacaaaacccatgtaatgtaactgatgggtcatcacacaaacctttttctgagagaaaatgtaaaagtatatgcaaaatataaacattcacataagcttaaaaatgtgacaatcacttcaaaacatttttctaatactaagaatgaaaaaaatcaagactgtgtatctgtcattaaaatgaggattacacatcttcaggtcaggaaaagagctcgattgatgaccatctcccattaccaaagacccttttaaggactgataaacaaaatagaaaaaaaaaaaacagagtcttactgttggctaaaaggcctttgcaaaatttatggaaagacggaagacagaataaaggtgcatatgtttcggacttcttcattaaaacagctacttccaaagcccaagtcattaacagtttcctgaaacacaaaatatacagttgactgtacacaaaaaaaacaacaacaaaaacaaaaaaacgttaaaagcctagtcttcttacattggttttctcttggtttttcaaacatctcaaacaataaaaaataaaaataaaaaatgaaactatagaaattactgtcaaaattgttgtgtgccttttaagaaaacctcccaacgcagcataatagcaaagaggccgggcatggtggcttacctgaggtcaggagttcaagaccagcctggccaacaacatggtgaaacaccatctctactaaaaatacaaaaattagctgggtgtggtggcggtcacctgtaatcacggctacttgggaggctgaggcaggagaattgcttgaacctgggaggcagaggttgcagtgagcaaaactccgtctcaaaaaaaaaaaaagcatagaatattaaaaatctatatatattcttctatgaaacactgggggtgagggattgaggtttttcatgtatttcttttcagaaagaataagaaagcctagattaaataataaaaccaaattataaggtgtttgacaataaagaagctgctctacctcacctctataatccacatttttttaaatgttttgtaatccacatttcttattctcaaattataaaggcaaattaacaaagttaggaatagttaatactatataatatctgttacctcgtgtcctggttaaggttatctttcttaagtaatattcccagaagatttaacataattgagaaatgtttctttgtggccgtagttacagtgctaatcacagctccatcaaacaaaggaggagaggaagaactgaggctactagagataaagtgatcatgcctgaaagacaaagcatagattatcttttcatctttaatcaaagaaagcaagcaagcccaaagttaaatcaacatacatctttaaaatctatccattaaaaaaataaaatgttttgtggggttcttttgttaagaaaaatttgtgaatacagtacctggtacaatgagaatacaaagtgtagagcacagcatactgaatggtagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggacatttttaaattaaaattacagactggaagggatctagtacactacacctgggacaaatactcttttgtgaagtcagtaaagcctttgcgtgcaatatagcatctctatgcaatgcagcaactcctcgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccgcatctctactaaaattacaaaaattagctgggcatggtggcgcacacttgtaatcccagctactcaggaggctgaggcaggagaattgcttgaacttgggaggcagaggttgcagtgacccgatatcataccaatgcactccagcctagatgacaaagttaagactctctctctcaaaacaaaacaaaacaccagccacatacaaaacacaggaatgagagtacctgtgttccaagaaaactttcttgagtcggagtctctcgctctgttgcccaggctggagtgcaatggggtgatctcagctcactgcaacctctacctctggggttcaagcaattctccctgcctcagtctcccaagtagctgggattacaggtgcccatcaccacgccctgctaacttttgtatttttttagtagagatagggtttcaccatgtgggccaggctggtcttgaactcctgagctcgggtgatctgcctgtctcagtctcctgagggattacaggcgtgaaccactgcgcccagcccgagaactttctttacaaaaacaggcactagtgttgtgatggttgtacacttctgtgaatatactaaaaatcagtgaattatacacttaaaataacaaacaaaaaacaggtgctgggctgtatttggcccacggaccatagtttgctgatctctgatctaaacagagccctttgtatgtgccttttgtggaagtagactgtatttcctcaattttccatatactgcaaatggcaaggtgccctgttcaataaggaaacaaaggcacaccctgccactctacaccttttccatccatctttttcctttacactgccaagacactccattccacctgactgccccatccccacccactttctccttatttctagagtacaggacataaacatctttgaatctgtaaataatgtgaataattttcctcaaaaatcaagctttcatgtttgaagaagagtttattgtgacttcaaacataagctgtaactggtaataagcgaagcagctatggaattatacaaggcaatccaatcaaacaacacggagcacattgaagcgcaaacatcaaattttaccttcttcctcctaaaaactttattccctaattacatccattactttctttctttgtttctttctttttttttttttttcttttgagacagagtctggttctgtagcccaggctggagtgcggtggtgtgatctcagctcactgcaacctccacttcctgggttcaagcaattctcctacctcagcctccaaagtagctaggattacagctgtgcaccaccacccctggctaatttttctatttttagtagaggtgagctttcaccatgttggccaggttggtctcaaactcctgaccacaagtgatcagcccgacttggccttccagagtgctgggtttacaggtgtcagcaaccatgcccagcctacacctattattttctattaaaaataatgtttttcaactctgtgtggtccaataggaagaagaaatacacaaaccataaacaataaatacaaatcaagagcagggccacgtcaaattacttaaaaaaaaaacacacacaggctgggcgcggtggctcatgcctgtaattccagcactttgggaggctgaagcgggtggatcacctgaggtcaggagtttgagaccagcctggccaacatggtgaaatcaagtctctactaaaaatacaaaaattagcccgtcatagtggcaggtgtctgtatctcagctactcgggaggctgaggcaggagaattgctggaacccgggaggcagaggtggcagtgagccgagattgcaccactgcactccagcccaggtgacaacagcatgactctgtctccaaaaaaaaaaaaaaaaattcccccccccccaaaagaaagactaaaggttgagtatcccttattcaaaatgcttgggaccagaagtctttcagactttgtatatgtttggatttgagaatacctgcatatatataaaatgagatatgtgggggatgggacccaagtctaaacacgaaattcacttatgtttcatagacaccttctattcatagcctgaagatcattttatgcaatattttaaataattttgtgcatacaacagtttggactcatcacatgaggtcgggtttggggttttccacttggggcatcatactggtgctcaaaaagtttcaaattttggagcattttagatttaggattttcagattagggatgctcaccagtaagtgttatgaaaatattccaaaatccggctgggcatggtggtgctcacctgtaatcccagcatttttggaggccaaggcaggtggatcacctgaggtcaggagttcacaaccagcctggctaacatggtgaaaacccatctctattaaatacaaaaaaattagccaggcgtggtggcgcatgcctgtaatccgagctacttgggaggctgaaacaggagaatcgcttgtacctgggaggcggaggttgcagcgagccaagatcgcaccattgcacttcagcctgggcaacaagagtaaaacactatctccaaaaaaaaaaaagtattccaaaatccaaaatcaaaaacacttccagtcccaagtatttcagataaggaatattcaacctgtatgaatgtttctagggaaaaagagacagccaaaatataagaccatgtataagaactaacttcagtagacagaaagaaaaaagtaccaggggaagaagaaagagaccgcattttaaaacaactatacaaatttgagctgtaagaaacactgacattttctataagcatgctagagcaaacaggagaaattcataagacattttctagaaaataaaactaatataaaaaaacttatcaagatttgtcaaggaaaaagaagaaaagttaaatataatggcaagaaaacattcctaccaattttatttatccaggcatgtcttaaatatggctgtttgttacatggagaaaccttaaatgcatactggtaagtgaaagaagccaattgaaaaggctacatactatatgactccaactacatggcattctggaaaaagcaaaatgatggagacagtaaaaagatcaggggttgccatgggcttaagatggagggagggaggagtggggagagggaatgaggaaggagtgggtagaacataaaagatttttagggaagtgaaactatcctgtatgatactggtaataggggatacatgtcattacacatgttaaagtccatagaatacataacacaaagtaaactatgaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacttattttacagttatcatgggcattttttcacattagcaaagagaggtgtaattctggcagaaatgctcagcagaatgtcatctagaatttgctttaaaataagccagttagagatgaaaggatagcaaagaggcctagatgaaaccagatgggccgtttgcttctaattatagaagctgagtgttaaatatgtacaaatttattatactatgctccctatttttatgtgcttcagaatgtccataataaaagtggggggaggatatttatggttaagaaattaaaggaggccagccgggcacggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcgaaagagtgagactccgtctcaaaaaaaaaaaaaaaaaaaaagaaattaaaggagaccaggcatgactgctcacacctgtaatcccagcactttgggagggcaaggcaggaggattacttgagaccaagaattcaagtccagcctagacaatgcagtgagaccccttctctccaaaaaatacaaaggttagccaggcatggtggcatgcatctgtagtcccagatagtcgggaggctgagtgggaggatcacttgagcccaggagtttgaggctgcagtgagctctgattgtaccgctgcactccagccaggggaatatagcaagatcctgtgaccaaaaaaaaaaaaaaaagaaaagaaagaaaagaaaagcaaaaaacaaagaatctggtgcgtagagcaatgtttcctcagaaaaaacgagtaaagctacactgagactagctatcaaccactaaaaatagaggcctggcagagtggctcatgcctataatcccagtactttgggaggccaaggcaggtggatttcttgagcccaagaattcaagaccagcctgggcaacatggcaaaactccatctctacaaaataatataaaaaattagccaggtgtggtggtgcacgcctgtagtcctagctacctggggggctgaggtgggaggatcacctgaacccaagaggtcaaggctacagtgagccaaaatcatgccactgcacttcatcttgtgcaacagagtgagaccctgtctcaaaaaaaaattgcattaaaaataaaagtaaatagacactaaaatgaaggcatagattataagactgatgaatgtactctaaaaaaataatataataaagcaaagcccttatgttttttcttttttggagacagggccttttttgtcaccttggctgagtgcagtggcacaatcagagctcacttcaacctcaagttcctgggcttaatcgatcctcctccctcagcctcccgagtagctaggactgcaggtgcacaccactacaccaagctaatttttgactttttgtacagatggggtctcactacattgcccaagctgtgccagaattcctggatgccagcaatccttctgctttggcctcccaaagtgctgggattacaagcataagccaccatacccagacaaagcccttaatttcttacatatcgatttaagggcctgaataaaccaacacattaaaaaggaaaagaataattcacataccagcatgagtaaattcaagactgagatgatataatcggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaatctgtaaatggggaaaacaagcagctttttaaaaaaattcacgtgcttccacaaagcaaggaaatactttttatttaatgcaatttcaactgaaaattaactgcttgccttgccagcagtctcttaatattctagttctcagtagctgaataatgatacctttactacaatatgtaaacatgatcttggctaaaaaatcctaaagtgctactatgacaggaaatggaatctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaactttctatctactgatggtctcttttgaaagataagcactctcatgcttaccacatagtatcttcaaaaatcatatgatttccaatacacacacaaacaaaatcccccacttaactataatggccaataattgtgtactaaatttctaataaaataggggagaaaacagagcaaatgttaaaaaatacttctataatatttaacaaccaatacatacaggattttatttagtctacccataattttcattaaaagtatccttggaggttgggcatagtgactcacatctatcatcctagcactttgagaggattagctggaaggttctcttgagtccaggagtttaagaccagccatgtcaacataacaacacctcatctctaccaaatttgtttttaaattggttgggcgtggtggctcacaccagtagtcccaccaactacttgagaggctgaggtgggaggatcacttaagcctgggaagtcaaggctgcagtgagccaagatcgtgccactgcactccagcctgggcaacagagaccagtggctcatgtctataatcccaacactttgggaggctgaggtgggaagactgcttgaggccaaaagttcaagaccagcctgggaaacactgagacgccatctctacaaaaataaaaaattagcaggagctatggtgggaggatcacttgagcccaagagatagaggctgcactgagtcgtgatggcaccaccccactttaaaaagaaaaaaaaaagagctgggtatggtgacacccgcttgtagggctgagtgaggtgggaagttcacctgggcccaagagttcaagactacagtgagctatgattgcactactacactccagcctgggtgagagagtgaggctccagctccaaaaataaataaaaataaaataaaaaaataaaaaccccaccattctaccattctcaaaggcctaaaagatcctcataaatcaatatacacctatcctataaattatgtcccttttattttatgtctgaattaacagctttttatttcaactctgtacagtcttcaaacaaccaccttttagacattaaaaatgaagcaaagatattaaaccattttgaaaccatattggtttaaaataccgatatgctggtttcatttatctttaagttctgacatttctgctcaagtacacaacttactatataatcaatatcctattttatttagcaacatgttcagcaaaagtatatgctcctaaaagcaagttttatcctaacggtaaaattttcatcagttagattaaattttttatgactgtatcacacatgcttctttctccttattcacagccgagtacaatgcctggggttcatttcttgtgtcttttccactgaaccctcattggatgtgctatatacagtgcagctaatgtttgaggctgctgaagtgtggcaatctatctacctcatttttaatttgtttatgttctttgatatcaggctatcaaagaatataaagatatacaagttttcatatgagttccatcttatgctcagagaagattactttctgaggcttctcctatagtgtgctattcgtaatatgttgaaaaactaaaaggaaacccaataatttaaaagtaaaattataagaaatattatttaaaaatgaaagaataagatttaaaaattcagagtggccttttgtcatgggagggtagggaagttggatgaaaggaggatgagatataaaaggattccctgcttttctggttatttaagaaagcagtcagacaatatatacatatacacatacatacatacatgctaaacaaatgaaggattaataacagttcacctggtaaagagaagcatttacaatgtaaaacaattttatttttgaatgacacttcaaatgcccaaaagcacttacatctgttacgtatgcctcagtaatcggaggacccgaattgggctgaagcgttccccaatgctcctcaccacagtactaaatacccggagaagcgcagtcagctttggtaatgacactgatggaggagggacgtcttcatccactgattccccagaggccacatggctgaggtcctagatgtgaattcacagcattcttaataagtagtacattgtttaaaaaaaaaaaaactctaaaatatttcaatcaattcattttagaatagatttttaggcttttagaaagagaactgtggcccatgagaatattcatgactctgaatataaaaatgggttttacctaattatttcaaaaagccaacattaaacccaatagacaacaaattaaggaaataatctcttaaatcaactcagaaagctgttggggaaaaataaattctagcacatatgctctagttatatgtaggtataaatgaagacggaagcttttgccactcctgaattagtttttggctaaaaatctcattctaggtattctttgagccactcagctcaacagtaagtcctccaaaccaagagcatgcacatgaagagcaaagggagattacaagacctggtctacagatgtgtaactgaagaagtacgatatatgaaaaggacaagattcgcaaaaactaggatactagaaccaatctatacatttacctaaaattaagcaccaaaataacagaagagaatgagatcttaaggataacaaggggaagcatctctacaaactagaatgtgtggcttatgagaggtagatcagctttaaacgtgggctgtgaaaaaagacattctaggtgtgggggcaaagaaaaaacaacacagaagcaaaacatttccttgcttttctaggaaagagtaaacacatcagtacagctaaaggtactgaattcctgttgactacaagcagcaaagatgataaaaacaagatgaggccaaaatctttatgggagccttgattggttgatctgaataggggagaaacacaaagagattcagataagagatagcacagagttaagccatgacagtggggccagaaaagccaagtaccagtaacagaggcttcagcagtgctcttaaagctcctatgctatattcgtacagccacaaaagctggctgaagccaaggcctgtcctccaaagtacgattcagatctcccgtacatatgtaagaggaaaatctttaggagcttttggtgttttgtgtttttttataacacaacatcaatttgctttaagactctgaagactgggaacaaaaaataaaaataaataacaaaaaatgtctttagaaaaataccagctaccaagagtatgtaaagctttgcgaaatacgaagcttgcaacgtttcttttagtctctccagtaattctcctggtaacttaaatacatctgaaataaatgtttaaaatactgactgagcacgggggctcatgcctataatcccagcatttgggaggccgacgcgggtggatcaccagtggtcaggagtttgagaccagcctggccaacatggtgaaaccccgtctctactaaaaatacaaaaattagctgggcatagtggcgggcacctgtaattccagctactcaggaggctgaggcaggagaatcatttgaacccaggaggtggaggttgcagtgagctgagatcgtgccattgcactccagcctgagtgacagagtgagactccgtctcaaaaaaaaatttttttttcaaaatattgcaatgggcttgtaatttctgcttaaatgtcaggaggtctgagccattttaaaataaatctagcacaatttaagattttttcttaaccaaaattttaagaaacagctttctatatactcacctcagcatatgcttccatgtcttctagaaaatgaccaagaagagtcgtagaaaatgcaagatcagctacccaaaatggctccaaactctgcaaccacccttggaatcgtataagaaattgtgaaagggtggggggagaaaaaacaccaaaaaatccaaattaaaaaaatataagaggcttgttttaaaaagtatccggttttcaagcagcataccctaaaacatgtcctatatcataaaattaagactgctaaacatgctgatcacgattaaccaatacctctttaattaatacctctttaatttctgcaaaaattaacatgtaaatgttatttccttactttttcagtaaatttcctatctatattgtcactacacatgacttaacactaaaatgccacaatctaccattggcctggctaatcccagggccacatctaaccattaaaggtgtatacttatctcctcagtgaaaatgaaacagaccactatcacctgaatatcctattttcaaaagtttattacaccaagtaagttacgagaaactatgacacttgaaacaagctgaaatgtgcaaatgagccatgctagtcattcacttaactccaaaaaaatgggaaacaaaaccatttctcatttatgacaattctccaaattaaccctatttccttttttaaaaaaataaccagaaaaacaataaaatgttacaaataacttggatcttccattgtccacttcagggtattgccactgcaatatattcttaccatatactttttcctaccagtacaaactacaaataacttgggtaagtcctgtctgtacttattctacccacctactagtaatttcttctgaaaatatatatttagctaacaagtaatgttcatttacaatataacatttctctgaattagttttcttgcattattaaagaaatgttattgatagatggtcactgggggaccactgctcctccccgacagtatttaaataactggtataggctgcaagacttaccagatacctgctgcgtgagcgaaggtttctgagtatgatctatatgccatccaactaatatatcaactgtatccttgatggaaacaaagagagagggggccaatcattttaagatattactgccattcacctgtggaccattccacagcaaaagatcctaaaaggagcatctatgttctacctactcaacattctagaaacttagaaaggggagaggggcaggaaaataaaagaactacatttctgacaacaatgaaatagtttattttcttcaaatattttaaggtacgaacgtcagaaataaaaatgcagcatttaaccctggaacctcaaatatcactgattatactcaaaggagcagaggcattgttttccatctgattcctcagttcctcacacacacaaccatccccctcaccccatgatctgaaaagcgaaatgag
